United States Patent 11,725,251 (METHYLATION MARKERS AND TARGETED METHYLATION PROBE PANEL) - sequence listing, part 10

SEQ ID NO: 102020 - DNA, 409 bp, Homo sapiens
  misc_feature 1..409: note = chr1:6484931-6485340
  misc_feature 1..409: note = Hyper
  source 1..409: mol_type = genomic DNA
cgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggtgggtccgcgcggttcgccaggggcactga

SEQ ID NO: 102021 - DNA, 89 bp, Homo sapiens; identical to SEQ ID NO: 69836
  misc_feature 1..89: note = chr1:6488312-6488401
  misc_feature 1..89: note = Hypo
  source 1..89: mol_type = genomic DNA

SEQ ID NO: 102022 - DNA, 435 bp, Homo sapiens
  misc_feature 1..435: note = chr1:6500744-6501179
  misc_feature 1..435: note = Hyper
  source 1..435: mol_type = genomic DNA
cttcgcggcgagccgcggccacaccaaggtgctcagctggctgctgctgcacggcggggagatctcggctgacctgtggggcgggaccccgctgcacgacgccgccgagaacggggagctagaggtcagcgcgggcccggggtgggggcgcgcgccctctgctggcaccgcgctttcagcacggccctgcccgggcgcgggggtcccagctcgcggccgcggccgggtcctcactgcgtgcccccgcagtgctgccagatcctggtagtgaacggcgcggagctggacgtccgcgaccgcgacgggtacacggccgccgacctgtcggacttcaacggccacagccactgcacccgctacctgcgcacggtggagaacctggtacgatccctgagctgctcctgtcgcattctttcttctcgcccctccacccca

SEQ ID NO: 102023 - DNA, 2018 bp, Homo sapiens
  misc_feature 1..2018: note = chr1:6507126-6509144
  misc_feature 1..2018: note = Hyper
  source 1..2018: mol_type = genomic DNA
gcccagccagtgccccgtctccaccgttgagcccaagtgccaggtctgcgtggtcccctcctggctgtgtgagccccctcccggctgtgtgcgtccctccgggctgtgtgcgcccctcccggctgtgtgcgcccctccccactgtgtgcgcccctcccggctatgtgcgtccatctcggccgtgtgcgtgctgggccgcaggcgccagggccggggcccggacgctccacaaagggctctttgtgtcgccgcggcgccccccgcgcgggtgcctgaccgggggcgggagcagggtcgtggcgtccgaacctccgggctgcagggggcgcggagcgggcgggctggcccagaaaacaaatcctgcggtgtcgcatttcctgcaacgtgagccaggtcgggcggggtgaagggtctgaggccaccgcagggacgcatgggctggagagtggggcagaggacagcccccacccggtcactcagtctttggcccggccgcctcactctccctcactgagctgggcctagttgggggcagctgcgatggggtgggaagccacgctgtcacccgaccccgccttacggcccctgaaatccgaggcttgagcgcgggtgtcggtgtcgctttcgtggatggcgatggtttccagatgcaggaggggaagggtggggacgcgacccggagccgggggccaaatatgagaggcctcctctgcccacagtcagccctctcccctctcgggcggggatgaaggtgggggctcagctcccagcttagggagaggcgcagggggcggggtcacatctggccggggacgggtgcagagccgcggccaggtgtggcaaagtagttggcgccccctgtggcatccgcgacggctgggggggttcagcctgggattggcgggccccgggtgatgtcaggccgtcggagcccataggctggctgtgcgcgggtggctgtaacctgagaggaagtatcaggtaacgcaggtgtcgggtcctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtcc

SEQ ID NO: 102024 - DNA, 34 bp, Homo sapiens; identical to SEQ ID NO: 69842
  misc_feature 1..34: note = chr1:6533352-6533386
  misc_feature 1..34: note = Hypo
  source 1..34: mol_type = genomic DNA

SEQ ID NO: 102025 - DNA, 36 bp, Homo sapiens; identical to SEQ ID NO: 69843
  misc_feature 1..36: note = chr1:6537501-6537537
  misc_feature 1..36: note = Hypo
  source 1..36: mol_type = genomic DNA

SEQ ID NO: 102026 - DNA, 30 bp, Homo sapiens; identical to SEQ ID NO: 69844
  misc_feature 1..30: note = chr1:6542460-6542490
  misc_feature 1..30: note = Hypo
  source 1..30: mol_type = genomic DNA

SEQ ID NO: 102027 - DNA, 260 bp, Homo sapiens; identical to SEQ ID NO: 69845
  misc_feature 1..260: note = chr1:6545379-6545639
  misc_feature 1..260: note = Hyper
  source 1..260: mol_type = genomic DNA

SEQ ID NO: 102028 - DNA, 46 bp, Homo sapiens; identical to SEQ ID NO: 69846
  misc_feature 1..46: note = chr1:6545885-6545931
  misc_feature 1..46: note = Hyper
  source 1..46: mol_type = genomic DNA

SEQ ID NO: 102029 - DNA, 20 bp, Homo sapiens
  misc_feature 1..20: note = chr1:6621025-6621045
  misc_feature 1..20: note = Hypo
  source 1..20: mol_type = genomic DNA
agagtcggaagactctgtct

SEQ ID NO: 102030 - DNA, 139 bp, Homo sapiens; identical to SEQ ID NO: 69864
  misc_feature 1..139: note = chr1:6627618-6627757
  misc_feature 1..139: note = Hypo
  source 1..139: mol_type = genomic DNA

SEQ ID NO: 102031 - DNA, 30 bp, Homo sapiens; identical to SEQ ID NO: 38839
  misc_feature 1..30: note = chr1:6635034-6635064
  misc_feature 1..30: note = Hypo
  source 1..30: mol_type = genomic DNA

SEQ ID NO: 102032 - DNA, 209 bp, Homo sapiens
  misc_feature 1..209: note = chr1:6663691-6663900
  misc_feature 1..209: note = Hyper
  source 1..209: mol_type = genomic DNA
cgccctaggggctcccgggcctccctgaagcagctgctcggactccacgagagggtaactgggtataaagagcgagggctcaaagtcagataggagaccgccttgaaactagatgacgccactaagcacagtcccgccgtcacttgtactgcggtggggaatggtgaaagaaggaatcgcccttattttagttccgatagacacagcac

SEQ ID NO: 102033 - DNA, 30 bp, Homo sapiens; identical to SEQ ID NO: 69870
  misc_feature 1..30: note = chr1:6765811-6765841
  misc_feature 1..30: note = Hypo
  source 1..30: mol_type = genomic DNA

SEQ ID NO: 102034 - DNA, 23 bp, Homo sapiens
  misc_feature 1..23: note = chr1:6776365-6776388
  misc_feature 1..23: note = Hypo
  source 1..23: mol_type = genomic DNA
agggagaccgtggggagagggag

SEQ ID NO: 102035 - DNA, 183 bp, Homo sapiens; identical to SEQ ID NO: 69873
  misc_feature 1..183: note = chr1:6801549-6801732
  misc_feature 1..183: note = Hypo
  source 1..183: mol_type = genomic DNA

SEQ ID NO: 102036 - DNA, 17 bp, Homo sapiens
  misc_feature 1..17: note = chr1:6811500-6811517
  misc_feature 1..17: note = Hypo
  source 1..17: mol_type = genomic DNA
cgcgcctggcctataat

SEQ ID NO: 102037 - DNA, 30 bp, Homo sapiens; identical to SEQ ID NO: 69883
  misc_feature 1..30: note = chr1:6964959-6964989
  misc_feature 1..30: note = Hypo
  source 1..30: mol_type = genomic DNA

SEQ ID NO: 102038 - DNA, 195 bp, Homo sapiens; identical to SEQ ID NO: 38841
  misc_feature 1..195: note = chr1:6984148-6984343
  misc_feature 1..195: note = Hypo
  source 1..195: mol_type = genomic DNA

SEQ ID NO: 102039 - DNA, 112 bp, Homo sapiens; identical to SEQ ID NO: 69891
  misc_feature 1..112: note = chr1:7023766-7023878
  misc_feature 1..112: note = Hyper
  source 1..112: mol_type = genomic DNA

SEQ ID NO: 102040 - DNA, 35 bp, Homo sapiens; identical to SEQ ID NO: 69894
  misc_feature 1..35: note = chr1:7067754-7067789
  misc_feature 1..35: note = Hypo
  source 1..35: mol_type = genomic DNA

SEQ ID NO: 102041 - DNA, 30 bp, Homo sapiens; identical to SEQ ID NO: 26040
  misc_feature 1..30: note = chr1:7130249-7130279
  misc_feature 1..30: note = Hyper
  source 1..30: mol_type = genomic DNA

SEQ ID NO: 102042 - DNA, 30 bp, Homo sapiens; identical to SEQ ID NO: 38843
  misc_feature 1..30: note = chr1:7162881-7162911
  misc_feature 1..30: note = Hypo
  source 1..30: mol_type = genomic DNA

SEQ ID NO: 102043 - DNA, 30 bp, Homo sapiens; identical to SEQ ID NO: 69909
  misc_feature 1..30: note = chr1:7315042-7315072
  misc_feature 1..30: note = Hypo
  source 1..30: mol_type = genomic DNA

SEQ ID NO: 102044 - DNA, 30 bp, Homo sapiens; identical to SEQ ID NO: 69910
  misc_feature 1..30: note = chr1:7445788-7445818
  misc_feature 1..30: note = Hypo
  source 1..30: mol_type = genomic DNA

SEQ ID NO: 102045 - DNA, 30 bp, Homo sapiens; identical to SEQ ID NO: 69911
  misc_feature 1..30: note = chr1:7500700-7500730
  misc_feature 1..30: note = Hypo
  source 1..30: mol_type = genomic DNA

SEQ ID NO: 102046 - DNA, 221 bp, Homo sapiens; identical to SEQ ID NO: 69937
  misc_feature 1..221: note = chr1:7728823-7729044
  misc_feature 1..221: note = Hypo
  source 1..221: mol_type = genomic DNA

SEQ ID NO: 102047 - DNA, 44 bp, Homo sapiens; identical to SEQ ID NO: 69944
  misc_feature 1..44: note = chr1:7740637-7740681
  misc_feature 1..44: note = Hyper
  source 1..44: mol_type = genomic DNA

SEQ ID NO: 102048 - DNA, 201 bp, Homo sapiens; identical to SEQ ID NO: 69945
  misc_feature 1..201: note = chr1:7750833-7751034
  misc_feature 1..201: note = Hypo
  source 1..201: mol_type = genomic DNA

SEQ ID NO: 102049 - DNA, 39 bp, Homo sapiens; identical to SEQ ID NO: 69946
  misc_feature 1..39: note = chr1:7764052-7764091
  misc_feature 1..39: note = Hyper
  source 1..39: mol_type = genomic DNA

SEQ ID NO: 102050 - DNA, 137 bp, Homo sapiens; identical to SEQ ID NO: 69947
  misc_feature 1..137: note = chr1:7764556-7764693
  misc_feature 1..137: note = Hyper
  source 1..137: mol_type = genomic DNA

SEQ ID NO: 102051 - DNA, 139 bp, Homo sapiens; identical to SEQ ID NO: 69948
  misc_feature 1..139: note = chr1:7765187-7765326
  misc_feature 1..139: note = Hyper
  source 1..139: mol_type = genomic DNA

SEQ ID NO: 102052 - DNA, 40 bp, Homo sapiens; identical to SEQ ID NO: 69954
  misc_feature 1..40: note = chr1:7842867-7842907
  misc_feature 1..40: note = Hypo
  source 1..40: mol_type = genomic DNA

SEQ ID NO: 102053 - DNA, 25 bp, Homo sapiens
  misc_feature 1..25: note = chr1:7908876-7908901
  misc_feature 1..25: note = Hypo
  source 1..25: mol_type = genomic DNA
ttctgtacatcgttcaggtcaatgt

SEQ ID NO: 102054 - DNA, 465 bp, Homo sapiens; identical to SEQ ID NO: 69961
  misc_feature 1..465: note = chr1:8002286-8002751
  misc_feature 1..465: note = Hyper
  source 1..465: mol_type = genomic DNA

SEQ ID NO: 102055 - DNA, 30 bp, Homo sapiens; identical to SEQ ID NO: 69962
  misc_feature 1..30: note = chr1:8044661-8044691
  misc_feature 1..30: note = Hypo
  source 1..30: mol_type = genomic DNA

SEQ ID NO: 102056 - DNA, 309 bp, Homo sapiens; identical to SEQ ID NO: 69964
  misc_feature 1..309: note = chr1:8086092-8086401
  misc_feature 1..309: note = Hyper
  source 1..309: mol_type = genomic DNA

SEQ ID NO: 102057 - DNA, 30 bp, Homo sapiens; identical to SEQ ID NO: 69965
  misc_feature 1..30: note = chr1:8152862-8152892
  misc_feature 1..30: note = Hypo
  source 1..30: mol_type = genomic DNA

SEQ ID NO: 102058 - DNA, 722 bp, Homo sapiens
  misc_feature 1..722: note = chr1:8277113-8277835
  misc_feature 1..722: note = Hyper
  source 1..722: mol_type = genomic DNA
tcccagagatgagggcgaggggaggggaccggagagcagagggaggcgagggagcagaaggaggagcccccaggtgggaggacgggggtctgcccagctcggccggggagtgcagtaggggggcgtcctcccgactaagggcaaaggaggtgacggcggggacgcccgccccgtgacgaggagggctcggccgagccgtcccggggcgacaggaagcggccgccctttgaaggcccagcggcggcgctgggtcagccaggccagcttgtgggggagcggccgcccgcgcacggctggggccggggccagggccggagggcgccgcaggaaggggccggggccggggcggcttctctccccgcagccggcgcctccacgcggcggtcaagctcgcgcgtgggctttagcagtttcgggcgtgcacgtgcgcggaggctcctgcctctgcggagctcgcgccctcaagagacttccaggagggtttggagcccgggtttctctttcccccagccccggaacccgagtctgctccaagtgcgcatctgcgcggcggccgacggggacgcagcccggtgtccccggcaggaccccggagcaacgtctcctggagcctgtgcagaagctgggcttggcgagggagggggtgcttccggggacacccgcgcagggaaaaggaggatgctagtgacccatcctttctcgccgtgcgctttaatttcaac

SEQ ID NO: 102059 - DNA, 150 bp, Homo sapiens; identical to SEQ ID NO: 69996
  misc_feature 1..150: note = chr1:8742771-8742921
  misc_feature 1..150: note = Hypo
  source 1..150: mol_type = genomic DNA

SEQ ID NO: 102060 - DNA, 30 bp, Homo sapiens; identical to SEQ ID NO: 70036
  misc_feature 1..30: note = chr1:9174714-9174744
  misc_feature 1..30: note = Hypo
  source 1..30: mol_type = genomic DNA

SEQ ID NO: 102061 - DNA, 130 bp, Homo sapiens; identical to SEQ ID NO: 70040
  misc_feature 1..130: note = chr1:9243203-9243333
  misc_feature 1..130: note = Hyper
  source 1..130: mol_type = genomic DNA

SEQ ID NO: 102062 - DNA, 30 bp, Homo sapiens; identical to SEQ ID NO: 70050
  misc_feature 1..30: note = chr1:9379709-9379739
  misc_feature 1..30: note = Hypo
  source 1..30: mol_type = genomic DNA

SEQ ID NO: 102063 - DNA, 19 bp, Homo sapiens
  misc_feature 1..19: note = chr1:9391674-9391693
  misc_feature 1..19: note = Hypo
  source 1..19: mol_type = genomic DNA
tcaccgtgcctagccggca

SEQ ID NO: 102064 - DNA, 30 bp, Homo sapiens; identical to SEQ ID NO: 70068
  misc_feature 1..30: note = chr1:9580479-9580509
  misc_feature 1..30: note = Hypo
  source 1..30: mol_type = genomic DNA

SEQ ID NO: 102065 - DNA, 83 bp, Homo sapiens; identical to SEQ ID NO: 70069
  misc_feature 1..83: note = chr1:9648276-9648359
  misc_feature 1..83: note = Hypo
  source 1..83: mol_type = genomic DNA

SEQ ID NO: 102066 - DNA, 55 bp, Homo sapiens; identical to SEQ ID NO: 70070
  misc_feature 1..55: note = chr1:9661692-9661747
  misc_feature 1..55: note = Hypo
  source 1..55: mol_type = genomic DNA

SEQ ID NO: 102067 - DNA, 67 bp, Homo sapiens; identical to SEQ ID NO: 70071
  misc_feature 1..67: note = chr1:9711452-9711519
  misc_feature 1..67: note = Hyper
  source 1..67: mol_type = genomic DNA

SEQ ID NO: 102068 - DNA, 916 bp, Homo sapiens; identical to SEQ ID NO: 70072
  misc_feature 1..916: note = chr1:9712098-9713014
  misc_feature 1..916: note = Hyper
  source 1..916: mol_type = genomic DNA

SEQ ID NO: 102069 - DNA, 30 bp, Homo sapiens; identical to SEQ ID NO: 70074
  misc_feature 1..30: note = chr1:9740821-9740851
  misc_feature 1..30: note = Hypo
  source 1..30: mol_type = genomic DNA

SEQ ID NO: 102070 - DNA, 30 bp, Homo sapiens; identical to SEQ ID NO: 70077
  misc_feature 1..30: note = chr1:9828369-9828399
  misc_feature 1..30: note = Hypo
  source 1..30: mol_type = genomic DNA

SEQ ID NO: 102071 - DNA, 30 bp, Homo sapiens; identical to SEQ ID NO: 70091
  misc_feature 1..30: note = chr1:9877098-9877128
  misc_feature 1..30: note = Hypo
  source 1..30: mol_type = genomic DNA

SEQ ID NO: 102072 - DNA, 30 bp, Homo sapiens; identical to SEQ ID NO: 70092
  misc_feature 1..30: note = chr1:9897055-9897085
  misc_feature 1..30: note = Hypo
  source 1..30: mol_type = genomic DNA

SEQ ID NO: 102073 - DNA, 32 bp, Homo sapiens; identical to SEQ ID NO: 70093
  misc_feature 1..32: note = chr1:9899160-9899192
  misc_feature 1..32: note = Hypo
  source 1..32: mol_type = genomic DNA

SEQ ID NO: 102074 - DNA, 30 bp, Homo sapiens; identical to SEQ ID NO: 70094
  misc_feature 1..30: note = chr1:9907045-9907075
  misc_feature 1..30: note = Hypo
  source 1..30: mol_type = genomic DNA

SEQ ID NO: 102075 - DNA, 242 bp, Homo sapiens; identical to SEQ ID NO: 67385
  misc_feature 1..242: note = chr1:10057380-10057622
  misc_feature 1..242: note = Hyper
  source 1..242: mol_type = genomic DNA

SEQ ID NO: 102076 - DNA, 155 bp, Homo sapiens; identical to SEQ ID NO: 67388
  misc_feature 1..155: note = chr1:10094917-10095072
  misc_feature 1..155: note = Hypo
  source 1..155: mol_type = genomic DNA

SEQ ID NO: 102077 - DNA, 86 bp, Homo sapiens; identical to SEQ ID NO: 67392
  misc_feature 1..86: note = chr1:10103747-10103833
  misc_feature 1..86: note = Hypo
  source 1..86: mol_type = genomic DNA

SEQ ID NO: 102078 - DNA, 55 bp, Homo sapiens; identical to SEQ ID NO: 67393
  misc_feature 1..55: note = chr1:10166572-10166627
  misc_feature 1..55: note = Hypo
  source 1..55: mol_type = genomic DNA

SEQ ID NO: 102079 - DNA, 30 bp, Homo sapiens; identical to SEQ ID NO: 67402
  misc_feature 1..30: note = chr1:10206714-10206744
  misc_feature 1..30: note = Hypo
  source 1..30: mol_type = genomic DNA

SEQ ID NO: 102080 - DNA, 23 bp, Homo sapiens
  misc_feature 1..23: note = chr1:10232969-10232992
  misc_feature 1..23: note = Hypo
  source 1..23: mol_type = genomic DNA
ttgtgttacaactgccgacagga

SEQ ID NO: 102081 - DNA, 30 bp, Homo sapiens; identical to SEQ ID NO: 67409
  misc_feature 1..30: note = chr1:10493353-10493383
  misc_feature 1..30: note = Hypo
  source 1..30: mol_type = genomic DNA

SEQ ID NO: 102082 - DNA, 92 bp, Homo sapiens; identical to SEQ ID NO: 67411
  misc_feature 1..92: note = chr1:10534389-10534481
  misc_feature 1..92: note = Hypo
  source 1..92: mol_type = genomic DNA

SEQ ID NO: 102083 - DNA, 35 bp, Homo sapiens; identical to SEQ ID NO: 67415
  misc_feature 1..35: note = chr1:10601654-10601689
  misc_feature 1..35: note = Hypo
  source 1..35: mol_type = genomic DNA

SEQ ID NO: 102084 - DNA, 30 bp, Homo sapiens; identical to SEQ ID NO: 67424
  misc_feature 1..30: note = chr1:10783213-10783243
  misc_feature 1..30: note = Hypo
  source 1..30: mol_type = genomic DNA

SEQ ID NO: 102085 - DNA, 30 bp, Homo sapiens; identical to SEQ ID NO: 67426
  misc_feature 1..30: note = chr1:10819797-10819827
  misc_feature 1..30: note = Hypo
  source 1..30: mol_type = genomic DNA

SEQ ID NO: 102086 - DNA, 169 bp, Homo sapiens; identical to SEQ ID NO: 67428
  misc_feature 1..169: note = chr1:10838656-10838825
  misc_feature 1..169: note = Hypo
  source 1..169: mol_type = genomic DNA

SEQ ID NO: 102087 - DNA, 287 bp, Homo sapiens; identical to SEQ ID NO: 67436
  misc_feature 1..287: note = chr1:10854374-10854661
  misc_feature 1..287: note = Hyper
  source 1..287: mol_type = genomic DNA

SEQ ID NO: 102088 - DNA, 30 bp, Homo sapiens; identical to SEQ ID NO: 67437
  misc_feature 1..30: note = chr1:10856927-10856957
  misc_feature 1..30: note = Hyper
  source 1..30: mol_type = genomic DNA

SEQ ID NO: 102089 - DNA, 621 bp, Homo sapiens
  misc_feature 1..621: note = chr1:10948439-10949060
  misc_feature 1..621: note = Hyper
  source 1..621: mol_type = genomic DNA
ctcaagtgcctcattcgcgccctacccaggtccccgcccaggatcacaggatttgtgaccctggccttggccttgtccctaaaaccgtcacccgggtctcccaggcgagaggggcgggaggctccagacgcccagagcccacagcttcccgcccggggcggctgagcggtcccggggagagccctggagagagacagagaaggggaggcgtggagcggggcccccacagcagaagaggggcaggagggaggcgagagggggccggagtctggcccgagacagaaggggcggaggggcgcggggtggacgcggcccgggggtcccagacggggcgcccctccccacccggcccgccctgccccaccccccggcgcgggaggcccctgctccgcagtcggcggcgcccgggggagggggcgctgtgggggctcccggccgcccgccgcctgatgcgtatcgatcgcagcccggggtcgacgcgggggcaccagctgccggcgggcggggcgaccgcacattagcgcggccgggaccactccccggaacgcgggccgggcagcccattagacgcccccgggcggccgggcgaccactgcacgggcggggcgaggctggctccaa

SEQ ID NO: 102090 - DNA, 18 bp, Homo sapiens
  misc_feature 1..18: note = chr1:10959337-10959355
  misc_feature 1..18: note = Hypo
  source 1..18: mol_type = genomic DNA
taccctgtagggggccgg

SEQ ID NO: 102091 - DNA, 91 bp, Homo sapiens; identical to SEQ ID NO: 67468
  misc_feature 1..91: note = chr1:11036267-11036358
  misc_feature 1..91: note = Hypo
  source 1..91: mol_type = genomic DNA

SEQ ID NO: 102092 - DNA, 104 bp, Homo sapiens; identical to SEQ ID NO: 67481
  misc_feature 1..104: note = chr1:11073857-11073961
  misc_feature 1..104: note = Hypo
  source 1..104: mol_type = genomic DNA

SEQ ID NO: 102093 - DNA, 29 bp, Homo sapiens
  misc_feature 1..29: note = chr1:11089945-11089974
  misc_feature 1..29: note = Hypo
  source 1..29: mol_type = genomic DNA
gctgggattacaggcgtgagccacacctg

SEQ ID NO: 102094 - DNA, 19 bp, Homo sapiens
  misc_feature 1..19: note = chr1:11091314-11091333
  misc_feature 1..19: note = Hypo
  source 1..19: mol_type = genomic DNA
tcatgcctgtaatcccggc

SEQ ID NO: 102095 - DNA, 62 bp, Homo sapiens; identical to SEQ ID NO: 67487
  misc_feature 1..62: note = chr1:11095139-11095201
  misc_feature 1..62: note = Hypo
  source 1..62: mol_type = genomic DNA

SEQ ID NO: 102096 - DNA, 30 bp, Homo sapiens; identical to SEQ ID NO: 67489
  misc_feature 1..30: note = chr1:11104788-11104818
  misc_feature 1..30: note = Hypo
  source 1..30: mol_type = genomic DNA

SEQ ID NO: 102097 - DNA, 30 bp, Homo sapiens; identical to SEQ ID NO: 67492
  misc_feature 1..30: note = chr1:11115120-11115150
  misc_feature 1..30: note = Hypo
  source 1..30: mol_type = genomic DNA

SEQ ID NO: 102098 - DNA, 30 bp, Homo sapiens; identical to SEQ ID NO: 67493
  misc_feature 1..30: note = chr1:11118714-11118744
  misc_feature 1..30: note = Hypo
  source 1..30: mol_type = genomic DNA

SEQ ID NO: 102099 - DNA, 42 bp, Homo sapiens; identical to SEQ ID NO: 67500
  misc_feature 1..42: note = chr1:11124188-11124230
  misc_feature 1..42: note = Hypo
  source 1..42: mol_type = genomic DNA

SEQ ID NO: 102100 - DNA, 201 bp, Homo sapiens; identical to SEQ ID NO: 67501
  misc_feature 1..201: note = chr1:11131698-11131899
  misc_feature 1..201: note = Hypo
  source 1..201: mol_type = genomic DNA

SEQ ID NO: 102101 - DNA, 43 bp, Homo sapiens; identical to SEQ ID NO: 67502
  misc_feature 1..43: note = chr1:11139758-11139801
  misc_feature 1..43: note = Hypo
  source 1..43: mol_type = genomic DNA

SEQ ID NO: 102102 - DNA, 30 bp, Homo sapiens; identical to SEQ ID NO: 67503
  misc_feature 1..30: note = chr1:11141247-11141277
  misc_feature 1..30: note = Hypo
  source 1..30: mol_type = genomic DNA

SEQ ID NO: 102103 - DNA, 110 bp, Homo sapiens; identical to SEQ ID NO: 67506
  misc_feature 1..110: note = chr1:11193073-11193183
  misc_feature 1..110: note = Hypo
  source 1..110: mol_type = genomic DNA

SEQ ID NO: 102104 - DNA, 30 bp, Homo sapiens; identical to SEQ ID NO: 67520
  misc_feature 1..30: note = chr1:11376239-11376269
  misc_feature 1..30: note = Hypo
  source 1..30: mol_type = genomic DNA

SEQ ID NO: 102105 - DNA, 30 bp, Homo sapiens; identical to SEQ ID NO: 67521
  misc_feature 1..30: note = chr1:11380230-11380260
  misc_feature 1..30: note = Hyper
  source 1..30: mol_type = genomic DNA

SEQ ID NO: 102106 - DNA, 42 bp, Homo sapiens; identical to SEQ ID NO: 67522
  misc_feature 1..42: note = chr1:11417975-11418017
  misc_feature 1..42: note = Hypo
  source 1..42: mol_type = genomic DNA

SEQ ID NO: 102107 - DNA, 1524 bp, Homo sapiens
  misc_feature 1..1524: note = chr1:11538873-11540397
  misc_feature 1..1524: note = Hyper
  source 1..1524: mol_type = genomic DNA
tgcaggggcggggaccgacccccaggggtcgctgcgccttgcgcttcccccgcccgcgggcgccagggccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccagcgatggatccgcgcgcgcgagggtccccaggctctgccgagaacgcgaacgagggtggaggtggagtgggcagccgggcagtggcggcgctgagggtcgggaaagattcccagcgcaaggggcgccaagtcccgggagccaaccccaccgccgggagaacttttcccaactccctggggaggccggcagcagggctgggaaggcgcctccttgggggcttctcttctcggcctctgctccacggccggcgccagcttcccgctgtcccccactcactgcgagactgcgcgcaggtctccgtcagcccactccccgggtcagcaccgcggacagcgcctcgcggccgccctagaaactcagaagcccgcgcacacccacagtccacgcgcacactcacaccc

SEQ ID NO: 102108 - DNA, 30 bp, Homo sapiens; identical to SEQ ID NO: 67543
  misc_feature 1..30: note = chr1:11591786-11591816
  misc_feature 1..30: note = Hypo
  source 1..30: mol_type = genomic DNA

SEQ ID NO: 102109 - DNA, 99 bp, Homo sapiens; identical to SEQ ID NO: 67544
  misc_feature 1..99: note = chr1:11596484-11596583
  misc_feature 1..99: note = Hypo
  source 1..99: mol_type = genomic DNA

SEQ ID NO: 102110 - DNA, 30 bp, Homo sapiens; identical to SEQ ID NO: 26053
  misc_feature 1..30: note = chr1:11611023-11611053
  misc_feature 1..30: note = Hyper
  source 1..30: mol_type = genomic DNA

SEQ ID NO: 102111 - DNA, 30 bp, Homo sapiens; identical to SEQ ID NO: 67554
  misc_feature 1..30: note = chr1:11645732-11645762
  misc_feature 1..30: note = Hypo
  source 1..30: mol_type = genomic DNA

SEQ ID NO: 102112 - DNA, 30 bp, Homo sapiens; identical to SEQ ID NO: 67559
  misc_feature 1..30: note = chr1:11721254-11721284
  misc_feature 1..30: note = Hypo
  source 1..30: mol_type = genomic DNA

SEQ ID NO: 102113 - DNA, 30 bp, Homo sapiens; identical to SEQ ID NO: 67563
  misc_feature 1..30: note = chr1:11740384-11740414
  misc_feature 1..30: note = Hypo
  source 1..30: mol_type = genomic DNA

SEQ ID NO: 102114 - DNA, 278 bp, Homo sapiens; identical to SEQ ID NO: 67566
  misc_feature 1..278: note = chr1:11751289-11751567
  misc_feature 1..278: note = Hyper
  source 1..278: mol_type = genomic DNA

SEQ ID NO: 102115 - DNA, 210 bp, Homo sapiens; identical to SEQ ID NO: 67567
  misc_feature 1..210: note = chr1:11752448-11752658
  misc_feature 1..210: note = Hyper
  source 1..210: mol_type = genomic DNA

SEQ ID NO: 102116 - DNA, 30 bp, Homo sapiens; identical to SEQ ID NO: 67570
  misc_feature 1..30: note = chr1:11780195-11780225
  misc_feature 1..30: note = Hypo
  source 1..30: mol_type = genomic DNA

SEQ ID NO: 102117 - DNA, 76 bp, Homo sapiens; identical to SEQ ID NO: 38854
  misc_feature 1..76: note = chr1:11792825-11792901
  misc_feature 1..76: note = Hypo
  source 1..76: mol_type = genomic DNA

SEQ ID NO: 102118 - DNA, 36 bp, Homo sapiens; identical to SEQ ID NO: 67575
  misc_feature 1..36: note = chr1:11822246-11822282
  misc_feature 1..36: note = Hyper
  source 1..36: mol_type = genomic DNA

SEQ ID NO: 102119 - DNA, 30 bp, Homo sapiens; identical to SEQ ID NO: 67577
  misc_feature 1..30: note = chr1:11839862-11839892
  misc_feature 1..30: note = Hypo
  source 1..30: mol_type = genomic DNA

SEQ ID NO: 102120 - DNA, 33 bp, Homo sapiens; identical to SEQ ID NO: 67578
  misc_feature 1..33: note = chr1:11848300-11848333
  misc_feature 1..33: note = Hypo
  source 1..33: mol_type = genomic DNA

SEQ ID NO: 102121 - DNA, 83 bp, Homo sapiens; identical to SEQ ID NO: 38855
  misc_feature 1..83: note = chr1:11854720-11854803
  misc_feature 1..83: note = Hypo
  source 1..83: mol_type = genomic DNA

SEQ ID NO: 102122 - DNA, 30 bp, Homo sapiens; identical to SEQ ID NO: 67581
  misc_feature 1..30: note = chr1:11861082-11861112
  misc_feature 1..30: note = Hypo
  source 1..30: mol_type = genomic DNA

SEQ ID NO: 102123 - DNA, 317 bp, Homo sapiens; identical to SEQ ID NO: 67584
  misc_feature 1..317: note = chr1:11919143-11919460
  misc_feature 1..317: note = Hyper
  source 1..317: mol_type = genomic DNA

SEQ ID NO: 102124 - DNA, 85 bp, Homo sapiens; identical to SEQ ID NO: 38856
  misc_feature 1..85: note = chr1:11936694-11936779
  misc_feature 1..85: note = Hypo
  source 1..85: mol_type = genomic DNA

SEQ ID NO: 102125 - DNA, 30 bp, Homo sapiens; identical to SEQ ID NO: 67586
  misc_feature 1..30: note = chr1:11938065-11938095
  misc_feature 1..30: note = Hypo
  source 1..30: mol_type = genomic DNA

SEQ ID NO: 102126 - DNA, 30 bp, Homo sapiens; identical to SEQ ID NO: 67587
  misc_feature 1..30: note = chr1:11938661-11938691
  misc_feature 1..30: note = Hypo
  source 1..30: mol_type = genomic DNA

SEQ ID NO: 102127 - DNA, 30 bp, Homo sapiens; identical to SEQ ID NO: 67588
  misc_feature 1..30: note = chr1:11939935-11939965
  misc_feature 1..30: note = Hypo
  source 1..30: mol_type = genomic DNA

SEQ ID NO: 102128 - DNA, 358 bp, Homo sapiens; identical to SEQ ID NO: 67616
  misc_feature 1..358: note = chr1:11958880-11959238
  misc_feature 1..358: note = Hyper
  source 1..358: mol_type = genomic DNA

SEQ ID NO: 102129 - DNA, 15 bp, Homo sapiens
  misc_feature 1..15: note = chr1:12041510-12041525
  misc_feature 1..15: note = Hypo
  source 1..15: mol_type = genomic DNA
cgctgctgcactcca

SEQ ID NO: 102130 - DNA, 76 bp, Homo sapiens; identical to SEQ ID NO: 38857
  misc_feature 1..76: note = chr1:12078805-12078881
  misc_feature 1..76: note = Hypo
  source 1..76: mol_type = genomic DNA

SEQ ID NO: 102131 - DNA, 828 bp, Homo sapiens
  misc_feature 1..828: note = chr1:12123122-12123950
  misc_feature 1..828: note = Hyper
  source 1..828: mol_type = genomic DNA
ctactcacatttcaccgtttcttggggcaggagtggaggtgggggcattggaacccccttggggcctcctaatatcctgtgagtccccacctccagggccagaagctgcctgcctccgctccccgcagcccaggtgcggcgggcagcacactccctagagccaggaccactagttccgtcaaatccggggcgggccattcaaacagctaagggaggcgtctcctagtgtgccttttcctgagtcatctctgcacgtgtttgcccccttttttcttcgctgcttgtagctaagtgttcctggaaccaatttgatacgggagaactaaggctgaaacctcggaggaacaaccacttttgaagtgacttcgcggcgtgcgttgggtgcggactaggtggccgcggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggtaagcgggtgacgggcgcctggggaggtgccggcggtccagagcccggacagtgtggggtgcgtgggacgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactg

SEQ ID NO: 102132 - DNA, 94 bp, Homo sapiens; identical to SEQ ID NO: 67628
  misc_feature 1..94: note = chr1:12175071-12175165
  misc_feature 1..94: note = Hypo
  source 1..94: mol_type = genomic DNA

SEQ ID NO: 102133 - DNA, 30 bp, Homo sapiens; identical to SEQ ID NO: 67630
  misc_feature 1..30: note = chr1:12201701-12201731
  misc_feature 1..30: note = Hypo
  source 1..30: mol_type = genomic DNA

SEQ ID NO: 102134 - DNA, 20 bp, Homo sapiens
  misc_feature 1..20: note = chr1:12204539-12204559
  misc_feature 1..20: note = Hypo
  source 1..20: mol_type = genomic DNA
actcaaagccactgtcggcc

SEQ ID NO: 102135 - DNA, 30 bp, Homo sapiens; identical to SEQ ID NO: 67633
  misc_feature 1..30: note = chr1:12227408-12227438
  misc_feature 1..30: note = Hyper
  source 1..30: mol_type = genomic DNA

SEQ ID NO: 102136 - DNA, 81 bp, Homo sapiens; identical to SEQ ID NO: 67634
  misc_feature 1..81: note = chr1:12227644-12227725
  misc_feature 1..81: note = Hyper
  source 1..81: mol_type = genomic DNA

SEQ ID NO: 102137 - DNA, 639 bp, Homo sapiens; identical to SEQ ID NO: 67637
  misc_feature 1..639: note = chr1:12251319-12251958
  misc_feature 1..639: note = Hypo
  source 1..639: mol_type = genomic DNA

SEQ ID NO: 102138 - DNA, 56 bp, Homo sapiens; identical to SEQ ID NO: 67639
  misc_feature 1..56: note = chr1:12304691-12304747
  misc_feature 1..56: note = Hypo
  source 1..56: mol_type = genomic DNA

SEQ ID NO: 102139 - DNA, 30 bp, Homo sapiens; identical to SEQ ID NO: 67649
  misc_feature 1..30: note = chr1:12551925-12551955
  misc_feature 1..30: note = Hypo
  source 1..30: mol_type = genomic DNA

SEQ ID NO: 102140 - DNA, 57 bp, Homo sapiens; identical to SEQ ID NO: 67652
  misc_feature 1..57: note = chr1:12655969-12656026
  misc_feature 1..57: note = Hyper
  source 1..57: mol_type = genomic DNA

SEQ ID NO: 102141 - DNA, 17 bp, Homo sapiens
  misc_feature 1..17: note = chr1:12805063-12805080
  misc_feature 1..17: note = Hypo
  source 1..17: mol_type = genomic DNA
aacgcatgcctcctctg

SEQ ID NO: 102142 - DNA, 824 bp, Homo sapiens
  misc_feature 1..824: note = chr1:13839429-13840253
  misc_feature 1..824: note = Hyper
  source 1..824: mol_type = genomic DNA
ctcccccagcctagccggctcggctcacctttgggcagtttggatgcgttctcctggatccaggagaagaggtgggcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaacacgagcttggccgagccgctgaacgtgccctcctccagcgagcgcagcgagttgttcctgaagtccaggtagaccaggtcgccgtagaagatgaagaagtcctcggggatccgctggatgcggttgccggccaccagcagcttgcgcacgtccagggggaaagggtctggcacgctgggcagcccgcggtcgcggcagtccacggtgtgcgggtcggtgcaggcgcagcccgcggggcacgcgtgcccgggcgcgagcagcagcagaaggctgcagagcccgagcgccgcggcggcgcaggctggggctcgggggcgcatggccggggggcccgcgccggccgcggcgagaaggaagcggctctcggagcgagccctggcgcgggacggcgcggtgaggcactggctgccgggcgcggggagccagagggcggcccgggcggggagggcgtgcgcccgggcgtgcgggggcgatggagcgcggcg

SEQ ID NO: 102143 - DNA, 177 bp, Homo sapiens; identical to SEQ ID NO: 26061
  misc_feature 1..177: note = chr1:13840521-13840698
  misc_feature 1..177: note = Hyper
  source 1..177: mol_type = genomic DNA

SEQ ID NO: 102144 - DNA, 77 bp, Homo sapiens; identical to SEQ ID NO: 67668
  misc_feature 1..77: note = chr1:13854197-13854274
  misc_feature 1..77: note = Hypo
  source 1..77: mol_type = genomic DNA

SEQ ID NO: 102145 - DNA, 21 bp, Homo sapiens
  misc_feature 1..21: note = chr1:13882124-13882145
  misc_feature 1..21: note = Hypo
  source 1..21: mol_type = genomic DNA
aagagtcgcttctttctttgg

SEQ ID NO: 102146 - DNA, 872 bp, Homo sapiens
  misc_feature 1..872: note = chr1:13910055-13910927
  misc_feature 1..872: note = Hyper
  source 1..872: mol_type = genomic DNA
taatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccggacggagaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagcgcgggggagctgagggtgtgtgcgtgtcaggcggctgagcgccggaggaggagaggcagcggcttagtcggtgccaggtcccaaagacgcagctgcgcgggtgtgccgggaggagccccggaatccacaggctgcgaggtgggcagcacagggggcctccctccgagtcggcagcaccagagagatcgggtggaaggttcacagtaggcagccccgcttgctggcagca

SEQ ID NO: 102147 - DNA, 160 bp, Homo sapiens; identical to SEQ ID NO: 67674
  misc_feature 1..160: note = chr1:13936570-13936730
  misc_feature 1..160: note = Hypo
  source 1..160: mol_type = genomic DNA

SEQ ID NO: 102148 - DNA, 730 bp, Homo sapiens; identical to SEQ ID NO: 67675
  misc_feature 1..730: note = chr1:14026466-14027196
  misc_feature 1..730: note = Hyper
  source 1..730: mol_type = genomic DNA

SEQ ID NO: 102149 - DNA, 116 bp, Homo sapiens; identical to SEQ ID NO: 67676
  misc_feature 1..116: note = chr1:14079260-14079376
  misc_feature 1..116: note = Hypo
  source 1..116: mol_type = genomic DNA

SEQ ID NO: 102150 - DNA, 54 bp, Homo sapiens; identical to SEQ ID NO: 67677
  misc_feature 1..54: note = chr1:14125568-14125622
  misc_feature 1..54: note = Hypo
  source 1..54: mol_type = genomic DNA

SEQ ID NO: 102151 - DNA, 194 bp, Homo sapiens; identical to SEQ ID NO: 38860
  misc_feature 1..194: note = chr1:14139406-14139600
  misc_feature 1..194: note = Hypo
  source 1..194: mol_type = genomic DNA

SEQ ID NO: 102152 - DNA, 928 bp, Homo sapiens; identical to SEQ ID NO: 67679
  misc_feature 1..928: note = chr1:14218911-14219839
  misc_feature 1..928: note = Hyper
  source 1..928: mol_type = genomic DNA

SEQ ID NO: 102153 - DNA, 60 bp, Homo sapiens; identical to SEQ ID NO: 14211
  misc_feature 1..60: note = chr1:14730412-14730472
  misc_feature 1..60: note = Hypo
  source 1..60: mol_type = genomic DNA

SEQ ID NO: 102154 - DNA, 1700 bp, Homo sapiens
  misc_feature 1..1700: note = chr1:14924504-14926204
  misc_feature 1..1700: note = Hyper
  source 1..1700: mol_type = genomic DNA
cctcatctctgtccccgccaatattcagcccggctaagaagcttaggagctggctaaggctgctcctccacctggatgcacacacagggctagggctgtggagaggcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctcggcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccggcatcagaaagtgccctttccgtggcaccagccccctagctccgtgcaaacttttcatgccggggccttttccccaccccccgcaggggtgaatggcacagttccccccacttccttaggctccttcccagagagagctccgggctctgccgccgtggttgggatagaggattgcactgctgtgcacttttctccgcggatgccaaatccc

SEQ ID NO: 102155 - DNA, 44 bp, Homo sapiens; identical to SEQ ID NO: 67712
  misc_feature 1..44: note = chr1:15149251-15149295
  misc_feature 1..44: note = Hypo
  source 1..44: mol_type = genomic DNA

SEQ ID NO: 102156 - DNA, 85 bp, Homo sapiens; identical to SEQ ID NO: 67730
  misc_feature 1..85: note = chr1:15251189-15251274
  misc_feature 1..85: note = Hyper
  source 1..85: mol_type = genomic DNA

SEQ ID NO: 102157 - DNA, 81 bp, Homo sapiens; identical to SEQ ID NO: 26071
  misc_feature 1..81: note = chr1:15251499-15251580
  misc_feature 1..81: note = Hyper
  source 1..81: mol_type = genomic DNA

SEQ ID NO: 102158 - DNA, 127 bp, Homo sapiens; identical to SEQ ID NO: 67733
  misc_feature 1..127: note = chr1:15314099-15314226
  misc_feature 1..127: note = Hypo
  source 1..127: mol_type = genomic DNA

SEQ ID NO: 102159 - DNA, 85 bp, Homo sapiens; identical to SEQ ID NO: 67770
  misc_feature 1..85: note = chr1:15479692-15479777
  misc_feature 1..85: note = Hyper
  source 1..85: mol_type = genomic DNA

SEQ ID NO: 102160 - DNA, 116 bp, Homo sapiens; identical to SEQ ID NO: 67771
  misc_feature 1..116: note = chr1:15480110-15480226
  misc_feature 1..116: note = Hyper
  source 1..116: mol_type = genomic DNA

SEQ ID NO: 102161 - DNA, 125 bp, Homo sapiens; identical to SEQ ID NO: 67773
  misc_feature 1..125: note = chr1:15480940-15481065
  misc_feature 1..125: note = Hyper
  source 1..125: mol_type = genomic DNA

SEQ ID NO: 102162 - DNA, 181 bp, Homo sapiens; identical to SEQ ID NO: 67795
  misc_feature 1..181: note = chr1:15573580-15573761
  misc_feature 1..181: note = Hyper
  source 1..181: mol_type = genomic DNA

SEQ ID NO: 102163 - DNA, 30 bp, Homo sapiens; identical to SEQ ID NO: 67796
  misc_feature 1..30: note = chr1:15573999-15574029
  misc_feature 1..30: note = Hyper
  source 1..30: mol_type = genomic DNA

SEQ ID NO: 102164 - DNA, 30 bp, Homo sapiens; identical to SEQ ID NO: 67808
  misc_feature 1..30: note = chr1:15599088-15599118
  misc_feature 1..30: note = Hyper
  source 1..30: mol_type = genomic DNA

SEQ ID NO: 102165 - DNA, 30 bp, Homo sapiens; identical to SEQ ID NO: 38862
  misc_feature 1..30: note = chr1:15651124-15651154
  misc_feature 1..30: note = Hypo
  source 1..30: mol_type = genomic DNA

SEQ ID NO: 102166 - DNA, 31 bp, Homo sapiens; identical to SEQ ID NO: 67878
  misc_feature 1..31: note = chr1:15714388-15714419
  misc_feature 1..31: note = Hypo
  source 1..31: mol_type = genomic DNA

SEQ ID NO: 102167 - DNA, 114 bp, Homo sapiens; identical to SEQ ID NO: 67925
  misc_feature 1..114: note = chr1:15911093-15911207
  misc_feature 1..114: note = Hyper
  source 1..114: mol_type = genomic DNA

SEQ ID NO: 102168 - DNA, 30 bp, Homo sapiens; identical to SEQ ID NO: 38863
  misc_feature 1..30: note = chr1:15928989-15929019
  misc_feature 1..30: note = Hypo
  source 1..30: mol_type = genomic DNA

SEQ ID NO: 102169 - DNA, 442 bp, Homo sapiens; identical to SEQ ID NO: 67934
  misc_feature 1..442: note = chr1:15929958-15930400
  misc_feature 1..442: note = Hyper
  source 1..442: mol_type = genomic DNA

SEQ ID NO: 102170 - DNA, 30 bp, Homo sapiens; identical to SEQ ID NO: 67957
  misc_feature 1..30: note = chr1:16049826-16049856
  misc_feature 1..30: note = Hypo
  source 1..30: mol_type = genomic DNA

SEQ ID NO: 102171 - DNA, 73 bp, Homo sapiens; identical to SEQ ID NO: 67962
  misc_feature 1..73: note = chr1:16059027-16059100
  misc_feature 1..73: note = Hypo
  source 1..73: mol_type = genomic DNA

SEQ ID NO: 102172 - DNA, 126 bp, Homo sapiens; identical to SEQ ID NO: 67963
  misc_feature 1..126: note = chr1:16059358-16059484
  misc_feature 1..126: note = Hypo
  source 1..126: mol_type = genomic DNA

SEQ ID NO: 102173 - DNA, 501 bp, Homo sapiens
  misc_feature 1..501: note = chr1:16085333-16085834
  misc_feature 1..501: note = Hyper
  source 1..501: mol_type = genomic DNA
ggcggcccaggtaagcgggccgggtgggtgggggtcgcgtccctccgtccctgtccccggtgcacacaggtgacagcgccggcagtgctcggccggagcctgctcggtcgccagccgggacccccggcgcggcgcccctggaggggcctgcgggtggggggtgcggtcctcacgccctttgcgtcccagtctcttggtctctctccccggagtcggggagtcggcaggtccggggcgagggctcagtgaggccggcggagggccgagtcccagcccgggagcgggagccggggacccggcgcgcagggcggaagctcccgcacaaaaggccggagtcccgcacatggatcgaattaaagctccggcggcgcccagcggtgaccccggcggccgccctgctcggctgcctgcggagggtcccgcgtttccggagcccgggggcgctccaggccccttttcctagccagggtcaggcaaggggagggacgggtcccggggctg

SEQ ID NO: 102174 - DNA, 196 bp, Homo sapiens; identical to SEQ ID NO: 68011
  misc_feature 1..196: note = chr1:16375246-16375442
  misc_feature 1..196: note = Hyper
  source 1..196: mol_type = genomic DNA

SEQ ID NO: 102175 - DNA, 34 bp, Homo sapiens; identical to SEQ ID NO: 68013
  misc_feature 1..34: note = chr1:16455953-16455987
  misc_feature 1..34: note = Hypo
  source 1..34: mol_type = genomic DNA

SEQ ID NO: 102176 - DNA, 359 bp, Homo sapiens; identical to SEQ ID NO: 68018
  misc_feature 1..359: note = chr1:16475073-16475432
  misc_feature 1..359: note = Hypo
  source 1..359: mol_type = genomic DNA

SEQ ID NO: 102177 - DNA, 68 bp, Homo sapiens; identical to SEQ ID NO: 68019
  misc_feature 1..68: note = chr1:16482476-16482544
  misc_feature 1..68: note = Hyper
  source 1..68: mol_type = genomic DNA

SEQ ID NO: 102178 - DNA, 30 bp, Homo sapiens; identical to SEQ ID NO: 68020
  misc_feature 1..30: note = chr1:16483726-16483756
  misc_feature 1..30: note = Hypo
  source 1..30: mol_type = genomic DNA

SEQ ID NO: 102179 - DNA, 30 bp, Homo sapiens; identical to SEQ ID NO: 68030
  misc_feature 1..30: note = chr1:16532867-16532897
  misc_feature 1..30: note = Hyper
  source 1..30: mol_type = genomic DNA

SEQ ID NO: 102180 - DNA, 438 bp, Homo sapiens; identical to SEQ ID NO: 68031
  misc_feature 1..438: note = chr1:16533298-16533736
  misc_feature 1..438: note = Hyper
  source 1..438: mol_type = genomic DNA

SEQ ID NO: 102181 - DNA, 257 bp, Homo sapiens; identical to SEQ ID NO: 68032
  misc_feature 1..257: note = chr1:16534506-16534763
  misc_feature 1..257: note = Hypo
  source 1..257: mol_type = genomic DNA

SEQ ID NO: 102182 - DNA, 67 bp, Homo sapiens; identical to SEQ ID NO: 38867
  misc_feature 1..67: note = chr1:16535138-16535205
  misc_feature 1..67: note = Hypo
  source 1..67: mol_type = genomic DNA

SEQ ID NO: 102183 - DNA, 76 bp, Homo sapiens; identical to SEQ ID NO: 68037
  misc_feature 1..76: note = chr1:16542965-16543041
  misc_feature 1..76: note = Hyper
  source 1..76: mol_type = genomic DNA

SEQ ID NO: 102184 - DNA, 404 bp, Homo sapiens
  misc_feature 1..404: note = chr1:16553382-16553786
  misc_feature 1..404: note = Hyper
  source 1..404: mol_type = genomic DNA
gctgcggaaggcgcacgaatcctacggccggctgggcacctactgctgcagagggttgcgcaggcgcaggcgtcgccgtggctccgccgagccctcagagtcggggttgggccgggcctggggtcaagggcagggttacggccccctagggagactccgcccctggcggaccccgccccacccctccacatgagacggcgcgcgcaggctcagttcctcggcgtagcacagcggctcccaggcgcgctcagctcggcgaagggtgcggcgctatgccggggtactctcctgggctgctctcccaggaggagagggaaggacccctaagcccctcccctcacgatctcggccgggaggtgacagatccctttttttgttgttgttttgtttttttgagacaacat

SEQ ID NO: 102185 - DNA, 36 bp, Homo sapiens; identical to SEQ ID NO: 68054
  misc_feature 1..36: note = chr1:16693059-16693095
  misc_feature 1..36: note = Hypo
  source 1..36: mol_type = genomic DNA

SEQ ID NO: 102186 - DNA, 48 bp, Homo sapiens; identical to SEQ ID NO: 68060
  misc_feature 1..48: note = chr1:16736310-16736358
  misc_feature 1..48: note = Hypo
  source 1..48: mol_type = genomic DNA

SEQ ID NO: 102187 - DNA, 277 bp, Homo sapiens; identical to SEQ ID NO: 68073
  misc_feature 1..277: note = chr1:16861465-16861742
  misc_feature 1..277: note = Hyper
  source 1..277: mol_type = genomic DNA

SEQ ID NO: 102188 - DNA, 30 bp, Homo sapiens; identical to SEQ ID NO: 26080
  misc_feature 1..30: note = chr1:17033955-17033985
  misc_feature 1..30: note = Hyper
  source 1..30: mol_type = genomic DNA

SEQ ID NO: 102189 - DNA, 35 bp, Homo sapiens; identical to SEQ ID NO: 68079
  misc_feature 1..35: note = chr1:17034330-17034365
  misc_feature 1..35: note = Hyper
  source 1..35: mol_type = genomic DNA

SEQ ID NO: 102190 - DNA, 30 bp, Homo sapiens; identical to SEQ ID NO: 68096
  misc_feature 1..30: note = chr1:17215966-17215996
  misc_feature 1..30: note = Hyper
  source 1..30: mol_type = genomic DNA

SEQ ID NO: 102191 - DNA, 30 bp, Homo sapiens; identical to SEQ ID NO: 68107
  misc_feature 1..30: note = chr1:17416193-17416223
  misc_feature 1..30: note = Hypo
  source 1..30: mol_type = genomic DNA

SEQ ID NO: 102192 - DNA, 30 bp, Homo sapiens; identical to SEQ ID NO: 68109
  misc_feature 1..30: note = chr1:17444308-17444338
  misc_feature 1..30: note = Hypo
  source 1..30: mol_type = genomic DNA

SEQ ID NO: 102193 - DNA, 44 bp, Homo sapiens; identical to SEQ ID NO: 68110
  misc_feature 1..44: note = chr1:17445869-17445913
  misc_feature 1..44: note = Hyper
  source 1..44: mol_type = genomic DNA

SEQ ID NO: 102194 - DNA, 18 bp, Homo sapiens
  misc_feature 1..18: note = chr1:17498377-17498395
  misc_feature 1..18: note = Hypo
  source 1..18: mol_type = genomic DNA
gcccggcctctttttttt

SEQ ID NO: 102195 - DNA, 39 bp, Homo sapiens; identical to SEQ ID NO: 68128
  misc_feature 1..39: note = chr1:17679581-17679620
  misc_feature 1..39: note = Hypo
  source 1..39: mol_type = genomic DNA

SEQ ID NO: 102196 - DNA, 140 bp, Homo sapiens; identical to SEQ ID NO: 68129
  misc_feature 1..140: note = chr1:17689938-17690078
  misc_feature 1..140: note = Hypo
  source 1..140: mol_type = genomic DNA

SEQ ID NO: 102197 - DNA, 86 bp, Homo sapiens; identical to SEQ ID NO: 68136
  misc_feature 1..86: note = chr1:17757487-17757573
  misc_feature 1..86: note = Hypo
  source 1..86: mol_type = genomic DNA

SEQ ID NO: 102198 - DNA, 37 bp, Homo sapiens; identical to SEQ ID NO: 68137
  misc_feature 1..37: note = chr1:17787462-17787499
  misc_feature 1..37: note = Hypo
  source 1..37: mol_type = genomic DNA

SEQ ID NO: 102199 - DNA, 93 bp, Homo sapiens; identical to SEQ ID NO: 68142
  misc_feature 1..93: note = chr1:17865877-17865970
  misc_feature 1..93: note = Hyper
  source 1..93: mol_type = genomic DNA

SEQ ID NO: 102200 - DNA, 179 bp, Homo sapiens; identical to SEQ ID NO: 68172
  misc_feature 1..179: note = chr1:18033374-18033553
  misc_feature 1..179: note = Hypo
  source 1..179: mol_type = genomic DNA

SEQ ID NO: 102201 - DNA, 173 bp, Homo sapiens; identical to SEQ ID NO: 68190
  misc_feature 1..173: note = chr1:18152682-18152855
  misc_feature 1..173: note = Hyper
  source 1..173: mol_type = genomic DNA

SEQ ID NO: 102202 - DNA, 32 bp, Homo sapiens; identical to SEQ ID NO: 68214
  misc_feature 1..32: note = chr1:18387093-18387125
  misc_feature 1..32: note = Hypo
  source 1..32: mol_type = genomic DNA

SEQ ID NO: 102203 - DNA, 51 bp, Homo sapiens; identical to SEQ ID NO: 68217
  misc_feature 1..51: note = chr1:18433884-18433935
  misc_feature 1..51: note = Hyper
  source 1..51: mol_type = genomic DNA

SEQ ID NO: 102204 - DNA, 507 bp, Homo sapiens
  misc_feature 1..507: note = chr1:18434309-18434816
  misc_feature 1..507: note = Hyper
  source 1..507: mol_type = genomic DNA
ggcgctgcagccgatcggactctgggccgcggtgggcaccgcgcgcagctagggagccgagaaccgcggcgagccccgaggacgcccagagcgcgagggtcgctgcgcctcgcagagccggagccgagtcgagccgggcgcccgggctgcctggccgcggcggcatgggggcgcccccgcggctctccgcgctgcccgccaccgcctcggccagtggccggaggcaggagcgcgtctgagcccatggcgaggggacccgccgccaccgcctccacccccgccgccccgccaccgccgccagctcccgggcaccatgcgaaccgccccgagcctccgccgctgcgtctgcctgctgctcgccgcgatcctggacctggcgcgcggtgagtgcgcgggcgcctggcgggagccgagcggtgaacgtgcgcggggacggggtgccgggggagggcgctggccggggtcgctccgagaggctcgggctacgagcaccggtcctgcccgggg

SEQ ID NO: 102205 - DNA, 98 bp, Homo sapiens; identical to SEQ ID NO: 68220
  misc_feature 1..98: note = chr1:18435431-18435529
  misc_feature 1..98: note = Hyper
  source 1..98: mol_type = genomic DNA

SEQ ID NO: 102206 - DNA, 1511 bp, Homo sapiens
  misc_feature 1..1511: note = chr1:18436334-18437845
  misc_feature 1..1511: note = Hyper
  source 1..1511: mol_type = genomic DNA
ggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttcacgaacgtactggcggtcactgctcggggaggggcacggccagaacgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagccgggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgca

SEQ ID NO: 102207 - DNA, 30 bp, Homo sapiens; identical to SEQ ID NO: 68225
  misc_feature 1..30: note = chr1:18448183-18448213
  misc_feature 1..30: note = Hypo
  source 1..30: mol_type = genomic DNA

SEQ ID NO: 102208 - DNA, 122 bp, Homo sapiens; identical to SEQ ID NO: 68239
  misc_feature 1..122: note = chr1:18703326-18703448
  misc_feature 1..122: note = Hypo
  source 1..122: mol_type = genomic DNA

SEQ ID NO: 102209 - DNA, 30 bp, Homo sapiens; identical to SEQ ID NO: 68243
  misc_feature 1..30: note = chr1:18801486-18801516
  misc_feature 1..30: note = Hypo
  source 1..30: mol_type = genomic DNA

SEQ ID NO: 102210 - DNA, 30 bp, Homo sapiens; identical to SEQ ID NO: 38873
  misc_feature 1..30: note = chr1:18818951-18818981
  misc_feature 1..30: note = Hypo
  source 1..30: mol_type = genomic DNA

SEQ ID NO: 102211 - DNA, 44 bp, Homo sapiens; identical to SEQ ID NO: 68246
  misc_feature 1..44: note = chr1:18956211-18956255
  misc_feature 1..44: note = Hyper
  source 1..44: mol_type = genomic DNA

SEQ ID NO: 102212 - DNA, 1143 bp, Homo sapiens
  misc_feature 1..1143: note = chr1:18956470-18957613
  misc_feature 1..1143: note = Hyper
  source 1..1143: mol_type = genomic DNA
tgtatcaagtcttgacgggctccctccctcccatttcccacctctttgggcccccagatcctcacaccagcaccaactccctgtaaacccaactacctgctggaaaggagttataggcccggcctgggggcctgaggaggacggcggcggctggagacgtctgcacggggcggaactggaaggggaggaagaaacctgtgcctagcacttggcagacccactttgccaagcctcggaaccagatacggttactgggggcttctcagagcggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatatataaataaatacgagaacgaaatcca

SEQ ID NO: 102213 - DNA, 444 bp, Homo sapiens
  misc_feature 1..444: note = chr1:18957985-18958429
  misc_feature 1..444: note = Hyper
  source 1..444: mol_type = genomic DNA
ttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcctcgccgcgactccgccgcccggaactcggggtccttggagaggctgcggtctccaggggacggtggcggcgccggcgatagcagagggatcccgttctcttctgggtcccagtccgggcgcggaacccagggagtttctgggacccatacttgtccgcttctgcgtgggtttcactgcccggcggccttcgtttcgcaggtcgctagctgccggtctttacccgca

SEQ ID NO: 102214 - DNA, 1118 bp, Homo sapiens
  misc_feature 1..1118: note = chr1:18958829-18959947
  misc_feature 1..1118: note = Hyper
  source 1..1118: mol_type = genomic DNA
tagagaacctctaaacggcgagaggggcacggcaatgtccaaacgagaagaaagagctgattttgtaaagcgtccttcctaaacatccagcgcccgcccggggagacccgataggacgggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggaggagctcccttgggcagcgagacggcgccgggtccctgaattagacagaggcgaagagagcggctccgtgatcaagtgcgcgccggcagccacgcaggcgggagagcgcgcaaacccggggatttgcagtggcactctcctgtagcgaatgcaagtaaaacaggcggctgaggacgcgcggcggattagaacaatatttgcccaacatgacgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtca

SEQ ID NO: 102215 - DNA, 170 bp, Homo sapiens; identical to SEQ ID NO: 68254
  misc_feature 1..170: note = chr1:18960861-18961031
  misc_feature 1..170: note = Hyper
  source 1..170: mol_type = genomic DNA

SEQ ID NO: 102216 - DNA, 1220 bp, Homo sapiens; identical to SEQ ID NO: 68255
  misc_feature 1..1220: note = chr1:18962727-18963947
  misc_feature 1..1220: note = Hyper
  source 1..1220: mol_type = genomic DNA

SEQ ID NO: 102217 - DNA, 231 bp, Homo sapiens; identical to SEQ ID NO: 68256
  misc_feature 1..231: note = chr1:18964253-18964484
  misc_feature 1..231: note = Hyper
  source 1..231: mol_type = genomic DNA

SEQ ID NO: 102218 - DNA, 137 bp, Homo sapiens; identical to SEQ ID NO: 68257
  misc_feature 1..137: note = chr1:18965943-18966080
  misc_feature 1..137: note = Hyper
  source 1..137: mol_type = genomic DNA

SEQ ID NO: 102219 - DNA, 30 bp, Homo sapiens; identical to SEQ ID NO: 68258
  misc_feature 1..30: note = chr1:18966326-18966356
  misc_feature 1..30: note = Hyper
  source 1..30: mol_type = genomic DNA

SEQ ID NO: 102220 - DNA, 41 bp, Homo sapiens; identical to SEQ ID NO: 26100
  misc_feature 1..41: note = chr1:18966656-18966697
  misc_feature 1..41: note = Hyper
  source 1..41: mol_type = genomic DNA

SEQ ID NO: 102221 - DNA, 129 bp, Homo sapiens; identical to SEQ ID NO: 26101
  misc_feature 1..129: note = chr1:18968003-18968132
  misc_feature 1..129: note = Hyper
  source 1..129: mol_type = genomic DNA

SEQ ID NO: 102222 - DNA, 1483 bp, Homo sapiens; identical to SEQ ID NO: 68261
  misc_feature 1..1483: note = chr1:18969348-18970831
  misc_feature 1..1483: note = Hyper
  source 1..1483: mol_type = genomic DNA

SEQ ID NO: 102223 - DNA, 367 bp, Homo sapiens; identical to SEQ ID NO: 68262
  misc_feature 1..367: note = chr1:18971716-18972083
  misc_feature 1..367: note = Hyper
  source 1..367: mol_type = genomic DNA

SEQ ID NO: 102224 - DNA, 30 bp, Homo sapiens; identical to SEQ ID NO: 68263
  misc_feature 1..30: note = chr1:18972559-18972589
  misc_feature 1..30: note = Hyper
  source 1..30: mol_type = genomic DNA

SEQ ID NO: 102225 - DNA, 163 bp, Homo sapiens; identical to SEQ ID NO: 68264
  misc_feature 1..163: note = chr1:18972950-18973113
  misc_feature 1..163: note = Hyper
  source 1..163: mol_type = genomic DNA

SEQ ID NO: 102226 - DNA, 73 bp, Homo sapiens; identical to SEQ ID NO: 26105
  misc_feature 1..73: note = chr1:18973661-18973734
  misc_feature 1..73: note = Hyper
  source 1..73: mol_type = genomic DNA

SEQ ID NO: 102227 - DNA, 30 bp, Homo sapiens; identical to SEQ ID NO: 68266
  misc_feature 1..30: note = chr1:18978567-18978597
  misc_feature 1..30: note = Hyper
  source 1..30: mol_type = genomic DNA

SEQ ID NO: 102228 - DNA, 38 bp, Homo sapiens; identical to SEQ ID NO: 68267
  misc_feature 1..38: note = chr1:19020254-19020292
  misc_feature 1..38: note = Hyper
  source 1..38: mol_type = genomic DNA

SEQ ID NO: 102229 - DNA, 91 bp, Homo sapiens
  misc_feature 1..91: note = chr1:19043052-19043143
  misc_feature 1..91: note = Hyper
  source 1..91: mol_type = genomic DNA
cctcttttctcccttcgcgccccatttcccttcgccccctgtgccaccacccccttgctcaccgtctccctgatcgcgtcataaccctgag

SEQ ID NO: 102230 - DNA, 555 bp, Homo sapiens
  misc_feature 1..555: note = chr1:19043352-19043907
  misc_feature 1..555: note = Hyper
  source 1..555: mol_type = genomic DNA
cctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactgcggagccgccgctcgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcat

SEQ ID NO: 102231 - DNA, 242 bp, Homo sapiens; identical to SEQ ID NO: 68280
  misc_feature 1..242: note = chr1:19075291-19075533
  misc_feature 1..242: note = Hypo
  source 1..242: mol_type = genomic DNA

SEQ ID NO: 102232 - DNA, 30 bp, Homo sapiens; identical to SEQ ID NO: 68282
  misc_feature 1..30: note = chr1:19119663-19119693
  misc_feature 1..30: note = Hypo
  source 1..30: mol_type = genomic DNA

SEQ ID NO: 102233 - DNA, 30 bp, Homo sapiens; identical to SEQ ID NO: 68286
  misc_feature 1..30: note = chr1:19147954-19147984
  misc_feature 1..30: note = Hypo
  source 1..30: mol_type = genomic DNA

SEQ ID NO: 102234 - DNA, 30 bp, Homo sapiens; identical to SEQ ID NO: 68289
  misc_feature 1..30: note = chr1:19204137-19204167
  misc_feature 1..30: note = Hypo
  source 1..30: mol_type = genomic DNA

SEQ ID NO: 102235 - DNA, 124 bp, Homo sapiens; identical to SEQ ID NO: 68290
  misc_feature 1..124: note = chr1:19213653-19213777
  misc_feature 1..124: note = Hypo
  source 1..124: mol_type = genomic DNA

SEQ ID NO: 102236 - DNA, 103 bp, Homo sapiens; identical to SEQ ID NO: 38875
  misc_feature 1..103: note = chr1:19676719-19676822
  misc_feature 1..103: note = Hypo
  source 1..103: mol_type = genomic DNA

SEQ ID NO: 102237 - DNA, 53 bp, Homo sapiens; identical to SEQ ID NO: 68307
  misc_feature 1..53: note = chr1:19683185-19683238
  misc_feature 1..53: note = Hypo
  source 1..53: mol_type = genomic DNA

SEQ ID NO: 102238 - DNA, 30 bp, Homo sapiens; identical to SEQ ID NO: 68309
  misc_feature 1..30: note = chr1:19739205-19739235
  misc_feature 1..30: note = Hypo
  source 1..30: mol_type = genomic DNA

SEQ ID NO: 102239 - DNA, 23 bp, Homo sapiens
  misc_feature 1..23: note = chr1:19980869-19980892
  misc_feature 1..23: note = Hypo
  source 1..23: mol_type = genomic DNA
tgggtgaccgagtgagatctttt

SEQ ID NO: 102240 - DNA, 391 bp, Homo sapiens
  misc_feature 1..391: note = chr1:19992140-19992531
  misc_feature 1..391: note = Hyper
  source 1..391: mol_type = genomic DNA
cgcggtctgttctcacggacggtccccgtccagcctgcgcttcgccggggccctcatctgctttcccgccaccctatcactcccttgccgtccaccctcggtcctcatggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcg

SEQ ID NO: 102241 - DNA, 28 bp, Homo sapiens
  misc_feature 1..28: note = chr1:20127443-20127471
  misc_feature 1..28: note = Hypo
  source 1..28: mol_type = genomic DNA
gcgtgagccaccgcgcagccccaactag

SEQ ID NO: 102242 - DNA, 30 bp, Homo sapiens; identical to SEQ ID NO: 68379
  misc_feature 1..30: note = chr1:20205294-20205324
  misc_feature 1..30: note = Hypo
  source 1..30: mol_type = genomic DNA

SEQ ID NO: 102243 - DNA, 30 bp, Homo sapiens; identical to SEQ ID NO: 68385
  misc_feature 1..30: note = chr1:20247063-20247093
  misc_feature 1..30: note = Hypo
  source 1..30: mol_type = genomic DNA

SEQ ID NO: 102244 - DNA, 30 bp, Homo sapiens; identical to SEQ ID NO: 68417
  misc_feature 1..30: note = chr1:20416390-20416420
  misc_feature 1..30: note = Hypo
  source 1..30: mol_type = genomic DNA

SEQ ID NO: 102245 - DNA, 25 bp, Homo sapiens
  misc_feature 1..25: note = chr1:20492314-20492339
  misc_feature 1..25: note = Hypo
  source 1..25: mol_type = genomic DNA
tgtgcgcgcgcgcatgtgtgtttag

SEQ ID NO: 102246 - DNA, 30 bp, Homo sapiens; identical to SEQ ID NO: 68434
  misc_feature 1..30: note = chr1:20498645-20498675
  misc_feature 1..30: note = Hypo
  source 1..30: mol_type = genomic DNA

SEQ ID NO: 102247 - DNA, 454 bp, Homo sapiens
  misc_feature 1..454: note = chr1:20512345-20512799
  misc_feature 1..454: note = Hyper
  source 1..454: mol_type = genomic DNA
agagagaaacagaggcggtgacgctaggaagaggaggagagaaggaggccgcgggtccctgtcgcctccaggccaggcaatccactccaggctcgcaatccaccgacctggagttcacggcctccgccctcctggcccagcggcccccacccgaccccacccgaccccacccgacccaggccggttccggtcacgccggaagcacgtggccccccaccctgcggcgttgcccgggagaccagggttgtttaccagcaggacagagcccgggcgcaggcggcggatggagcggaacggctaggtgagagcggctgcccgatcccgcggcctgcccttggcctccgccaggcctggaaggggccgggggaggccagtccccgagaccccagcacatcacccgggagggcctccccagacccagcccgggggacgcaaaccccgggagacaggcgag

SEQ ID NO: 102248 - DNA, 29 bp, Homo sapiens
  misc_feature 1..29: note = chr1:20534652-20534681
  misc_feature 1..29: note = Hypo
  source 1..29: mol_type = genomic DNA
acagagtgagaccccgcatccaaaagaaa

SEQ ID NO: 102249 - DNA, 413 bp, Homo sapiens; identical to SEQ ID NO: 26111
  misc_feature 1..413: note = chr1:20618140-20618553
  misc_feature 1..413: note = Hyper
  source 1..413: mol_type = genomic DNA

SEQ ID NO: 102250 - DNA, 267 bp, Homo sapiens
  misc_feature 1..267: note = chr1:20669698-20669965
  misc_feature 1..267: note = Hyper
  source 1..267: mol_type = genomic DNA
ggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcagggtgagcgccacggaactgcgcccctcccgcggacggcctccggaggacagccccgctccacagccgctcccccttcccc

SEQ ID NO: 102251 - DNA, 105 bp, Homo sapiens; identical to SEQ ID NO: 68451
  misc_feature 1..105: note = chr1:20692819-20692924
  misc_feature 1..105: note = Hyper
  source 1..105: mol_type = genomic DNA

SEQ ID NO: 102252 - DNA, 30 bp, Homo sapiens; identical to SEQ ID NO: 68452
  misc_feature 1..30: note = chr1:20693939-20693969
  misc_feature 1..30: note = Hyper
  source 1..30: mol_type = genomic DNA

SEQ ID NO: 102253 - DNA, 336 bp, Homo sapiens
  misc_feature 1..336: note = chr1:20810594-20810930
  misc_feature 1..336: note = Hyper
  source 1..336: mol_type = genomic DNA
accccaggtaagtcccgagcgcagctccggtgggcaaggctaggtgcggagatgagcggaaccaggaggggacgccaaaaccggttcccacgacgcgcagcgggtgggggttagggcctggcctgggcgggcgccccctcctgcgcgccctctcccagccgctggccgactgactcggccgccccgcgctccccgctgccgcagaggtcagagcctcccttcgctgcctgccagggacacatgccgtaacctcggcctctcttaccgtctcgacttagcctcgcctttctcagtccctccatcgtccctcggcgcgacggccggcagccgatcgag

SEQ ID NO: 102254 - DNA, 469 bp, Homo sapiens; identical to SEQ ID NO: 68482
  misc_feature 1..469: note = chr1:20811286-20811755
  misc_feature 1..469: note = Hyper
  source 1..469: mol_type = genomic DNA

SEQ ID NO: 102255 - DNA, 175 bp, Homo sapiens; identical to SEQ ID NO: 68487
  misc_feature 1..175: note = chr1:20878485-20878660
  misc_feature 1..175: note = Hyper
  source 1..175: mol_type = genomic DNA

SEQ ID NO: 102256 - DNA, 1732 bp, Homo sapiens
  misc_feature 1..1732: note = chr1:20878905-20880637
  misc_feature 1..1732: note = Hyper
  source 1..1732: mol_type = genomic DNA
gcctgtgcagggtcccgggcagcgcgagcctgcgtggggggaggggagaagagggcaaggggaggggacaagagagctagcggtcccgcccggtgatgtaggcagcccggggaggtggagccgcgacgcctgaaggagtccccaccgcagccgcgctctcggtctgccccactaagcagccgccagcggctccggcgacccaaattgcggcggcagggaccgcggaaatcccaccgtttgggcttggtggacgtccagcccacctcacccccagccccggcccctcctcgcttcccagacggctggagacactcccgggaaaagcggtcctcagccactcggccgccgtccgcacctcggctgctggcccggctgggcaccgggcatctgcgaagctagccctgcctggcactgggcatctccaggcaacgactgtccccggccctgcccagcttctcgcgactccagggcggtggacttctgcgcgccttccctcccccggtctcccgacaggacgccggtgagctccctgcgcccccagcccctttcgccgccgccgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattg

SEQ ID NO: 102257 - DNA, 25 bp, Homo sapiens
  misc_feature 1..25: note = chr1:20897067-20897092
  misc_feature 1..25: note = Hypo
  source 1..25: mol_type = genomic DNA
ggattacagacgtgagtcacccatc

SEQ ID NO: 102258 - DNA, 93 bp, Homo sapiens; identical to SEQ ID NO: 68495
  misc_feature 1..93: note = chr1:20916163-20916256
  misc_feature 1..93: note = Hyper
  source 1..93: mol_type = genomic DNA

SEQ ID NO: 102259 - DNA, 30 bp, Homo sapiens; identical to SEQ ID NO: 68506
  misc_feature 1..30: note = chr1:21024801-21024831
  misc_feature 1..30: note = Hypo
  source 1..30: mol_type = genomic DNA

SEQ ID NO: 102260 - DNA, 30 bp, Homo sapiens; identical to SEQ ID NO: 68507
  misc_feature 1..30: note = chr1:21026148-21026178
  misc_feature 1..30: note = Hypo
  source 1..30: mol_type = genomic DNA

SEQ ID NO: 102261 - DNA, 30 bp, Homo sapiens; identical to SEQ ID NO: 68508
  misc_feature 1..30: note = chr1:21030592-21030622
  misc_feature 1..30: note = Hypo
  source 1..30: mol_type = genomic DNA

SEQ ID NO: 102262 - DNA, 36 bp, Homo sapiens; identical to SEQ ID NO: 68512
  misc_feature 1..36: note = chr1:21042027-21042063
  misc_feature 1..36: note = Hypo
  source 1..36: mol_type = genomic DNA

SEQ ID NO: 102263 - DNA, 337 bp, Homo sapiens; identical to SEQ ID NO: 68513
  misc_feature 1..337: note = chr1:21042750-21043087
  misc_feature 1..337: note = Hypo
  source 1..337: mol_type = genomic DNA

SEQ ID NO: 102264 - DNA, 219 bp, Homo sapiens; identical to SEQ ID NO: 68514
  misc_feature 1..219: note = chr1:21044015-21044234
  misc_feature 1..219: note = Hyper
  source 1..219: mol_type = genomic DNA

SEQ ID NO: 102265 - DNA, 154 bp, Homo sapiens; identical to SEQ ID NO: 68516
  misc_feature 1..154: note = chr1:21058263-21058417
  misc_feature 1..154: note = Hyper
  source 1..154: mol_type = genomic DNA

SEQ ID NO: 102266 - DNA, 164 bp, Homo sapiens; identical to SEQ ID NO: 68555
  misc_feature 1..164: note = chr1:21523130-21523294
  misc_feature 1..164: note = Hypo
  source 1..164: mol_type = genomic DNA

SEQ ID NO: 102267 - DNA, 51 bp, Homo sapiens; identical to SEQ ID NO: 68558
  misc_feature 1..51: note = chr1:21568327-21568378
  misc_feature 1..51: note = Hypo
  source 1..51: mol_type = genomic DNA

SEQ ID NO: 102268 - DNA, 83 bp, Homo sapiens; identical to SEQ ID NO: 68559
  misc_feature 1..83: note = chr1:21573351-21573434
  misc_feature 1..83: note = Hypo
  source 1..83: mol_type = genomic DNA

SEQ ID NO: 102269 - DNA, 294 bp, Homo sapiens; identical to SEQ ID NO: 68560
  misc_feature 1..294: note = chr1:21573828-21574122
  misc_feature 1..294: note = Hypo
  source 1..294: mol_type = genomic DNA

SEQ ID NO: 102270 - DNA, 141 bp, Homo sapiens; identical to SEQ ID NO: 68562
  misc_feature 1..141: note = chr1:21586789-21586930
  misc_feature 1..141: note = Hypo
  source 1..141: mol_type = genomic DNA

SEQ ID NO: 102271 - DNA, 30 bp, Homo sapiens; identical to SEQ ID NO: 68563
  misc_feature 1..30: note = chr1:21594515-21594545
  misc_feature 1..30: note = Hypo
  source 1..30: mol_type = genomic DNA

SEQ ID NO: 102272 - DNA, 40 bp, Homo sapiens; identical to SEQ ID NO: 68564
  misc_feature 1..40: note = chr1:21611198-21611238
  misc_feature 1..40: note = Hypo
  source 1..40: mol_type = genomic DNA

SEQ ID NO: 102273 - DNA, 35 bp, Homo sapiens; identical to SEQ ID NO: 68567
  misc_feature 1..35: note = chr1:21682446-21682481
  misc_feature 1..35: note = Hypo
  source 1..35: mol_type = genomic DNA

SEQ ID NO: 102274 - DNA, 146 bp, Homo sapiens; identical to SEQ ID NO: 68579
  misc_feature 1..146: note = chr1:21754473-21754619
  misc_feature 1..146: note = Hyper
  source 1..146: mol_type = genomic DNA

SEQ ID NO: 102275 - DNA, 40 bp, Homo sapiens; identical to SEQ ID NO: 68581
  misc_feature 1..40: note = chr1:21831562-21831602
  misc_feature 1..40: note = Hypo
  source 1..40: mol_type = genomic DNA

SEQ ID NO: 102276 - DNA, 254 bp, Homo sapiens; identical to SEQ ID NO: 68583
  misc_feature 1..254: note = chr1:21835380-21835634
  misc_feature 1..254: note = Hyper
  source 1..254: mol_type = genomic DNA

SEQ ID NO: 102277 - DNA, 505 bp, Homo sapiens; identical to SEQ ID NO: 68584
  misc_feature 1..505: note = chr1:21835915-21836420
  misc_feature 1..505: note = Hyper
  source 1..505: mol_type = genomic DNA

SEQ ID NO: 102278 - DNA, 42 bp, Homo sapiens; identical to SEQ ID NO: 68586
  misc_feature 1..42: note = chr1:21846323-21846365
  misc_feature 1..42: note = Hypo
  source 1..42: mol_type = genomic DNA

SEQ ID NO: 102279 - DNA, 30 bp, Homo sapiens; identical to SEQ ID NO: 68591
  misc_feature 1..30: note = chr1:21934551-21934581
  misc_feature 1..30: note = Hyper
  source 1..30: mol_type = genomic DNA

SEQ ID NO: 102280 - DNA, 37 bp, Homo sapiens; identical to SEQ ID NO: 68593
  misc_feature 1..37: note = chr1:21948897-21948934
  misc_feature 1..37: note = Hyper
  source 1..37: mol_type = genomic DNA

SEQ ID NO: 102281 - DNA, 30 bp, Homo sapiens; identical to SEQ ID NO: 68594
  misc_feature 1..30: note = chr1:21949180-21949210
  misc_feature 1..30: note = Hyper
  source 1..30: mol_type = genomic DNA

SEQ ID NO: 102282 - DNA, 315 bp, Homo sapiens; identical to SEQ ID NO: 68595
  misc_feature 1..315: note = chr1:21996075-21996390
  misc_feature 1..315: note = Hyper
  source 1..315: mol_type = genomic DNA

SEQ ID NO: 102283 - DNA, 120 bp, Homo sapiens; identical to SEQ ID NO: 38884
  misc_feature 1..120: note = chr1:22092109-22092229
  misc_feature 1..120: note = Hypo
  source 1..120: mol_type = genomic DNA

SEQ ID NO: 102284 - DNA, 635 bp, Homo sapiens
  misc_feature 1..635: note = chr1:22140673-22141308
  misc_feature 1..635: note = Hyper
  source 1..635: mol_type = genomic DNA
ggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggcggcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctcttt

SEQ ID NO: 102285 - DNA, 179 bp, Homo sapiens; identical to SEQ ID NO: 68625
  misc_feature 1..179: note = chr1:22333829-22334008
  misc_feature 1..179: note = Hypo
  source 1..179: mol_type = genomic DNA

SEQ ID NO: 102286 - DNA, 208 bp, Homo sapiens; identical to SEQ ID NO: 68628
  misc_feature 1..208: note = chr1:22349452-22349660
  misc_feature 1..208: note = Hypo
  source 1..208: mol_type = genomic DNA

SEQ ID NO: 102287 - DNA, 41 bp, Homo sapiens; identical to SEQ ID NO: 68633
  misc_feature 1..41: note = chr1:22378609-22378650
  misc_feature 1..41: note = Hypo
  source 1..41: mol_type = genomic DNA

SEQ ID NO: 102288 - DNA, 119 bp, Homo sapiens; identical to SEQ ID NO: 38886
  misc_feature 1..119: note = chr1:22447958-22448077
  misc_feature 1..119: note = Hypo
  source 1..119: mol_type = genomic DNA

SEQ ID NO: 102289 - DNA, 37 bp, Homo sapiens; identical to SEQ ID NO: 68653
  misc_feature 1..37: note = chr1:22468804-22468841
  misc_feature 1..37: note = Hyper
  source 1..37: mol_type = genomic DNA

SEQ ID NO: 102290 - DNA, 30 bp, Homo sapiens; identical to SEQ ID NO: 68697
  misc_feature 1..30: note = chr1:22710484-22710514
  misc_feature 1..30: note = Hypo
  source 1..30: mol_type = genomic DNA

SEQ ID NO: 102291 - DNA, 184 bp, Homo sapiens; identical to SEQ ID NO: 38887
  misc_feature 1..184: note = chr1:22777513-22777697
  misc_feature 1..184: note = Hypo
  source 1..184: mol_type = genomic DNA

SEQ ID NO: 102292 - DNA, 814 bp, Homo sapiens
  misc_feature 1..814: note = chr1:22889595-22890409
  misc_feature 1..814: note = Hyper
  source 1..814: mol_type = genomic DNA
cggagtgtgtcaccacgcgaagcactcggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctgagccctgagtccaagtgcgcagcgcggggcgcgcccccgaaggtgcccgccgggggagtgtgggcgtgcgcacgtgcggcggcggtggccgcgggccgggtggccgcggtgcgggctccgtgtcccccacccccccgcctcggtgctgattggctcggcgccgtgacgggccggcccccgcccggggcggcggcggcggcggcgggcgcgggtgcccgcgtgtgcgctgggagccgcgtgtgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaa

SEQ ID NO: 102293 - DNA, 30 bp, Homo sapiens; identical to SEQ ID NO: 68783
  misc_feature 1..30: note = chr1:22893250-22893280
  misc_feature 1..30: note = Hypo
  source 1..30: mol_type = genomic DNA

SEQ ID NO: 102294 - DNA, 193 bp, Homo sapiens; identical to SEQ ID NO: 68784
  misc_feature 1..193: note = chr1:22896425-22896618
  misc_feature 1..193: note = Hypo
  source 1..193: mol_type = genomic DNA

SEQ ID NO: 102295 - DNA, 154 bp, Homo sapiens; identical to SEQ ID NO: 68785
  misc_feature 1..154: note = chr1:22900779-22900933
  misc_feature 1..154: note = Hypo
  source 1..154: mol_type = genomic DNA

SEQ ID NO: 102296 - DNA, 107 bp, Homo sapiens; identical to SEQ ID NO: 68786
  misc_feature 1..107: note = chr1:22902850-22902957
  misc_feature 1..107: note = Hypo
  source 1..107: mol_type = genomic DNA

SEQ ID NO: 102297 - DNA, 78 bp, Homo sapiens; identical to SEQ ID NO: 68787
  misc_feature 1..78: note = chr1:22903278-22903356
  misc_feature 1..78: note = Hypo
  source 1..78: mol_type = genomic DNA

SEQ ID NO: 102298 - DNA, 222 bp, Homo sapiens; identical to SEQ ID NO: 68788
  misc_feature 1..222: note = chr1:22927359-22927581
  misc_feature 1..222: note = Hypo
  source 1..222: mol_type = genomic DNA

SEQ ID NO: 102299 - DNA, 48 bp, Homo sapiens; identical to SEQ ID NO: 26132
  misc_feature 1..48: note = chr1:22933907-22933955
  misc_feature 1..48: note = Hyper
  source 1..48: mol_type = genomic DNA

SEQ ID NO: 102300 - DNA, 73 bp, Homo sapiens; identical to SEQ ID NO: 26133
  misc_feature 1..73: note = chr1:23038177-23038250
  misc_feature 1..73: note = Hyper
  source 1..73: mol_type = genomic DNA

SEQ ID NO: 102301 - DNA, 30 bp, Homo sapiens; identical to SEQ ID NO: 68909
  misc_feature 1..30: note = chr1:23693485-23693515
  misc_feature 1..30: note = Hypo
  source 1..30: mol_type = genomic DNA

SEQ ID NO: 102302 - DNA, 33 bp, Homo sapiens; identical to SEQ ID NO: 38890
  misc_feature 1..33: note = chr1:23694078-23694111
  misc_feature 1..33: note = Hypo
  source 1..33: mol_type = genomic DNA

SEQ ID NO: 102303 - DNA, 33 bp, Homo sapiens; identical to SEQ ID NO: 68911
  misc_feature 1..33: note = chr1:23704242-23704275
  misc_feature 1..33: note = Hypo
  source 1..33: mol_type = genomic DNA

SEQ ID NO: 102304 - DNA, 299 bp, Homo sapiens; identical to SEQ ID NO: 68917
  misc_feature 1..299: note = chr1:23748862-23749161
  misc_feature 1..299: note = Hyper
  source 1..299: mol_type = genomic DNA

SEQ ID NO: 102305 - DNA, 74 bp, Homo sapiens; identical to SEQ ID NO: 68919
  misc_feature 1..74: note = chr1:23750737-23750811
  misc_feature 1..74: note = Hyper
  source 1..74: mol_type = genomic DNA

SEQ ID NO: 102306 - DNA, 88 bp, Homo sapiens; identical to SEQ ID NO: 68929
  misc_feature 1..88: note = chr1:23833064-23833152
  misc_feature 1..88: note = Hypo
  source 1..88: mol_type = genomic DNA

SEQ ID NO: 102307 - DNA, 84 bp, Homo sapiens; identical to SEQ ID NO: 68931
  misc_feature 1..84: note = chr1:23859450-23859534
  misc_feature 1..84: note = Hypo
  source 1..84: mol_type = genomic DNA

SEQ ID NO: 102308 - DNA, 72 bp, Homo sapiens; identical to SEQ ID NO: 68932
  misc_feature 1..72: note = chr1:23884932-23885004
  misc_feature 1..72: note = Hyper
  source 1..72: mol_type = genomic DNA

SEQ ID NO: 102309 - DNA, 41 bp, Homo sapiens; identical to SEQ ID NO: 68943
  misc_feature 1..41: note = chr1:24017587-24017628
  misc_feature 1..41: note = Hypo
  source 1..41: mol_type = genomic DNA

SEQ ID NO: 102310 - DNA, 206 bp, Homo sapiens; identical to SEQ ID NO: 68959
  misc_feature 1..206: note = chr1:24119111-24119317
  misc_feature 1..206: note = Hypo
  source 1..206: mol_type = genomic DNA

SEQ ID NO: 102311 - DNA, 17 bp, Homo sapiens
  misc_feature 1..17: note = chr1:24246049-24246066
  misc_feature 1..17: note = Hypo
  source 1..17: mol_type = genomic DNA
atttattttttaagacg

SEQ ID NO: 102312 - DNA, 21 bp, Homo sapiens
  misc_feature 1..21: note = chr1:24426643-24426664
  misc_feature 1..21: note = Hypo
  source 1..21: mol_type = genomic DNA
ccaccgcgcctggcctccagt

SEQ ID NO: 102313 - DNA, 47 bp, Homo sapiens; identical to SEQ ID NO: 69012
  misc_feature 1..47: note = chr1:24435099-24435146
  misc_feature 1..47: note = Hypo
  source 1..47: mol_type = genomic DNA

SEQ ID NO: 102314 - DNA, 43 bp, Homo sapiens; identical to SEQ ID NO: 69051
  misc_feature 1..43: note = chr1:24611924-24611967
  misc_feature 1..43: note = Hypo
  source 1..43: mol_type = genomic DNA

SEQ ID NO: 102315 - DNA, 112 bp, Homo sapiens; identical to SEQ ID NO: 69059
  misc_feature 1..112: note = chr1:24648230-24648342
  misc_feature 1..112: note = Hyper
  source 1..112: mol_type = genomic DNA

SEQ ID NO: 102316 - DNA, 319 bp, Homo sapiens; identical to SEQ ID NO: 69061
  misc_feature 1..319: note = chr1:24648832-24649151
  misc_feature 1..319: note = Hyper
  source 1..319: mol_type = genomic DNA

SEQ ID NO: 102317 - DNA, 83 bp, Homo sapiens; identical to SEQ ID NO: 69070
  misc_feature 1..83: note = chr1:24701375-24701458
  misc_feature 1..83: note = Hypo
  source 1..83: mol_type = genomic DNA

SEQ ID NO: 102318 - DNA, 180 bp, Homo sapiens; identical to SEQ ID NO: 69080
  misc_feature 1..180: note = chr1:24740809-24740989
  misc_feature 1..180: note = Hypo
  source 1..180: mol_type = genomic DNA

SEQ ID NO: 102319 - DNA, 154 bp, Homo sapiens; identical to SEQ ID NO: 69087
  misc_feature 1..154: note = chr1:24768639-24768793
  misc_feature 1..154: note = Hypo
  source 1..154: mol_type = genomic DNA

SEQ ID NO: 102320 - DNA, 88 bp, Homo sapiens; identical to SEQ ID NO: 69129
  misc_feature 1..88: note = chr1:25220516-25220604
  misc_feature 1..88: note = Hypo
  source 1..88: mol_type = genomic DNA

SEQ ID NO: 102321 - DNA, 43 bp, Homo sapiens; identical to SEQ ID NO: 69130
  misc_feature 1..43: note = chr1:25228594-25228637
  misc_feature 1..43: note = Hypo
  source 1..43: mol_type = genomic DNA

SEQ ID NO: 102322 - DNA, 1428 bp, Homo sapiens
  misc_feature 1..1428: note = chr1:25255940-25257368
  misc_feature 1..1428: note = Hyper
  source 1..1428: mol_type = genomic DNA
actgaaccgggtgcccgggtgtcgccgcggcgtctcgggcacctcccatccccactgctcccgaggctctggctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctggcggagcgacgcgtcgcacagccaatcggcggagcccccatcgcgggcacctcggtggcgttcgcggggaggaacggggcctgccggaggccgcccaacggggaggggcggaaggcgccaccccgcggaggaggccccagtgccacagcccagggcccccgagagctctgggagcccggggcaaatgctagaaatttgcttagaacgtccgggtcccacggaaggcgcccttgccgccctctctcgggtcgtagctccctgacgctggggcgcaaccccttcgctcctcctccccgctggccgcggccgggcttccccagctcttgctgcttcgggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctcccagccctgcgcggctttggtcccag

SEQ ID NO: 102323 - DNA, 117 bp, Homo sapiens; identical to SEQ ID NO: 26139
  misc_feature 1..117: note = chr1:25259018-25259135
  misc_feature 1..117: note = Hyper
  source 1..117: mol_type = genomic DNA

SEQ ID NO: 102324 - DNA, 64 bp, Homo sapiens; identical to SEQ ID NO: 69134
  misc_feature 1..64: note = chr1:25269281-25269345
  misc_feature 1..64: note = Hypo
  source 1..64: mol_type = genomic DNA

SEQ ID NO: 102325 - DNA, 30 bp, Homo sapiens; identical to SEQ ID NO: 69137
  misc_feature 1..30: note = chr1:25351684-25351714
  misc_feature 1..30: note = Hypo
  source 1..30: mol_type = genomic DNA

SEQ ID NO: 102326 - DNA, 30 bp, Homo sapiens; identical to SEQ ID NO: 69142
  misc_feature 1..30: note = chr1:25417486-25417516
  misc_feature 1..30: note = Hypo
  source 1..30: mol_type = genomic DNA

SEQ ID NO: 102327 - DNA, 35 bp, Homo sapiens; identical to SEQ ID NO: 69143
  misc_feature 1..35: note = chr1:25425784-25425819
  misc_feature 1..35: note = Hyper
  source 1..35: mol_type = genomic DNA

SEQ ID NO: 102328 - DNA, 30 bp, Homo sapiens; identical to SEQ ID NO: 69144
  misc_feature 1..30: note = chr1:25501519-25501549
  misc_feature 1..30: note = Hypo
  source 1..30: mol_type = genomic DNA

SEQ ID NO: 102329 - DNA, 29 bp, Homo sapiens
  misc_feature 1..29: note = chr1:25601203-25601232
  misc_feature 1..29: note = Hypo
  source 1..29: mol_type = genomic DNA
ggggaaacaaagggccgggcgacgtggct

SEQ ID NO: 102330 - DNA, 30 bp, Homo sapiens; identical to SEQ ID NO: 69148
  misc_feature 1..30: note = chr1:25856663-25856693
  misc_feature 1..30: note = Hypo
  source 1..30: mol_type = genomic DNA

SEQ ID NO: 102331 - DNA, 30 bp, Homo sapiens; identical to SEQ ID NO: 69149
  misc_feature 1..30: note = chr1:25857535-25857565
  misc_feature 1..30: note = Hypo
  source 1..30: mol_type = genomic DNA

SEQ ID NO: 102332 - DNA, 30 bp, Homo sapiens; identical to SEQ ID NO: 69150
  misc_feature 1..30: note = chr1:25999651-25999681
  misc_feature 1..30: note = Hypo
  source 1..30: mol_type = genomic DNA

SEQ ID NO: 102333 - DNA, 30 bp, Homo sapiens; identical to SEQ ID NO: 69151
  misc_feature 1..30: note = chr1:26222050-26222080
  misc_feature 1..30: note = Hyper
  source 1..30: mol_type = genomic DNA

SEQ ID NO: 102334 - DNA, 602 bp, Homo sapiens; identical to SEQ ID NO: 69152
  misc_feature 1..602: note = chr1:26249024-26249626
  misc_feature 1..602: note = Hyper
  source 1..602: mol_type = genomic DNA

SEQ ID NO: 102335 - DNA, 32 bp, Homo sapiens; identical to SEQ ID NO: 69153
  misc_feature 1..32: note = chr1:26336891-26336923
  misc_feature 1..32: note = Hypo
  source 1..32: mol_type = genomic DNA

SEQ ID NO: 102336 - DNA, 92 bp, Homo sapiens; identical to SEQ ID NO: 69154
  misc_feature 1..92: note = chr1:26337163-26337255
  misc_feature 1..92: note = Hypo
  source 1..92: mol_type = genomic DNA

SEQ ID NO: 102337 - DNA, 30 bp, Homo sapiens; identical to SEQ ID NO: 69155
  misc_feature 1..30: note = chr1:26372114-26372144
  misc_feature 1..30: note = Hyper
  source 1..30: mol_type = genomic DNA

SEQ ID NO: 102338 - DNA, 30 bp, Homo sapiens; identical to SEQ ID NO: 69156
  misc_feature 1..30: note = chr1:26372535-26372565
  misc_feature 1..30: note = Hyper
  source 1..30: mol_type = genomic DNA

SEQ ID NO: 102339 - DNA, 113 bp, Homo sapiens; identical to SEQ ID NO: 26142
  misc_feature 1..113: note = chr1:26372988-26373101
  misc_feature 1..113: note = Hyper
  source 1..113: mol_type = genomic DNA

SEQ ID NO: 102340 - DNA, 603 bp, Homo sapiens
  misc_feature 1..603: note = chr1:26551658-26552261
  misc_feature 1..603: note = Hyper
  source 1..603: mol_type = genomic DNA
gccttcaacctgatccgcttctcgaccagcgatacactgtacctgcacggccgagtgaccctgtgtgacacgcgggcaagacgcccatgccaaccagtgagtgggcagccccgggacctcctgcgcagccgccgcagccttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcggtaaatggatcatttctggggcctccctgactcctcttccagagcctcctaccgacctgctctgtcc

SEQ ID NO: 102341 - DNA, 36 bp, Homo sapiens; identical to SEQ ID NO: 69159
  misc_feature 1..36: note = chr1:26612389-26612425
  misc_feature 1..36: note = Hypo
  source 1..36: mol_type = genomic DNA

SEQ ID NO: 102342 - DNA, 30 bp, Homo sapiens; identical to SEQ ID NO: 69160
  misc_feature 1..30: note = chr1:26627535-26627565
  misc_feature 1..30: note = Hypo
  source 1..30: mol_type = genomic DNA

SEQ ID NO: 102343 - DNA, 30 bp, Homo sapiens; identical to SEQ ID NO: 69161
  misc_feature 1..30: note = chr1:26648095-26648125
  misc_feature 1..30: note = Hyper
  source 1..30: mol_type = genomic DNA

SEQ ID NO: 102344 - DNA, 31 bp, Homo sapiens; identical to SEQ ID NO: 69162
  misc_feature 1..31: note = chr1:26723047-26723078
  misc_feature 1..31: note = Hypo
  source 1..31: mol_type = genomic DNA

SEQ ID NO: 102345 - DNA, 121 bp, Homo sapiens; identical to SEQ ID NO: 26144
  misc_feature 1..121: note = chr1:26735162-26735283
  misc_feature 1..121: note = Hyper
  source 1..121: mol_type = genomic DNA

SEQ ID NO: 102346 - DNA, 396 bp, Homo sapiens
  misc_feature 1..396: note = chr1:26735591-26735987
  misc_feature 1..396: note = Hyper
  source 1..396: mol_type = genomic DNA
tcctttttaccccacgaagtcccacctcccattccttacgctcaagttttcatttcttggagagcaccccgtacgagagaaagggaaataacttctgcagtctcttgctttcctccccatcttccccttccctacccccactcatccggtctctctgaaatacacatgtgcccacatccgcacgtgcacacacacacacacacaaacacacacacagagccacagcgtgagaattccaaaaggttctgcacactcggtggagaagattgaattcagagcaagcggatgcccccgaaagcaggctctgtccctttaaatgggttgtagtggtgggggaggggaactggccggagctggcattgtccagtttgaactgaacaccggaagtgaaggggc

SEQ ID NO: 102347 - DNA, 1143 bp, Homo sapiens
  misc_feature 1..1143: note = chr1:26737181-26738324
  misc_feature 1..1143: note = Hyper
  source 1..1143: mol_type = genomic DNA
ggggagggggctgcccgcggggggttgggtcattgtcttttagaatttgggagcctttgaaaagccgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggcgtgcgcgccagactacgtgggtggatggagaggagaggcttgtcccgccgtgagtctctgggaaacgcgttgtgggaagaggagcaaaactttcggggcactactgtcccggtgtacgctaggggaacgcgggaggcgaccgggataggtttcttctcttctgttgcttggtagctgccccctcctggctgtccacttgtggggctggatactcgggtctccctgcctggggcccgagacggccctccgattccgtgccccccagctaagtgcccggccctccctctctccaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccaggtgagactgattccggtaactttgcccagggaagggcgtctaggcgcccatatccacgggtgggctccgggctcgcagttgaattgagggccatcgggagccctcattatgcatccctgtctttgcttcggcaccccaattctgagtccctgttaactatctcgtgggggagtagtgggaggcagcaccaattatcagcacccccgcccccttccgggaacccctccggcttaccacgtgtctattacctc

SEQ ID NO: 102348 - DNA, 30 bp, Homo sapiens; identical to SEQ ID NO: 69167
  misc_feature 1..30: note = chr1:26758265-26758295
  misc_feature 1..30: note = Hyper
  source 1..30: mol_type = genomic DNA

SEQ ID NO: 102349 - DNA, 18 bp, Homo sapiens
  misc_feature 1..18: note = chr1:26879273-26879291
  misc_feature 1..18: note = Hypo
  source 1..18: mol_type = genomic DNA
gcccggcttaaattgtga

SEQ ID NO: 102350 - DNA, 43 bp, Homo sapiens; identical to SEQ ID NO: 38900
  misc_feature 1..43: note = chr1:26969603-26969646
  misc_feature 1..43: note = Hypo
  source 1..43: mol_type = genomic DNA

SEQ ID NO: 102351 - DNA, 90 bp, Homo sapiens; identical to SEQ ID NO: 69174
  misc_feature 1..90: note = chr1:27113624-27113714
  misc_feature 1..90: note = Hyper
  source 1..90: mol_type = genomic DNA

SEQ ID NO: 102352 - DNA, 30 bp, Homo sapiens; identical to SEQ ID NO: 69176
  misc_feature 1..30: note = chr1:27183642-27183672
  misc_feature 1..30: note = Hypo
  source 1..30: mol_type = genomic DNA

SEQ ID NO: 102353 - DNA, 406 bp, Homo sapiens; identical to SEQ ID NO: 69177
  misc_feature 1..406: note = chr1:27189908-27190314
  misc_feature 1..406: note = Hypo
  source 1..406: mol_type = genomic DNA

SEQ ID NO: 102354 - DNA, 70 bp, Homo sapiens; identical to SEQ ID NO: 69182
  misc_feature 1..70: note = chr1:27319476-27319546
  misc_feature 1..70: note = Hyper
  source 1..70: mol_type = genomic DNA

SEQ ID NO: 102355 - DNA, 112 bp, Homo sapiens; identical to SEQ ID NO: 69185
  misc_feature 1..112: note = chr1:27339342-27339454
  misc_feature 1..112: note = Hyper
  source 1..112: mol_type = genomic DNA

SEQ ID NO: 102356 - DNA, 30 bp, Homo sapiens; identical to SEQ ID NO: 69186
  misc_feature 1..30: note = chr1:27358149-27358179
  misc_feature 1..30: note = Hyper
  source 1..30: mol_type = genomic DNA

SEQ ID NO: 102357 - DNA, 18 bp, Homo sapiens
  misc_feature 1..18: note = chr1:27558365-27558383
  misc_feature 1..18: note = Hypo
  source 1..18: mol_type = genomic DNA
tgggggttctctggccgg

SEQ ID NO: 102358 - DNA, 187 bp, Homo sapiens; identical to SEQ ID NO: 69188
  misc_feature 1..187: note = chr1:27628242-27628429
  misc_feature 1..187: note = Hypo
  source 1..187: mol_type = genomic DNA

SEQ ID NO: 102359 - DNA, 30 bp, Homo sapiens; identical to SEQ ID NO: 69189
  misc_feature 1..30: note = chr1:27675398-27675428
  misc_feature 1..30: note = Hypo
  source 1..30: mol_type = genomic DNA

SEQ ID NO: 102360 - DNA, 76 bp, Homo sapiens
  misc_feature 1..76: note = chr1:27684179-27684255
  misc_feature 1..76: note = Hyper
  source 1..76: mol_type = genomic DNA
ggcgctagagtgggccgcccacctgctcttgcttctgctcctggtgcagattctccgccagcgctggcagctcctg

SEQ ID NO: 102361 - DNA, 30 bp, Homo sapiens; identical to SEQ ID NO: 69193
  misc_feature 1..30: note = chr1:27710201-27710231
  misc_feature 1..30: note = Hypo
  source 1..30: mol_type = genomic DNA

SEQ ID NO: 102362 - DNA, 32 bp, Homo sapiens; identical to SEQ ID NO: 69194
  misc_feature 1..32: note = chr1:27719783-27719815
  misc_feature 1..32: note = Hypo
  source 1..32: mol_type = genomic DNA

SEQ ID NO: 102363 - DNA, 104 bp, Homo sapiens; identical to SEQ ID NO: 69196
  misc_feature 1..104: note = chr1:27844518-27844622
  misc_feature 1..104: note = Hypo
  source 1..104: mol_type = genomic DNA

SEQ ID NO: 102364 - DNA, 30 bp, Homo sapiens; identical to SEQ ID NO: 69197
  misc_feature 1..30: note = chr1:27844988-27845018
  misc_feature 1..30: note = Hypo
  source 1..30: mol_type = genomic DNA

SEQ ID NO: 102365 - DNA, 35 bp, Homo sapiens; identical to SEQ ID NO: 69198
  misc_feature 1..35: note = chr1:27868411-27868446
  misc_feature 1..35: note = Hypo
  source 1..35: mol_type = genomic DNA

SEQ ID NO: 102366 - DNA, 244 bp, Homo sapiens; identical to SEQ ID NO: 69199
  misc_feature 1..244: note = chr1:27876089-27876333
  misc_feature 1..244: note = Hypo
  source 1..244: mol_type = genomic DNA

SEQ ID NO: 102367 - DNA, 475 bp, Homo sapiens; identical to SEQ ID NO: 69200
  misc_feature 1..475: note = chr1:27960621-27961096
  misc_feature 1..475: note = Hyper
  source 1..475: mol_type = genomic DNA

SEQ ID NO: 102368 - DNA, 30 bp, Homo sapiens; identical to SEQ ID NO: 69201
  misc_feature 1..30: note = chr1:28198358-28198388
  misc_feature 1..30: note = Hypo
  source 1..30: mol_type = genomic DNA

SEQ ID NO: 102369 - DNA, 688 bp, Homo sapiens; identical to SEQ ID NO: 69202
  misc_feature 1..688: note = chr1:28199059-28199747
  misc_feature 1..688: note = Hyper
  source 1..688: mol_type = genomic DNA

SEQ ID NO: 102370 - DNA, 113 bp, Homo sapiens; identical to SEQ ID NO: 69206
  misc_feature 1..113: note = chr1:28293291-28293404
  misc_feature 1..113: note = Hypo
  source 1..113: mol_type = genomic DNA

SEQ ID NO: 102371 - DNA, 89 bp, Homo sapiens; identical to SEQ ID NO: 69216
  misc_feature 1..89: note = chr1:28853681-28853770
  misc_feature 1..89: note = Hypo
  source 1..89: mol_type = genomic DNA

SEQ ID NO: 102372 - DNA, 74 bp, Homo sapiens; identical to SEQ ID NO: 69217
  misc_feature 1..74: note = chr1:28865161-28865235
  misc_feature 1..74: note = Hypo
  source 1..74: mol_type = genomic DNA

SEQ ID NO: 102373 - DNA, 246 bp, Homo sapiens; identical to SEQ ID NO: 69219
  misc_feature 1..246: note = chr1:28919075-28919321
  misc_feature 1..246: note = Hyper
  source 1..246: mol_type = genomic DNA

SEQ ID NO: 102374 - DNA, 23 bp, Homo sapiens
  misc_feature 1..23: note = chr1:28926140-28926163
  misc_feature 1..23: note = Hypo
  source 1..23: mol_type = genomic DNA
atggcacgcgcctgtggtgccac

SEQ ID NO: 102375 - DNA, 18 bp, Homo sapiens
  misc_feature 1..18: note = chr1:29047659-29047677
  misc_feature 1..18: note = Hypo
  source 1..18: mol_type = genomic DNA
tttttttttgtgaggcgg

SEQ ID NO: 102376 - DNA, 23 bp, Homo sapiens
  misc_feature 1..23: note = chr1:29061371-29061394
  misc_feature 1..23: note = Hypo
  source 1..23: mol_type = genomic DNA
accgcacccggcttttttttttt

SEQ ID NO: 102377 - DNA, 39 bp, Homo sapiens; identical to SEQ ID NO: 69224
  misc_feature 1..39: note = chr1:29074244-29074283
  misc_feature 1..39: note = Hypo
  source 1..39: mol_type = genomic DNA

SEQ ID NO: 102378 - DNA, 616 bp, Homo sapiens; identical to SEQ ID NO: 69225
  misc_feature 1..616: note = chr1:29138528-29139144
  misc_feature 1..616: note = Hyper
  source 1..616: mol_type = genomic DNA

SEQ ID NO: 102379 - DNA, 30 bp, Homo sapiens; identical to SEQ ID NO: 69228
  misc_feature 1..30: note = chr1:29205490-29205520
  misc_feature 1..30: note = Hypo
  source 1..30: mol_type = genomic DNA

SEQ ID NO: 102380 - DNA, 395 bp, Homo sapiens; identical to SEQ ID NO: 69230
  misc_feature 1..395: note = chr1:29448515-29448910
  misc_feature 1..395: note = Hyper
  source 1..395: mol_type = genomic DNA

SEQ ID NO: 102381 - DNA, 139 bp, Homo sapiens; identical to SEQ ID NO: 69231
  misc_feature 1..139: note = chr1:29449756-29449895
  misc_feature 1..139: note = Hyper
  source 1..139: mol_type = genomic DNA

SEQ ID NO: 102382 - DNA, 333 bp, Homo sapiens; identical to SEQ ID NO: 69232
  misc_feature 1..333: note = chr1:29450241-29450574
  misc_feature 1..333: note = Hyper
  source 1..333: mol_type = genomic DNA

SEQ ID NO: 102383 - DNA, 223 bp, Homo sapiens; identical to SEQ ID NO: 69233
  misc_feature 1..223: note = chr1:29462383-29462606
  misc_feature 1..223: note = Hypo
  source 1..223: mol_type = genomic DNA

SEQ ID NO: 102384 - DNA, 32 bp, Homo sapiens; identical to SEQ ID NO: 69234
  misc_feature 1..32: note = chr1:29463290-29463322
  misc_feature 1..32: note = Hypo
  source 1..32: mol_type = genomic DNA

SEQ ID NO: 102385 - DNA, 42 bp, Homo sapiens; identical to SEQ ID NO: 69235
  misc_feature 1..42: note = chr1:29463615-29463657
  misc_feature 1..42: note = Hypo
  source 1..42: mol_type = genomic DNA

SEQ ID NO: 102386 - DNA, 45 bp, Homo sapiens; identical to SEQ ID NO: 69236
  misc_feature 1..45: note = chr1:29516592-29516637
  misc_feature 1..45: note = Hypo
  source 1..45: mol_type = genomic DNA

SEQ ID NO: 102387 - DNA, 36 bp, Homo sapiens; identical to SEQ ID NO: 69237
  misc_feature 1..36: note = chr1:29564766-29564802
  misc_feature 1..36: note = Hyper
  source 1..36: mol_type = genomic DNA

SEQ ID NO: 102388 - DNA, 863 bp, Homo sapiens; identical to SEQ ID NO: 69238
  misc_feature 1..863: note = chr1:29586000-29586863
  misc_feature 1..863: note = Hyper
  source 1..863: mol_type = genomic DNA

SEQ ID NO: 102389 - DNA, 38 bp, Homo sapiens; identical to SEQ ID NO: 69239
  misc_feature 1..38: note = chr1:29785074-29785112
  misc_feature 1..38: note = Hypo
  source 1..38: mol_type = genomic DNA

SEQ ID NO: 102390 - DNA, 616 bp, Homo sapiens; identical to SEQ ID NO: 69240
  misc_feature 1..616: note = chr1:29804767-29805383
  misc_feature 1..616: note = Hyper
  source 1..616: mol_type = genomic DNA

SEQ ID NO: 102391 - DNA, 188 bp, Homo sapiens; identical to SEQ ID NO: 38915
  misc_feature 1..188: note = chr1:30351554-30351742
  misc_feature 1..188: note = Hypo
  source 1..188: mol_type = genomic DNA

SEQ ID NO: 102392 - DNA, 215 bp, Homo sapiens; identical to SEQ ID NO: 69255
  misc_feature 1..215: note = chr1:30558965-30559180
  misc_feature 1..215: note = Hyper
  source 1..215: mol_type = genomic DNA

SEQ ID NO: 102393 - DNA, 45 bp, Homo sapiens; identical to SEQ ID NO: 69258
  misc_feature 1..45: note = chr1:30723094-30723139
  misc_feature 1..45: note = Hypo
  source 1..45: mol_type = genomic DNA

SEQ ID NO: 102394 - DNA, 430 bp, Homo sapiens
  misc_feature 1..430: note = chr1:30815412-30815842
  misc_feature 1..430: note = Hyper
  source 1..430: mol_type = genomic DNA
taaaacgggcgctggcgacagcagcgcaggctggttaagctgcggcaggtccttgcagaggaggggctcttcccaggagggcgctccagccgaggcccctctgccttcacctgcgccatgaccacttccctcggccctctcccctcctccacgcctcctggggccgctctccagggtcctgggacgagaccagccccgggcagggcagcgcggggagccaggggtcccacacccaggagggcccctcaccgcaagggacgggcttaggcggataaatgtccggctcccctcgaggggcagagtcagcaccccccacacggtccctgagatggccctgggaccgagccgccgcccccgacttgtgattcagcctcttcctgcctggctttcccctccccactgtgcctcctgggatcgcctcccaaatcag

SEQ ID NO: 102395 - DNA, 232 bp, Homo sapiens; identical to SEQ ID NO: 69267
  misc_feature 1..232: note = chr1:31157994-31158226
  misc_feature 1..232: note = Hyper
  source 1..232: mol_type = genomic DNA

SEQ ID NO: 102396 - DNA, 181 bp, Homo sapiens; identical to SEQ ID NO: 69268
  misc_feature 1..181: note = chr1:31208071-31208252
  misc_feature 1..181: note = Hypo
  source 1..181: mol_type = genomic DNA

SEQ ID NO: 102397 - DNA, 33 bp, Homo sapiens; identical to SEQ ID NO: 69269
  misc_feature 1..33: note = chr1:31249862-31249895
  misc_feature 1..33: note = Hypo
  source 1..33: mol_type = genomic DNA

SEQ ID NO: 102398 - DNA, 30 bp, Homo sapiens; identical to SEQ ID NO: 69272
  misc_feature 1..30: note = chr1:31439991-31440021
  misc_feature 1..30: note = Hypo
  source 1..30: mol_type = genomic DNA

SEQ ID NO: 102399 - DNA, 52 bp, Homo sapiens; identical to SEQ ID NO: 69274
  misc_feature 1..52: note = chr1:31481385-31481437
  misc_feature 1..52: note = Hypo
  source 1..52: mol_type = genomic DNA

SEQ ID NO: 102400 - DNA, 18 bp, Homo sapiens
  misc_feature 1..18: note = chr1:31498805-31498823
  misc_feature 1..18: note = Hypo
  source 1..18: mol_type = genomic DNA
aagcttatcttccaccgg

SEQ ID NO: 102401 - DNA, 48 bp, Homo sapiens; identical to SEQ ID NO: 69277
  misc_feature 1..48: note = chr1:31712619-31712667
  misc_feature 1..48: note = Hyper
  source 1..48: mol_type = genomic DNA

SEQ ID NO: 102402 - DNA, 30 bp, Homo sapiens; identical to SEQ ID NO: 69282
  misc_feature 1..30: note = chr1:31846047-31846077
  misc_feature 1..30: note = Hyper
  source 1..30: mol_type = genomic DNA

SEQ ID NO: 102403 - DNA, 356 bp, Homo sapiens; identical to SEQ ID NO: 69284
  misc_feature 1..356: note = chr1:31846296-31846652
  misc_feature 1..356: note = Hyper
  source 1..356: mol_type = genomic DNA

SEQ ID NO: 102404 - DNA, 30 bp, Homo sapiens; identical to SEQ ID NO: 69285
  misc_feature 1..30: note = chr1:31863025-31863055
  misc_feature 1..30: note = Hypo
  source 1..30: mol_type = genomic DNA

SEQ ID NO: 102405 - DNA, 30 bp, Homo sapiens; identical to SEQ ID NO: 69286
  misc_feature 1..30: note = chr1:32098396-32098426
  misc_feature 1..30: note = Hypo
  source 1..30: mol_type = genomic DNA

SEQ ID NO: 102406 - DNA, 433 bp, Homo sapiens; identical to SEQ ID NO: 69289
  misc_feature 1..433: note = chr1:32179994-32180427
  misc_feature 1..433: note = Hyper
  source 1..433: mol_type = genomic DNA

SEQ ID NO: 102407 - DNA, 806 bp, Homo sapiens
  misc_feature 1..806: note = chr1:32180688-32181494
  misc_feature 1..806: note = Hyper
  source 1..806: mol_type = genomic DNA
gagcctcccgatggtcgctgtgtctgcccattggaccaggggccagggcgggcggggctttgggcgacagaactggctagggtgggagaggagaggaagctgccaggttctggggatcccgaccccaccccgccgacagccacgcctccagcccactctggccacgccactggtctgcctttggaccacactcatggccgggtgccttccctgactccgccctaggccctgcctcctatctggctccgcccagccctggccaaccttagaacctgtcccaaggtccagagaggcctagatgaggggtagcctgcctctgagaggcatggagccctcctcccgcgtggggtcagggaatagaagggcgtcgagggtggcgggtgagggaacgttcctggcgccgcgaacgggaagcctccaggctgcaggacgtagctgcggggacccggcagtctgcgaggctggagtggccgaggccgccccgagcatagaaacagccctgtatacgtgggcacagaaaggcccagggaggcgcctgggcagaagtgtctaggacgatgcctctgccacggagccctggagtgggggcagctgatggctcaagacacatgagctctggtggcgagtacagggacgcggggtttggggaggcccaagtcaaggtccatccttctgggatgaggggcggaggatgggaggcggagcccggtctccagggcaccagccctccacctagcgggaagcttgggaatcgcggagtgcagaggtggggtgcggaaagggttccaccgcgcctgggctccttt

SEQ ID NO: 102408 - DNA, 190 bp, Homo sapiens
  misc_feature 1..190: note = chr1:32226201-32226391
  misc_feature 1..190: note = Hyper
  source 1..190: mol_type = genomic DNA
ggccgggggaaggggcgcggcgacgcgcacatccgtcgcgtttatccacctggcagctccaattcgcccgcccgtcactcaccctccgcctccccggcgctcgccgcccgacctgcccaggccgccacgcaggcggtgacccccactcggtggctttgggtcctctgccagcgctcggacccaaggacag

SEQ ID NO: 102409 - DNA, 1195 bp, Homo sapiens
  misc_feature 1..1195: note = chr1:32237521-32238716
  misc_feature 1..1195: note = Hyper
  source 1..1195: mol_type = genomic DNA
cacaaagggccccaccgccggaagccgcccgcgctcccacaccttgtgcaggtctcccctgaaatgaattttaatttccgctgagggcaggcggcgtcgtgagtcctgagcccgtggcggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctgagggcttgggggcagctcatcagtcttccgcaatgggcctgct

SEQ ID NO: 102410 - DNA, 458 bp, Homo sapiens
  misc_feature 1..458: note = chr1:32410234-32410692
  misc_feature 1..458: note = Hyper
  source 1..458: mol_type = genomic DNA
ctagagcttcccctgcgtccgcctttgggggaggggagggagtgaagctgtgaattccgggagaagtcaagggtcgctcggggcgtgggtccgcgcgcggaggggctcgctgtcccggtgccagcgggagctggaaagcttcggctggggcctgagtggacgggaaggcggcggcctccgcgggatccttcccggggccgatccacagtcaggatccccagctccaccgccatcaagtgggactggagttcggccagagaagaaaacgacttcgggaactggcaacgagggagagggaaaagttgagaaacgtgactcagcctctttagttcatctttcacgtggggcagcggaggcctggcggggacggggagccgctcggggactgcaggcccgtaggtcgctccctatccgtgagggattggttggttccaggacacctgcggatcccaaaatct

SEQ ID NO: 102411 - DNA, 70 bp, Homo sapiens; identical to SEQ ID NO: 69299
  misc_feature 1..70: note = chr1:32705509-32705579
  misc_feature 1..70: note = Hypo
  source 1..70: mol_type = genomic DNA

SEQ ID NO: 102412 - DNA, 84 bp, Homo sapiens; identical to SEQ ID NO: 69300
  misc_feature 1..84: note = chr1:32741460-32741544
  misc_feature 1..84: note = Hypo
  source 1..84: mol_type = genomic DNA

SEQ ID NO: 102413 - DNA, 21 bp, Homo sapiens
  misc_feature 1..21: note = chr1:32756498-32756519
  misc_feature 1..21: note = Hypo
  source 1..21: mol_type = genomic DNA
cctgccctcctaggccgggcg

SEQ ID NO: 102414 - DNA, 125 bp, Homo sapiens
  misc_feature 1..125: note = chr1:32827740-32827865
  misc_feature 1..125: note = Hyper
  source 1..125: mol_type = genomic DNA
ctggagaacccccaacggtgccccctgccgcccctggcactcagcgcgggccagaatcggggactggaggcctctggccatggcgcctggagacggggtcgcgcagaccccggacacccgagggg

SEQ ID NO: 102415 - DNA, 30 bp, Homo sapiens; identical to SEQ ID NO: 69304
  misc_feature 1..30: note = chr1:32829362-32829392
  misc_feature 1..30: note = Hypo
  source 1..30: mol_type = genomic DNA

SEQ ID NO: 102416 - DNA, 18 bp, Homo sapiens
  misc_feature 1..18: note = chr1:32918164-32918182
  misc_feature 1..18: note = Hypo
  source 1..18: mol_type = genomic DNA
aaaactatgtctaggcgg

SEQ ID NO: 102417 - DNA, 30 bp, Homo sapiens; identical to SEQ ID NO: 69306
  misc_feature 1..30: note = chr1:32930129-32930159
  misc_feature 1..30: note = Hyper
  source 1..30: mol_type = genomic DNA

SEQ ID NO: 102418 - DNA, 408 bp, Homo sapiens; identical to SEQ ID NO: 26170
  misc_feature 1..408: note = chr1:32930619-32931027
  misc_feature 1..408: note = Hyper
  source 1..408: mol_type = genomic DNA

SEQ ID NO: 102419 - DNA, 74 bp, Homo sapiens; identical to SEQ ID NO: 69313
  misc_feature 1..74: note = chr1:33220942-33221016
  misc_feature 1..74: note = Hypo
  source 1..74: mol_type = genomic DNA

SEQ ID NO: 102420 - DNA, 130 bp, Homo sapiens; identical to SEQ ID NO: 69320
  misc_feature 1..130: note = chr1:33336741-33336871
  misc_feature 1..130: note = Hyper
  source 1..130: mol_type = genomic DNA

SEQ ID NO: 102421 - DNA, 121 bp, Homo sapiens; identical to SEQ ID NO: 69321
  misc_feature 1..121: note = chr1:33351599-33351720
  misc_feature 1..121: note = Hyper
  source 1..121: mol_type = genomic DNA

SEQ ID NO: 102422 - DNA, 379 bp, Homo sapiens
  misc_feature 1..379: note = chr1:33352075-33352454
  misc_feature 1..379: note = Hyper
  source 1..379: mol_type = genomic DNA
gcgccgccttccctgcgcagtcggtgtctccgcgtcgctgggtgagtgggggcagctccagccggggccgggggatgagggcagggggttcccggagctgggggcccacgtccagggcttcccaacaccgccgctcccgggcttcccgggaatccttgccccgggtggcgggggcgctggggactgggaagcgcgcggtgctctccagggtcctgaccgccgagtggccggcccctaggaaccgcgttcgaccgccctggagcgccccctccaggaggggccacgcgccgggcgctgtcctagtgctgagcggatggaggcgggggctgggggacagagctgagggaggtttggagcgggtccccggggctggcttctc

SEQ ID NO: 102423 - DNA, 435 bp, Homo sapiens; identical to SEQ ID NO: 69325
  misc_feature 1..435: note = chr1:33358628-33359063
  misc_feature 1..435: note = Hyper
  source 1..435: mol_type = genomic DNA

SEQ ID NO: 102424 - DNA, 75 bp, Homo sapiens; identical to SEQ ID NO: 26173
  misc_feature 1..75: note = chr1:33390730-33390805
  misc_feature 1..75: note = Hyper
  source 1..75: mol_type = genomic DNA

SEQ ID NO: 102425 - DNA, 19 bp, Homo sapiens
  misc_feature 1..19: note = chr1:33425641-33425660
  misc_feature 1..19: note = Hypo
  source 1..19: mol_type = genomic DNA
actccgtctcaaaaaaaaa

SEQ ID NO: 102426 - DNA, 421 bp, Homo sapiens; identical to SEQ ID NO: 69329
  misc_feature 1..421: note = chr1:33438500-33438921
  misc_feature 1..421: note = Hyper
  source 1..421: mol_type = genomic DNA

SEQ ID NO: 102427 - DNA, 149 bp, Homo sapiens; identical to SEQ ID NO: 38921
  misc_feature 1..149: note = chr1:33441493-33441642
  misc_feature 1..149: note = Hypo
  source 1..149: mol_type = genomic DNA

SEQ ID NO: 102428 - DNA, 143 bp, Homo sapiens; identical to SEQ ID NO: 14223
  misc_feature 1..143: note = chr1:33473115-33473258
  misc_feature 1..143: note = Hypo
  source 1..143: mol_type = genomic DNA

SEQ ID NO: 102429 - DNA, 77 bp, Homo sapiens; identical to SEQ ID NO: 69335
  misc_feature 1..77: note = chr1:33631065-33631142
  misc_feature 1..77: note = Hypo
  source 1..77: mol_type = genomic DNA

SEQ ID NO: 102430 - DNA, 316 bp, Homo sapiens
  misc_feature 1..316: note = chr1:33772299-33772615
  misc_feature 1..316: note = Hyper
  source 1..316: mol_type = genomic DNA
gagcgggagtgaggccgggccggctgggccggcggagaagccggagggccgggaaccggcggcggcgctagttccgcagcagccggtaccccttgggcgcccacagcagtcgcgggcggcggatctcggcccgcgggccgatgtccgggctccagcagaactcgggcgacagcaccttggcgggcttgtgcagccagaagaacttgttgaggtggctctcgtcgtgccagcgcgcctccaggccgcgcgcgcggtcccagtccaggccccccgcacagtgcgccgtcagcccgcgcagcgccgccacgctgccccc

SEQ ID NO: 102431 - DNA, 38 bp, Homo sapiens; identical to SEQ ID NO: 69338
  misc_feature 1..38: note = chr1:33772904-33772942
  misc_feature 1..38: note = Hyper
  source 1..38: mol_type = genomic DNA

SEQ ID NO: 102432 - DNA, 32 bp, Homo sapiens; identical to SEQ ID NO: 38924
  misc_feature 1..32: note = chr1:33798865-33798897
  misc_feature 1..32: note = Hypo
  source 1..32: mol_type = genomic DNA

SEQ ID NO: 102433 - DNA, 118 bp, Homo sapiens; identical to SEQ ID NO: 69340
  misc_feature 1..118: note = chr1:33896068-33896186
  misc_feature 1..118: note = Hyper
  source 1..118: mol_type = genomic DNA

SEQ ID NO: 102434 - DNA, 30 bp, Homo sapiens; identical to SEQ ID NO: 38925
  misc_feature 1..30: note = chr1:33981589-33981619
  misc_feature 1..30: note = Hypo
  source 1..30: mol_type = genomic DNA

SEQ ID NO: 102435 - DNA, 48 bp, Homo sapiens; identical to SEQ ID NO: 69342
  misc_feature 1..48: note = chr1:33985077-33985125
  misc_feature 1..48: note = Hypo
  source 1..48: mol_type = genomic DNA

SEQ ID NO: 102436 - DNA, 41 bp, Homo sapiens; identical to SEQ ID NO: 69345
  misc_feature 1..41: note = chr1:34090896-34090937
  misc_feature 1..41: note = Hypo
  source 1..41: mol_type = genomic DNA

SEQ ID NO: 102437 - DNA, 34 bp, Homo sapiens; identical to SEQ ID NO: 69346
  misc_feature 1..34: note = chr1:34100658-34100692
  misc_feature 1..34: note = Hyper
  source 1..34: mol_type = genomic DNA

SEQ ID NO: 102438 - DNA, 30 bp, Homo sapiens; identical to SEQ ID NO: 69348
  misc_feature 1..30: note = chr1:34115492-34115522
  misc_feature 1..30: note = Hypo
  source 1..30: mol_type = genomic DNA

SEQ ID NO: 102439 - DNA, 28 bp, Homo sapiens
  misc_feature 1..28: note = chr1:34130113-34130141
  misc_feature 1..28: note = Hypo
  source 1..28: mol_type = genomic DNA
attttaggccaggagcggtggctcatgc

SEQ ID NO: 102440 - DNA, 89 bp, Homo sapiens; identical to SEQ ID NO: 69352
  misc_feature 1..89: note = chr1:34180223-34180312
  misc_feature 1..89: note = Hypo
  source 1..89: mol_type = genomic DNA

SEQ ID NO: 102441 - DNA, 22 bp, Homo sapiens
  misc_feature 1..22: note = chr1:34558017-34558039
  misc_feature 1..22: note = Hypo
  source 1..22: mol_type = genomic DNA
aataggaacagctcccgtccac

SEQ ID NO: 102442 - DNA, 1323 bp, Homo sapiens; identical to SEQ ID NO: 26177
  misc_feature 1..1323: note = chr1:34628590-34629913
  misc_feature 1..1323: note = Hyper
  source 1..1323: mol_type = genomic DNA

SEQ ID NO: 102443 - DNA, 920 bp, Homo sapiens; identical to SEQ ID NO: 69360
  misc_feature 1..920: note = chr1:34630137-34631057
  misc_feature 1..920: note = Hyper
  source 1..920: mol_type = genomic DNA

SEQ ID NO: 102444 - DNA, 375 bp, Homo sapiens; identical to SEQ ID NO: 69361
  misc_feature 1..375: note = chr1:34631434-34631809
  misc_feature 1..375: note = Hyper
  source 1..375: mol_type = genomic DNA

SEQ ID NO: 102445 - DNA, 500 bp, Homo sapiens
  misc_feature 1..500: note = chr1:34632102-34632602
  misc_feature 1..500: note = Hyper
  source 1..500: mol_type = genomic DNA
ctgatttggccaaaacggagcgttggcatctgtgtggccaagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcccggtggccctgggcgggcgaatctcctcagaatcgcgggcctggtccccacccccaacacgcttgtatgcccgcccctcccgacgccgccttgctgggtgc

SEQ ID NO: 102446 - DNA, 771 bp, Homo sapiens
  misc_feature 1..771: note = chr1:34642367-34643138
  misc_feature 1..771: note = Hyper
  source 1..771: mol_type = genomic DNA
gagatttgtgtggagcggcgaagtggggcggcggcgcgtttggctttgacttctgatcccccgaagcgctctggggtcctttgggccccacccccacccaccccaccggcgggtcttgggctccgaacccagggcgccccgcgcaccgagccgttgcgtttgaaacccacagaaagaattcccccgctcgacgacggcgagggtgtgggagctactggcaggcaaattggtgggagccgcccggcccagcctgccttgccgagtcagcgcgctcttgagccgctgggcccttcccggtgcccgcctggcagcgcggcgcggctggggcaggggtctgctgggggccggggactaagggctgtgggcccatccacacacgcctcatcccttctttccgggggcagcagagcagcagcgggagaccgggagcaggaggggtagggcgagagaaaagcaggacctgggccgggggtgggagtcgggccgttgacgctcgctctgcgaggggctccctgggaacgcccaggcgagcgcctcctgcggggccccgccccccgagtgcctacaatggtgccaggcccgcacccagtcctccgcgtggcttagcgggacagcatgggctgagcccaggcgccgaaagttgtcacggcggcgtcgcaagggggcagtgccagggactgtggggagagccagccctccccttccagctgttcccagatgtcattctgcccgcccaggcgcctggttcctgagctccgcagcattccactg

SEQ ID NO: 102447 - DNA, 27 bp, Homo sapiens
  misc_feature 1..27: note = chr1:34979405-34979432
  misc_feature 1..27: note = Hypo
  source 1..27: mol_type = genomic DNA
aagaagagggctgggcgcagtggctca

SEQ ID NO: 102448 - DNA, 296 bp, Homo sapiens; identical to SEQ ID NO: 69370
  misc_feature 1..296: note = chr1:35246877-35247173
  misc_feature 1..296: note = Hyper
  source 1..296: mol_type = genomic DNA

SEQ ID NO: 102449 - DNA, 391 bp, Homo sapiens; identical to SEQ ID NO: 69371
  misc_feature 1..391: note = chr1:35258480-35258871
  misc_feature 1..391: note = Hyper
  source 1..391: mol_type = genomic DNA

SEQ ID NO: 102450 - DNA, 876 bp, Homo sapiens; identical to SEQ ID NO: 69375
  misc_feature 1..876: note = chr1:35350991-35351867
  misc_feature 1..876: note = Hyper
  source 1..876: mol_type = genomic DNA

SEQ ID NO: 102451 - DNA, 128 bp, Homo sapiens; identical to SEQ ID NO: 69376
  misc_feature 1..128: note = chr1:35369947-35370075
  misc_feature 1..128: note = Hypo
  source 1..128: mol_type = genomic DNA

SEQ ID NO: 102452 - DNA, 108 bp, Homo sapiens; identical to SEQ ID NO: 69377
  misc_feature 1..108: note = chr1:35390565-35390673
  misc_feature 1..108: note = Hyper
  source 1..108: mol_type = genomic DNA

SEQ ID NO: 102453 - DNA, 176 bp, Homo sapiens; identical to SEQ ID NO: 69378
  misc_feature 1..176: note = chr1:35394614-35394790
  misc_feature 1..176: note = Hyper
  source 1..176: mol_type = genomic DNA

SEQ ID NO: 102454 - DNA, 1089 bp, Homo sapiens
  misc_feature 1..1089: note = chr1:35395042-35396131
  misc_feature 1..1089: note = Hyper
  source 1..1089: mol_type = genomic DNA
gcggcttacctggcccggctcgggctccggccgggttacatggtgccggcggcccgggccgggggcgctgcggcgttgggcaggcgggcagggaccggggcccggcactgcggagcccccagctgaggggccgcgccggctgcggagccccaagcgagcgccgagcggcagcgggcgcgggagcgggaggcggccaagccacggaggctggatttcccggggaccgggaaggggaggcggggggatcccgcccgcgcgctccgcccccgcccccgcccccgcgcagggcagccgagcagggagagggagagggagaggaagagggagggggaccgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacccaggaacaggcacccgaagtgtcacggccacgcacagccgacctgggtacagggacccaagcccggcggcgggcgggcggtcggggaccagctcagcctcacggaccgggtctcgccccccgccgaggggcagtcacgccctgaatgtcacacacagcccccaggcccgtccgcttaggagactctccttcgggctttcccggtcggccgcctgacctcagctcctggcttggggtcagggagcccccctcttcggccccagcccctgccaggatggggcgctgtgcccggcctcggagccgctggcaggcgtcccccacccacagtccgcacagccgaggcatccccagtgtggagggagagccccgctgtacctgccgcctgtgctgggcccccgcccgtgcccactgtgcccgcccgcctctgggccctgagcctgggattgtgccatggcggggtcggggtggggggaaagggactgtccgaagcacagctggaggctgcggagcccggacacaggctgcgggagccgagaggcggagagcggactgcagcagtcccctggcttgaatccgtcttggcgcccagagcgatgctgtaatggg

SEQ ID NO: 102455 - DNA, 23 bp, Homo sapiens
  misc_feature 1..23: note = chr1:35660562-35660585
  misc_feature 1..23: note = Hypo
  source 1..23: mol_type = genomic DNA
aggcgggaccgggtgcggtggct

SEQ ID NO: 102456 - DNA, 136 bp, Homo sapiens; identical to SEQ ID NO: 38930
  misc_feature 1..136: note = chr1:35664720-35664856
  misc_feature 1..136: note = Hypo
  source 1..136: mol_type = genomic DNA

SEQ ID NO: 102457 - DNA, 1240 bp, Homo sapiens; identical to SEQ ID NO: 69392
  misc_feature 1..1240: note = chr1:36042478-36043718
  misc_feature 1..1240: note = Hyper
  source 1..1240: mol_type = genomic DNA

SEQ ID NO: 102458 - DNA, 139 bp, Homo sapiens; identical to SEQ ID NO: 69393
  misc_feature 1..139: note = chr1:36056226-36056365
  misc_feature 1..139: note = Hypo
  source 1..139: mol_type = genomic DNA

SEQ ID NO: 102459 - DNA, 41 bp, Homo sapiens; identical to SEQ ID NO: 69396
  misc_feature 1..41: note = chr1:36173241-36173282
  misc_feature 1..41: note = Hyper
  source 1..41: mol_type = genomic DNA

SEQ ID NO: 102460 - DNA, 237 bp, Homo sapiens; identical to SEQ ID NO: 69397
  misc_feature 1..237: note = chr1:36173696-36173933
  misc_feature 1..237: note = Hyper
  source 1..237: mol_type = genomic DNA

SEQ ID NO: 102461 - DNA, 120 bp, Homo sapiens; identical to SEQ ID NO: 69398
  misc_feature 1..120: note = chr1:36271443-36271563
  misc_feature 1..120: note = Hypo
  source 1..120: mol_type = genomic DNA

SEQ ID NO: 102462 - DNA, 105 bp, Homo sapiens; identical to SEQ ID NO: 69399
  misc_feature 1..105: note = chr1:36334781-36334886
  misc_feature 1..105: note = Hypo
  source 1..105: mol_type = genomic DNA

SEQ ID NO: 102463 - DNA, 167 bp, Homo sapiens; identical to SEQ ID NO: 69401
  misc_feature 1..167: note = chr1:36549703-36549870
  misc_feature 1..167: note = Hyper
  source 1..167: mol_type = genomic DNA

SEQ ID NO: 102464 - DNA, 252 bp, Homo sapiens; identical to SEQ ID NO: 38933
  misc_feature 1..252: note = chr1:36563342-36563594
  misc_feature 1..252: note = Hypo
  source 1..252: mol_type = genomic DNA

SEQ ID NO: 102465 - DNA, 47 bp, Homo sapiens; identical to SEQ ID NO: 69403
  misc_feature 1..47: note = chr1:36591033-36591080
  misc_feature 1..47: note = Hyper
  source 1..47: mol_type = genomic DNA

SEQ ID NO: 102466 - DNA, 30 bp, Homo sapiens; identical to SEQ ID NO: 69410
  misc_feature 1..30: note = chr1:36666375-36666405
  misc_feature 1..30: note = Hypo
  source 1..30: mol_type = genomic DNA

SEQ ID NO: 102467 - DNA, 22 bp, Homo sapiens
  misc_feature 1..22: note = chr1:36736011-36736033
  misc_feature 1..22: note = Hypo
  source 1..22: mol_type = genomic DNA
aggcacacgcacacgcacgcat

SEQ ID NO: 102468 - DNA, 88 bp, Homo sapiens; identical to SEQ ID NO: 69413
  misc_feature 1..88: note = chr1:36762204-36762292
  misc_feature 1..88: note = Hypo
  source 1..88: mol_type = genomic DNA

SEQ ID NO: 102469 - DNA, 94 bp, Homo sapiens; identical to SEQ ID NO: 69415
  misc_feature 1..94: note = chr1:36789434-36789528
  misc_feature 1..94: note = Hyper
  source 1..94: mol_type = genomic DNA

SEQ ID NO: 102470 - DNA, 20 bp, Homo sapiens
  misc_feature 1..20: note = chr1:36966967-36966987
  misc_feature 1..20: note = Hypo
  source 1..20: mol_type = genomic DNA
ctggccgattagcactgttt

SEQ ID NO: 102471 - DNA, 180 bp, Homo sapiens; identical to SEQ ID NO: 38934
  misc_feature 1..180: note = chr1:37148125-37148305
  misc_feature 1..180: note = Hypo
  source 1..180: mol_type = genomic DNA

SEQ ID NO: 102472 - DNA, 30 bp, Homo sapiens; identical to SEQ ID NO: 38935
  misc_feature 1..30: note = chr1:37227648-37227678
  misc_feature 1..30: note = Hypo
  source 1..30: mol_type = genomic DNA

SEQ ID NO: 102473 - DNA, 2670 bp, Homo sapiens
  misc_feature 1..2670: note = chr1:37498362-37501032
  misc_feature 1..2670: note = Hyper
  source 1..2670: mol_type = genomic DNA
gtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggctcgcctggtgccaggcgctggtgctggcgccgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgccgccagctgcggaggaattcgggctaactttaaaaaccgctggcgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactccggaggcgccgccagggagcggtcatcgttgggcgccgccgagcgtgcccggggcgcggccgtggcgggctccctggggcggcagctctaggcgcgggcgcgcagcagccccgaaggcgccgcctggcccagccgcccggctcccgagcgccgctgcaagtggggggcgccccgcggcgccgcgcacatcttactggggggccgccccgccggcgcccgccccgcctggctgccgcccacgggctgcccgcgagcgaggctcctgggctccgcccggactccgctcggactcggctccggctccgactcgcgtcggctcggctcccgcgcgggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagcgcgagagctggcaccgcgagctgggagacggcggcagcccagcggccggaccagctggaggagacgcgcccgccgggagcagcgagaccgggagcccgccgtctgcggagcctggcctcgcggctcccacgcggcgggcgctggctggacggcggtggcagcgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtaggatccgtgggggagcaagctaaaggggttaaaaagaaaaacaacgttgtttattagca

SEQ ID NO: 102474 - DNA, 30 bp, Homo sapiens; identical to SEQ ID NO: 69432
  misc_feature 1..30: note = chr1:37501855-37501885
  misc_feature 1..30: note = Hyper
  source 1..30: mol_type = genomic DNA

SEQ ID NO: 102475 - DNA, 192 bp, Homo sapiens; identical to SEQ ID NO: 69433
  misc_feature 1..192: note = chr1:37549296-37549488
  misc_feature 1..192: note = Hypo
  source 1..192: mol_type = genomic DNA

SEQ ID NO: 102476 - DNA, 107 bp, Homo sapiens; identical to SEQ ID NO: 69434
  misc_feature 1..107: note = chr1:37721088-37721195
  misc_feature 1..107: note = Hyper
  source 1..107: mol_type = genomic DNA

SEQ ID NO: 102477 - DNA, 26 bp, Homo sapiens
  misc_feature 1..26: note = chr1:37899676-37899702
  misc_feature 1..26: note = Hypo
  source 1..26: mol_type = genomic DNA
gcgtgagacaccgcacctggccaggg

SEQ ID NO: 102478 - DNA, 30 bp, Homo sapiens; identical to SEQ ID NO: 69437
  misc_feature 1..30: note = chr1:38099986-38100016
  misc_feature 1..30: note = Hyper
  source 1..30: mol_type = genomic DNA

SEQ ID NO: 102479 - DNA, 30 bp, Homo sapiens; identical to SEQ ID NO: 69438
  misc_feature 1..30: note = chr1:38100242-38100272
  misc_feature 1..30: note = Hyper
  source 1..30: mol_type = genomic DNA

SEQ ID NO: 102480 - DNA, 33 bp, Homo sapiens; identical to SEQ ID NO: 26198
  misc_feature 1..33: note = chr1:38100650-38100683
  misc_feature 1..33: note = Hyper
  source 1..33: mol_type = genomic DNA

SEQ ID NO: 102481 - DNA, 30 bp, Homo sapiens; identical to SEQ ID NO: 38936
  misc_feature 1..30: note = chr1:38207058-38207088
  misc_feature 1..30: note = Hypo
  source 1..30: mol_type = genomic DNA

SEQ ID NO: 102482 - DNA, 481 bp, Homo sapiens; identical to SEQ ID NO: 69441
  misc_feature 1..481: note = chr1:38219523-38220004
  misc_feature 1..481: note = Hyper
  source 1..481: mol_type = genomic DNA

SEQ ID NO: 102483 - DNA, 963 bp, Homo sapiens
  misc_feature 1..963: note = chr1:38229885-38230848
  misc_feature 1..963: note = Hyper
  source 1..963: mol_type = genomic DNA
caactgacagcacatcggaatcgcgaactggaaggcatcagccatccagggcccagaccaaccccgcggtcaacgcctcagattccagctcctccggattctgcacctagatatgacgcctctggattcaactgagcgtatagctcccctaaatgcacaatcagaggcaagacgcgggctccagtatcgccgacagcctcaaacccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtccgggctccatcccgtctccccatattccgagctcacctccgcatctccctgtctccactcttcatctccccgcccccgcacctcccacctccaatcactcagcttgtccgtctcaccggccgctggaccgccgcctctggctcccgcggttcctggcctctttctttcccaacctcccgggtctccagcccccaagctcctcagcgcccctctcttcgctactgcttgatcacatttttctctgtctctccagttctttgctgcctgcttgcttcaagccccaatacagactctagtctctccaatgactccttcccccagaacccccatcgccagccccctatcttttggtatgccacgctccgagcagagctcaccagtcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagccgcgccagcctagcaccgctgagcaatgcccccagaccccagagccagcggggggcggagtctcaccgct

SEQ ID NO: 102484 - DNA, 99 bp, Homo sapiens; identical to SEQ ID NO: 69444
  misc_feature 1..99: note = chr1:38342587-38342686
  misc_feature 1..99: note = Hypo
  source 1..99: mol_type = genomic DNA

SEQ ID NO: 102485 - DNA, 87 bp, Homo sapiens; identical to SEQ ID NO: 38937
  misc_feature 1..87: note = chr1:38398355-38398442
  misc_feature 1..87: note = Hypo
  source 1..87: mol_type = genomic DNA

SEQ ID NO: 102486 - DNA, 85 bp, Homo sapiens; identical to SEQ ID NO: 69446
  misc_feature 1..85: note = chr1:38456465-38456550
  misc_feature 1..85: note = Hypo
  source 1..85: mol_type = genomic DNA

SEQ ID NO: 102487 - DNA, 36 bp, Homo sapiens; identical to SEQ ID NO: 69447
  misc_feature 1..36: note = chr1:38493396-38493432
  misc_feature 1..36: note = Hypo
  source 1..36: mol_type = genomic DNA

SEQ ID NO: 102488 - DNA, 2421 bp, Homo sapiens
  misc_feature 1..2421: note = chr1:38510058-38512479
  misc_feature 1..2421: note = Hyper
  source 1..2421: mol_type = genomic DNA
aacttttccaagtttcgtttggtgtggccaggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacactcgaattttttttgttagttttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatccggccccgaacagcccgggggggcaggggcgggggtcgtcgaggggatgggggcagagagcaggcggcgggcaggatgcccggggtgagttggcgagttccggatcttcgctcctctctcccggggctcgggcgacgcagcctaccgggctgtcttcgccgctcaccggagagggtcgtccgggtgtttggttttgttcgaaagtttctgggcttttttttttttttgtaaaatccaaagcaaccgaacaaaaagagtccaggccgcgcgggcgggctgcgcgcccgcgccctgcagcgcgccggcgggggcccggcccgcggggtcactgcactgagccgggcagtgtgtggtggtggtggtggtgcagcgccgccggcgggggcggtgggggcgcggagggtggcgatgcgccgcccccgccaggccctagctccccaggcgcgtatacatcgtccatgggcgggtggcccgcgccggccgcaggggtcatgcgcttctccttctgccgccggttgcagaaccagacgcgcaccacctccttctccagctgcaggctgtctgccaagccggtgatctcgtgcgccgagggcttggggcacttgagaaagtggctctcgagcgcgcctttgacccccacctcgatggacgtgcgcttcttgcgcttgcggccctgcgccgcgatcttgtccaggttggtggggctgccgctggacgagtcggtctcctccagccacttgttgagcagcggcttgagcttgcacatgttcttgaagctcagctgcagggcctcgaagcggcagatggtggtctgcgagaacacgttaccgtagagcgtgcccagcgccagccccacgtcggcctgcgtaaagcccagcttgatgcgccgctgcttgaactgcttggcgaactgctccaggtcgtccgagctgggcgcatcctcgtccgagtgctcgcccaccgatgagccgccgccgcccgcgcccgggtgcaggtgcgccgccgccgcgtgcaggccgcccgcgtgtgcatgtccgtgtgcgtgtccgtgggcgcccagatgcggcggcggcgacggctccagctgcgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggccggtgccgccgccgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcct

SEQ ID NO: 102489 - DNA, 90 bp, Homo sapiens; identical to SEQ ID NO: 69453
  misc_feature 1..90: note = chr1:38513064-38513154
  misc_feature 1..90: note = Hyper
  source 1..90: mol_type = genomic DNA

SEQ ID NO: 102490 - DNA, 111 bp, Homo sapiens; identical to SEQ ID NO: 69454
  misc_feature 1..111: note = chr1:38599710-38599821
  misc_feature 1..111: note = Hyper
  source 1..111: mol_type = genomic DNA

SEQ ID NO: 102491 - DNA, 30 bp, Homo sapiens; identical to SEQ ID NO: 69455
  misc_feature 1..30: note = chr1:38673189-38673219
  misc_feature 1..30: note = Hypo
  source 1..30: mol_type = genomic DNA

SEQ ID NO: 102492 - DNA, 88 bp, Homo sapiens; identical to SEQ ID NO: 69456
  misc_feature 1..88: note = chr1:38953066-38953154
  misc_feature 1..88: note = Hypo
  source 1..88: mol_type = genomic DNA

SEQ ID NO: 102493 - DNA, 43 bp, Homo sapiens
  misc_feature 1..43: note = chr1:39025476-39025519
  misc_feature 1..43: note = Hyper
  source 1..43: mol_type = genomic DNA
gtgggaagactggggcgagcgggcggggcggggcggggggcga

SEQ ID NO: 102494 - DNA, 422 bp, Homo sapiens
  misc_feature 1..422: note = chr1:39044044-39044466
  misc_feature 1..422: note = Hyper
  source 1..422: mol_type = genomic DNA
aacttaagaggggagcgcgcccaggatgggagcgagccagagaggagggggcggcggcggcgagagcgggcgggggacacggggaccgggagacgcgatccggagagcggtgggaagtattcgcctccgttcctcaaacacaggatgcgagcgccctttggagaagtcgcgctcggcggaaacgctaactccccggccaagtgcaaatgtaaagaggccctgagagcactttgtgcaaatatcaggccgggaagtgctgcgcccgcggagctgccgggcacctcggcgcccccgcgccctcggctgcgcgctaattcactttgccgtcacctctcgggcggggtcgggcgggcgcgggcagccggagcgcgcagagggcgcagagcgcctcgcagggccaggggccgcggccctgcctaatg

SEQ ID NO: 102495 - DNA, 30 bp, Homo sapiens; identical to SEQ ID NO: 69461
  misc_feature 1..30: note = chr1:39061965-39061995
  misc_feature 1..30: note = Hypo
  source 1..30: mol_type = genomic DNA

SEQ ID NO: 102496 - DNA, 151 bp, Homo sapiens; identical to SEQ ID NO: 69462
  misc_feature 1..151: note = chr1:39075192-39075343
  misc_feature 1..151: note = Hypo
  source 1..151: mol_type = genomic DNA

SEQ ID NO: 102497 - DNA, 550 bp, Homo sapiens; identical to SEQ ID NO: 69463
  misc_feature 1..550: note = chr1:39269643-39270193
  misc_feature 1..550: note = Hyper
  source 1..550: mol_type = genomic DNA

SEQ ID NO: 102498 - DNA, 156 bp, Homo sapiens; identical to SEQ ID NO: 69464
  misc_feature 1..156: note = chr1:39284433-39284589
  misc_feature 1..156: note = Hyper
  source 1..156: mol_type = genomic DNA

SEQ ID NO: 102499 - DNA, 31 bp, Homo sapiens; identical to SEQ ID NO: 69465
  misc_feature 1..31: note = chr1:39345389-39345420
  misc_feature 1..31: note = Hypo
  source 1..31: mol_type = genomic DNA

SEQ ID NO: 102500 - DNA, 142 bp, Homo sapiens; identical to SEQ ID NO: 69466
  misc_feature 1..142: note = chr1:39416821-39416963
  misc_feature 1..142: note = Hypo
  source 1..142: mol_type = genomic DNA

SEQ ID NO: 102501 - DNA, 32 bp, Homo sapiens; identical to SEQ ID NO: 69467
  misc_feature 1..32: note = chr1:39547658-39547690
  misc_feature 1..32: note = Hyper
  source 1..32: mol_type = genomic DNA

SEQ ID NO: 102502 - DNA, 407 bp, Homo sapiens
  misc_feature 1..407: note = chr1:39957357-39957764
  misc_feature 1..407: note = Hyper
  source 1..407: mol_type = genomic DNA
gaccgcagccacagccggactggtgggaacggcggcgacagacggattggctgacagtcccagccctcagaacagccccggcctcgaagcgttggcgtctgcgtccgcgtcagcgtccgcttgtcccggagccggggcaggtgcgcgcggggggcgctccagggaccgcgctgaggccgcagacgccgcccgccgagccccgccccctgctcgccgaactcagctccccgttcgccgtcggggcgtccccgggcccaggggcggcggcggagctgatgtgcgcccgctgagcgcccccggcccgccatggccgcgcgccccggaccgctctggcttctgggcctgacgttgtgcgcgctgggcgggggcggccccggcctgcgacccccgcccggctgtccccagcg

SEQ ID NO: 102503 - DNA, 34 bp, Homo sapiens; identical to SEQ ID NO: 69468
  misc_feature 1..34: note = chr1:40025741-40025775
  misc_feature 1..34: note = Hypo
  source 1..34: mol_type = genomic DNA

SEQ ID NO: 102504 - DNA, 696 bp, Homo sapiens; identical to SEQ ID NO: 69469
  misc_feature 1..696: note = chr1:40105024-40105720
  misc_feature 1..696: note = Hyper
  source 1..696: mol_type = genomic DNA

SEQ ID NO: 102505 - DNA, 47 bp, Homo sapiens; identical to SEQ ID NO: 69470
  misc_feature 1..47: note = chr1:40136996-40137043
  misc_feature 1..47: note = Hyper
  source 1..47: mol_type = genomic DNA

SEQ ID NO: 102506 - DNA, 441 bp, Homo sapiens
  misc_feature 1..441: note = chr1:40137560-40138001
  misc_feature 1..441: note = Hyper
  source 1..441: mol_type = genomic DNA
gtgcattgcttttaccgatttgggtttcttcttgggcgcgaggttgtcgtagaaaatcttggcttcctcccagaccggggccgcagcggtctccgctcctggcccgggctcgcggggctcctggggctcccggggctgcccaggttccatgctccggctctgacccggcccggccagagcaggcggcggcgtagacgcggaggtggctggggctgggctgcaggagggaggcgagtcccggcgagggaagggggcgggcagcggcgaggaggctgtgcgtgtgagctgggctccccgcccgccgggcggggggaggtcacactggccctctcggtcgcccgtgtgtcgctgccgctgctgctgctactgctgtacggtatgagggatagctgggctctccttccccgaccgacccacgccagcagccggttgggtggtgag

SEQ ID NO: 102507 - DNA, 581 bp, Homo sapiens; identical to SEQ ID NO: 69473
  misc_feature 1..581: note = chr1:40157602-40158183
  misc_feature 1..581: note = Hyper
  source 1..581: mol_type = genomic DNA

SEQ ID NO: 102508 - DNA, 140 bp, Homo sapiens; identical to SEQ ID NO: 69474
  misc_feature 1..140: note = chr1:40204314-40204454
  misc_feature 1..140: note = Hyper
  source 1..140: mol_type = genomic DNA

SEQ ID NO: 102509 - DNA, 241 bp, Homo sapiens
  misc_feature 1..241: note = chr1:40236079-40236320
  misc_feature 1..241: note = Hyper
  source 1..241: mol_type = genomic DNA
gttaagcgctcaattcgtttctcgtatttctgcccctttatcacgcgatctacataaatgttaggaacgtggatgtcttctggggggaaagcccccacctccacgatctcttccacctccaccgccgtgacgtctgcagctttgcacatgggcacgttgaaattgcgggcgcttctcctgaagaccacgtttcctgcccggtcggccttccaccctttcaccagggcgaagtctgcccgga

SEQ ID NO: 102510 - DNA, 144 bp, Homo sapiens; identical to SEQ ID NO: 26221
  misc_feature 1..144: note = chr1:40237059-40237203
  misc_feature 1..144: note = Hyper
  source 1..144: mol_type = genomic DNA

SEQ ID NO: 102511 - DNA, 258 bp, Homo sapiens
  misc_feature 1..258: note = chr1:40254091-40254349
  misc_feature 1..258: note = Hyper
  source 1..258: mol_type = genomic DNA
gccgcccccgcccagcgcgcatagcgccaggcccaggagccagagcgggccggggagcgcggtcatggcaggccgggggcgctcagctggggcgctcagcgggcgcgcatcggctccgcggccgacccagggcctggggacgccccgacggcaaggaggctgggctcggcgggcggcgggcggcggggcggggcgggacgggcggcgaccgcggcctcagcgcggtccctggagcgcccgccgcgcgacacctgtcct

SEQ ID NO: 102512 - DNA, 85 bp, Homo sapiens; identical to SEQ ID NO: 69479
  misc_feature 1..85: note = chr1:40349616-40349701
  misc_feature 1..85: note = Hypo
  source 1..85: mol_type = genomic DNA

SEQ ID NO: 102513 - DNA, 23 bp, Homo sapiens
  misc_feature 1..23: note = chr1:40350021-40350044
  misc_feature 1..23: note = Hypo
  source 1..23: mol_type = genomic DNA
agcaaacctttggcccggcacag

SEQ ID NO: 102514 - DNA, 24 bp, Homo sapiens
  misc_feature 1..24: note = chr1:40409694-40409718
  misc_feature 1..24: note = Hypo
  source 1..24: mol_type = genomic DNA
accaggcaatataggcgtattcat

SEQ ID NO: 102515 - DNA, 27 bp, Homo sapiens
  misc_feature 1..27: note = chr1:40573661-40573688
  misc_feature 1..27: note = Hypo
  source 1..27: mol_type = genomic DNA
agactttttttttttcgagacggaatt

SEQ ID NO: 102516 - DNA, 30 bp, Homo sapiens; identical to SEQ ID NO: 69484
  misc_feature 1..30: note = chr1:40722325-40722355
  misc_feature 1..30: note = Hypo
  source 1..30: mol_type = genomic DNA

SEQ ID NO: 102517 - DNA, 1008 bp, Homo sapiens; identical to SEQ ID NO: 69485
  misc_feature 1..1008: note = chr1:40781208-40782216
  misc_feature 1..1008: note = Hyper
  source 1..1008: mol_type = genomic DNA

SEQ ID NO: 102518 - DNA, 234 bp, Homo sapiens; identical to SEQ ID NO: 69486
  misc_feature 1..234: note = chr1:40782674-40782908
  misc_feature 1..234: note = Hyper
  source 1..234: mol_type = genomic DNA

SEQ ID NO: 102519 - DNA, 138 bp, Homo sapiens; identical to SEQ ID NO: 38945
  misc_feature 1..138: note = chr1:40905029-40905167
  misc_feature 1..138: note = Hypo
  source 1..138: mol_type = genomic DNA

SEQ ID NO: 102520 - DNA, 32 bp, Homo sapiens; identical to SEQ ID NO: 69489
  misc_feature 1..32: note = chr1:40974460-40974492
  misc_feature 1..32: note = Hyper
  source 1..32: mol_type = genomic DNA

SEQ ID NO: 102521 - DNA, 17 bp, Homo sapiens
  misc_feature 1..17: note = chr1:41117054-41117071
  misc_feature 1..17: note = Hypo
  source 1..17: mol_type = genomic DNA
gccaggggaggggcacg

SEQ ID NO: 102522 - DNA, 17 bp, Homo sapiens
  misc_feature 1..17: note = chr1:41117191-41117208
  misc_feature 1..17: note = Hypo
  source 1..17: mol_type = genomic DNA
ggcgctttattgcagct

SEQ ID NO: 102523 - DNA, 196 bp, Homo sapiens; identical to SEQ ID NO: 69494
  misc_feature 1..196: note = chr1:41267850-41268046
  misc_feature 1..196: note = Hyper
  source 1..196: mol_type = genomic DNA

SEQ ID NO: 102524 - DNA, 611 bp, Homo sapiens; identical to SEQ ID NO: 69495
  misc_feature 1..611: note = chr1:41284141-41284752
  misc_feature 1..611: note = Hyper
  source 1..611: mol_type = genomic DNA

SEQ ID NO: 102525 - DNA, 95 bp, Homo sapiens; identical to SEQ ID NO: 69496
  misc_feature 1..95: note = chr1:41288701-41288796
  misc_feature 1..95: note = Hypo
  source 1..95: mol_type = genomic DNA

SEQ ID NO: 102526 - DNA, 90 bp, Homo sapiens; identical to SEQ ID NO: 69497
  misc_feature 1..90: note = chr1:41326990-41327080
  misc_feature 1..90: note = Hyper
  source 1..90: mol_type = genomic DNA

SEQ ID NO: 102527 - DNA, 359 bp, Homo sapiens
  misc_feature 1..359: note = chr1:41327695-41328054
  misc_feature 1..359: note = Hyper
  source 1..359: mol_type = genomic DNA
tacggcggcagagtccggagcgcatgagggccatgggcggccgcggcggacggcggcctctgcaccaggcggtagccctcggcgagcatcaggtggtcggccatggcggcaggccggctgcctgcggggacagcgcgcggtggtcagcgccggctcccccggcccgggccagcggctgctctgcggcgggagacccgggcaccgtgcggtccctgcagctcggccgggcggagcaaaaccaaacccgactggtgccccggcccagcccactactgcgcaccttgcggccgcagcctggggtcacaaaggcccgcaacctgtagtgctccgaaacctccgcgtcgcgtagctgggctcgg

SEQ ID NO: 102528 - DNA, 118 bp, Homo sapiens
  misc_feature 1..118: note = chr1:41350079-41350197
  misc_feature 1..118: note = Hyper
  source 1..118: mol_type = genomic DNA
gcacggcggttcccacgctcgggccctggttcgggggcgttctcgggacggcgtggccgcgctcaccaccaccgcggaggccgggctgtaattaggataattgcgctgctcccagcct

SEQ ID NO: 102529 - DNA, 136 bp, Homo sapiens; identical to SEQ ID NO: 69500
  misc_feature 1..136: note = chr1:41444838-41444974
  misc_feature 1..136: note = Hyper
  source 1..136: mol_type = genomic DNA

SEQ ID NO: 102530 - DNA, 36 bp, Homo sapiens; identical to SEQ ID NO: 69501
  misc_feature 1..36: note = chr1:41451976-41452012
  misc_feature 1..36: note = Hypo
  source 1..36: mol_type = genomic DNA

SEQ ID NO: 102531 - DNA, 116 bp, Homo sapiens; identical to SEQ ID NO: 69502
  misc_feature 1..116: note = chr1:41486048-41486164
  misc_feature 1..116: note = Hypo
  source 1..116: mol_type = genomic DNA

SEQ ID NO: 102532 - DNA, 33 bp, Homo sapiens; identical to SEQ ID NO: 69503
  misc_feature 1..33: note = chr1:41602320-41602353
  misc_feature 1..33: note = Hypo
  source 1..33: mol_type = genomic DNA

SEQ ID NO: 102533 - DNA, 1037 bp, Homo sapiens
  misc_feature 1..1037: note = chr1:41847281-41848318
  misc_feature 1..1037: note = Hyper
  source 1..1037: mol_type = genomic DNA
ccacagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccgggg

SEQ ID NO: 102534 - DNA, 30 bp, Homo sapiens; identical to SEQ ID NO: 69506
  misc_feature 1..30: note = chr1:41848613-41848643
  misc_feature 1..30: note = Hyper
  source 1..30: mol_type = genomic DNA

SEQ ID NO: 102535 - DNA, 99 bp, Homo sapiens
  misc_feature 1..99: note = chr1:41848877-41848976
  misc_feature 1..99: note = Hyper
  source 1..99: mol_type = genomic DNA
caaatcgccctccgacgaccgccacccccacagttcagtctccccctcccatccctgccggccctcgcttctcccctcccccgtcggagtcagtccctc

SEQ ID NO: 102536 - DNA, 66 bp, Homo sapiens; identical to SEQ ID NO: 69509
  misc_feature 1..66: note = chr1:41967207-41967273
  misc_feature 1..66: note = Hypo
  source 1..66: mol_type = genomic DNA

SEQ ID NO: 102537 - DNA, 195 bp, Homo sapiens; identical to SEQ ID NO: 69510
  misc_feature 1..195: note = chr1:41991590-41991785
  misc_feature 1..195: note = Hypo
  source 1..195: mol_type = genomic DNA

SEQ ID NO: 102538 - DNA, 115 bp, Homo sapiens; identical to SEQ ID NO: 69512
  misc_feature 1..115: note = chr1:42128232-42128347
  misc_feature 1..115: note = Hyper
  source 1..115: mol_type = genomic DNA

SEQ ID NO: 102539 - DNA, 30 bp, Homo sapiens; identical to SEQ ID NO: 69513
  misc_feature 1..30: note = chr1:42610107-42610137
  misc_feature 1..30: note = Hypo
  source 1..30: mol_type = genomic DNA

SEQ ID NO: 102540 - DNA, 23 bp, Homo sapiens
  misc_feature 1..23: note = chr1:42633276-42633299
  misc_feature 1..23: note = Hypo
  source 1..23: mol_type = genomic DNA
tgtgctgacgtgtgtgtatacac

SEQ ID NO: 102541 - DNA, 78 bp, Homo sapiens; identical to SEQ ID NO: 69516
  misc_feature 1..78: note = chr1:42802583-42802661
  misc_feature 1..78: note = Hypo
  source 1..78: mol_type = genomic DNA

SEQ ID NO: 102542 - DNA, 30 bp, Homo sapiens; identical to SEQ ID NO: 69517
  misc_feature 1..30: note = chr1:42803057-42803087
  misc_feature 1..30: note = Hypo
  source 1..30: mol_type = genomic DNA

SEQ ID NO: 102543 - DNA, 75 bp, Homo sapiens; identical to SEQ ID NO: 69519
  misc_feature 1..75: note = chr1:43209082-43209157
  misc_feature 1..75: note = Hypo
  source 1..75: mol_type = genomic DNA

SEQ ID NO: 102544 - DNA, 154 bp, Homo sapiens
  misc_feature 1..154: note = chr1:43250818-43250972
  misc_feature 1..154: note = Hyper
  source 1..154: mol_type = genomic DNA
ccggctccatcttcccgatgtggtcgcggctgaagccgggcctgggcattctcgggacagccagagtgggccaggggaccacgtcccatccccagaggccggccctccgtcggagggtttccagcctccaggaaaggagcgggggctgggaggg

SEQ ID NO: 102545 - DNA, 30 bp, Homo sapiens; identical to SEQ ID NO: 69521
  misc_feature 1..30: note = chr1:43393760-43393790
  misc_feature 1..30: note = Hypo
  source 1..30: mol_type = genomic DNA

SEQ ID NO: 102546 - DNA, 30 bp, Homo sapiens; identical to SEQ ID NO: 69522
  misc_feature 1..30: note = chr1:43414183-43414213
  misc_feature 1..30: note = Hypo
  source 1..30: mol_type = genomic DNA

SEQ ID NO: 102547 - DNA, 57 bp, Homo sapiens; identical to SEQ ID NO: 69523
  misc_feature 1..57: note = chr1:43446019-43446076
  misc_feature 1..57: note = Hypo
  source 1..57: mol_type = genomic DNA

SEQ ID NO: 102548 - DNA, 16 bp, Homo sapiens
  misc_feature 1..16: note = chr1:43531822-43531838
  misc_feature 1..16: note = Hypo
  source 1..16: mol_type = genomic DNA
gcgcccagccaagatg

SEQ ID NO: 102549 - DNA, 353 bp, Homo sapiens
  misc_feature 1..353: note = chr1:43533892-43534245
  misc_feature 1..353: note = Hyper
  source 1..353: mol_type = genomic DNA
ggcaggcggggtgtgcgccccggccgcttccagtcggcgcgggagctgggacggaagctgtgcgccctcggagcccctgcagtcccctcaccgggcgctcccaaacagcccgcggggcgctgggcgcggggccaggaaatccggcgccggcccttgaagcgcacccgggccgggagggggcggcgggggcggcgggggcgggctgggcgctggcaccacgaccgcccgctgagcaacgtgactgcgcgggctcgggtccccaccaggacaaggcggcctctgtgccgacccagctgattcctctcgggctgcaaatcccttccggctgacagccctgccggctggggccaggc

SEQ ID NO: 102550 - DNA, 369 bp, Homo sapiens; identical to SEQ ID NO: 69527
  misc_feature 1..369: note = chr1:43613473-43613842
  misc_feature 1..369: note = Hyper
  source 1..369: mol_type = genomic DNA

SEQ ID NO: 102551 - DNA, 30 bp, Homo sapiens; identical to SEQ ID NO: 69528
  misc_feature 1..30: note = chr1:43750677-43750707
  misc_feature 1..30: note = Hypo
  source 1..30: mol_type = genomic DNA

SEQ ID NO: 102552 - DNA, 30 bp, Homo sapiens; identical to SEQ ID NO: 69529
  misc_feature 1..30: note = chr1:43752107-43752137
  misc_feature 1..30: note = Hypo
  source 1..30: mol_type = genomic DNA

SEQ ID NO: 102553 - DNA, 30 bp, Homo sapiens; identical to SEQ ID NO: 69530
  misc_feature 1..30: note = chr1:43787010-43787040
  misc_feature 1..30: note = Hypo
  source 1..30: mol_type = genomic DNA

SEQ ID NO: 102554 - DNA, 92 bp, Homo sapiens; identical to SEQ ID NO: 38953
  misc_feature 1..92: note = chr1:43826882-43826974
  misc_feature 1..92: note = Hypo
  source 1..92: mol_type = genomic DNA

SEQ ID NO: 102555 - DNA, 91 bp, Homo sapiens; identical to SEQ ID NO: 38954
  misc_feature 1..91: note = chr1:43834716-43834807
  misc_feature 1..91: note = Hypo
  source 1..91: mol_type = genomic DNA

SEQ ID NO: 102556 - DNA, 89 bp, Homo sapiens; identical to SEQ ID NO: 69534
  misc_feature 1..89: note = chr1:43893329-43893418
  misc_feature 1..89: note = Hypo
  source 1..89: mol_type = genomic DNA

SEQ ID NO: 102557 - DNA, 49 bp, Homo sapiens; identical to SEQ ID NO: 69535
  misc_feature 1..49: note = chr1:43919778-43919827
  misc_feature 1..49: note = Hyper
  source 1..49: mol_type = genomic DNA

SEQ ID NO: 102558 - DNA, 57 bp, Homo sapiens; identical to SEQ ID NO: 38955
  misc_feature 1..57: note = chr1:43991727-43991784
  misc_feature 1..57: note = Hypo
  source 1..57: mol_type = genomic DNA

SEQ ID NO: 102559 - DNA, 30 bp, Homo sapiens; identical to SEQ ID NO: 38956
  misc_feature 1..30: note = chr1:44000506-44000536
  misc_feature 1..30: note = Hypo
  source 1..30: mol_type = genomic DNA

SEQ ID NO: 102560 - DNA, 30 bp, Homo sapiens; identical to SEQ ID NO: 38957
  misc_feature 1..30: note = chr1:44016696-44016726
  misc_feature 1..30: note = Hypo
  source 1..30: mol_type = genomic DNA

SEQ ID NO: 102561 - DNA, 57 bp, Homo sapiens; identical to SEQ ID NO: 69540
  misc_feature 1..57: note = chr1:44043730-44043787
  misc_feature 1..57: note = Hypo
  source 1..57: mol_type = genomic DNA

SEQ ID NO: 102562 - DNA, 115 bp, Homo sapiens; identical to SEQ ID NO: 69541
  misc_feature 1..115: note = chr1:44068774-44068889
  misc_feature 1..115: note = Hypo
  source 1..115: mol_type = genomic DNA

SEQ ID NO: 102563 - DNA, 30 bp, Homo sapiens; identical to SEQ ID NO: 69543
  misc_feature 1..30: note = chr1:44304865-44304895
  misc_feature 1..30: note = Hypo
  source 1..30: mol_type = genomic DNA

SEQ ID NO: 102564 - DNA, 142 bp, Homo sapiens; identical to SEQ ID NO: 69544
  misc_feature 1..142: note = chr1:44351091-44351233
  misc_feature 1..142: note = Hypo
  source 1..142: mol_type = genomic DNA

SEQ ID NO: 102565 - DNA, 30 bp, Homo sapiens; identical to SEQ ID NO: 69545
  misc_feature 1..30: note = chr1:44396459-44396489
  misc_feature 1..30: note = Hypo
  source 1..30: mol_type = genomic DNA

SEQ ID NO: 102566 - DNA, 351 bp, Homo sapiens; identical to SEQ ID NO: 69546
  misc_feature 1..351: note = chr1:44401909-44402260
  misc_feature 1..351: note = Hyper
  source 1..351: mol_type = genomic DNA

SEQ ID NO: 102567 - DNA, 45 bp, Homo sapiens; identical to SEQ ID NO: 38961
  misc_feature 1..45: note = chr1:44463208-44463253
  misc_feature 1..45: note = Hypo
  source 1..45: mol_type = genomic DNA

SEQ ID NO: 102568 - DNA, 173 bp, Homo sapiens; identical to SEQ ID NO: 69548
  misc_feature 1..173: note = chr1:44463830-44464003
  misc_feature 1..173: note = Hypo
  source 1..173: mol_type = genomic DNA

SEQ ID NO: 102569 - DNA, 150 bp, Homo sapiens; identical to SEQ ID NO: 38963
  misc_feature 1..150: note = chr1:44497521-44497671
  misc_feature 1..150: note = Hypo
  source 1..150: mol_type = genomic DNA

SEQ ID NO: 102570 - DNA, 146 bp, Homo sapiens; identical to SEQ ID NO: 69550
  misc_feature 1..146: note = chr1:44584392-44584538
  misc_feature 1..146: note = Hypo
  source 1..146: mol_type = genomic DNA

SEQ ID NO: 102571 - DNA, 92 bp, Homo sapiens; identical to SEQ ID NO: 69551
  misc_feature 1..92: note = chr1:44718072-44718164
  misc_feature 1..92: note = Hypo
  source 1..92: mol_type = genomic DNA

SEQ ID NO: 102572 - DNA, 423 bp, Homo sapiens; identical to SEQ ID NO: 69552
  misc_feature 1..423: note = chr1:44726893-44727316
  misc_feature 1..423: note = Hypo
  source 1..423: mol_type = genomic DNA

SEQ ID NO: 102573 - DNA, 30 bp, Homo sapiens; identical to SEQ ID NO: 38967
  misc_feature 1..30: note = chr1:44794138-44794168
  misc_feature 1..30: note = Hypo
  source 1..30: mol_type = genomic DNA

SEQ ID NO: 102574 - DNA, 26 bp, Homo sapiens
  misc_feature 1..26: note = chr1:44871018-44871044
  misc_feature 1..26: note = Hyper
  source 1..26: mol_type = genomic DNA
tcgcgaacacaaacccggggccagcc

SEQ ID NO: 102575 - DNA, 86 bp, Homo sapiens; identical to SEQ ID NO: 69556
  misc_feature 1..86: note = chr1:44871104-44871190
  misc_feature 1..86: note = Hyper
  source 1..86: mol_type = genomic DNA

SEQ ID NO: 102576 - DNA, 1552 bp, Homo sapiens
  misc_feature 1..1552: note = chr1:44872293-44873845
  misc_feature 1..1552: note = Hyper
  source 1..1552: mol_type = genomic DNA
gcgaccttctctgcccggaacccagccccgccaccgcactccggagcctccggcctcccccaccccacccccgccccccaacccggggcttttcagggctcggcctgggcgtttcgcctttgtgctttgtaagagaaagccttttcttccagggcacaacaaacttgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttccggccctgagccaggcgcgcgtcgcactgggtgggtgcatggggcccgggccataggtgtgggggcacagccctacctggccggcccgggtcgtctggggtctgcgccggcccactggcccgggagccgccgagggggagagcaccgcactcgctgcccacgacgcccagcagccacatcttgcctctcgcctccgctccggactcggcttgaggggcaaaggggagagaaaggaaaaataaagaaaaaaaagggcggcagtgaggaagcagcgaggggactggggggagcagagtgggcaggggggctttgccttgcctggcctcctctttccgtctcgcgggctcttcctgcaaaggggaatgagcagaggggggaaaggcagaaagagcgtcgaggaagagcggtgctggcgtcttccgtgccgatccctcctggcccgcagagacccggcaaaagtggcgtgagttcgcttgctgcgcttcgaggcaaggctggggaaggccgaggacggggcggcgccgcgtcgcgccgctggtggccgacagggccggggccgggcgcggagcgagcggggacacacacctgttctgcgagccgcgcggtgtgcggcggccggacggccgcggtgcgggccgcagaaccctccctcccgcactgcgcatccgcagtccaggagctggaagggcccggcagccccgcgccggtccgtatttgcaggagaagcgggagtggaggagtccgcggctgcccgctgaagcggtggtgcgcgcggcggcgggacccgggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttcttcccccgttttccctaaaag

SEQ ID NO: 102577 - DNA, 1216 bp, Homo sapiens
  misc_feature 1..1216: note = chr1:44883069-44884285
  misc_feature 1..1216: note = Hyper
  source 1..1216: mol_type = genomic DNA
tggggccaggctggacgggagcagtccctgatggctgcagagccatctggcctggcttggcttggctcggcgcgccgctcgcctggcggctgggctcgctgtagttgtgctcccgctcttcccctgccctcgctccacgccgcgccgctctgtgcggcggctgcctcctcttacggccggaatgcctaatcaccatggtgagaaaacggacaccgcagccgtcctccctcctcgccccgcgccctccctcccatcaattgtcatgcagaagtgatccgggctgccgttttctcgcggccgcccgccagcccctcgccgctgccggcagaagggtggctggtaattgatcttctgggggagggggcgcggagaggcgcgagaactggccccggggaggccaggccacggggtgggccccgttcgcttacttgcaagggacccccagcctccgccaccgaggcggcttgcaagtggtttcagaaatgttggtgatctcgccgtcgctctgcagcacttggaggccgcaggaggactccgcgcgccgcctcgagggccgggagcgcccagcccgcggccgcacacacgagggcccgtcgcgccccccgccctgccccgcctcgccctccacgtccctgcacccccaagtcgcactaagaacccagtccccgatcggtttcctctacgccgtctgagcagaagagagtgggaaccggggtgacggataaggggggggcgcccacgcgacgtcggggtgcatgggagcgcgcgggaggcgctagtgggtgcacggggcgtgagggggacacagcgcgggcgtggggatggccactgcgcggggagggttctgcctggagaaggagggatgggaggaggttgggggagcagggcgcgtggaggagggaggttggacgtgtgtacagcgcctggggacctcgctggccccttggtgcccccaggactctgaggcttctcctttcggcttgaaatgtttttcccttcctgcttttcaaatctgtaaaaatgttccggggaatgtttccgaagtccagggctccgtccttcggcgggattgctggcattcgggcaaggcgagtcgcggtggcctctgaggctcgcagccagcacagcggggctcgttaaagtctgggcaatttctggaactcttcccacgggaagttttccggggctgccttccggtcagcggccccaggttgat

SEQ ID NO: 102578 - DNA, 30 bp, Homo sapiens; identical to SEQ ID NO: 69564
  misc_feature 1..30: note = chr1:45063652-45063682
  misc_feature 1..30: note = Hypo
  source 1..30: mol_type = genomic DNA

SEQ ID NO: 102579 - DNA, 62 bp, Homo sapiens; identical to SEQ ID NO: 38968
  misc_feature 1..62: note = chr1:45103094-45103156
  misc_feature 1..62: note = Hypo
  source 1..62: mol_type = genomic DNA

SEQ ID NO: 102580 - DNA, 49 bp, Homo sapiens; identical to SEQ ID NO: 69566
  misc_feature 1..49: note = chr1:45106627-45106676
  misc_feature 1..49: note = Hypo
  source 1..49: mol_type = genomic DNA

SEQ ID NO: 102581 - DNA, 38 bp, Homo sapiens; identical to SEQ ID NO: 69567
  misc_feature 1..38: note = chr1:45156636-45156674
  misc_feature 1..38: note = Hypo
  source 1..38: mol_type = genomic DNA

SEQ ID NO: 102582 - DNA, 30 bp, Homo sapiens; identical to SEQ ID NO: 69568
  misc_feature 1..30: note = chr1:45194741-45194771
  misc_feature 1..30: note = Hypo
  source 1..30: mol_type = genomic DNA

SEQ ID NO: 102583 - DNA, 18 bp, Homo sapiens
  misc_feature 1..18: note = chr1:45197991-45198009
  misc_feature 1..18: note = Hypo
  source 1..18: mol_type = genomic DNA
ttttttaaagagtctcgc

SEQ ID NO: 102584 - DNA, 20 bp, Homo sapiens
  misc_feature 1..20: note = chr1:45240494-45240514
  misc_feature 1..20: note = Hypo
  source 1..20: mol_type = genomic DNA
caccgcgccaggcctaaaaa

SEQ ID NO: 102585 - DNA, 384 bp, Homo sapiens
  misc_feature 1..384: note = chr1:45250005-45250389
  misc_feature 1..384: note = Hyper
  source 1..384: mol_type = genomic DNA
acgcggccgaagttccggaggctgatggccggggagggcgcccctacgcccaggaagcggccgagcaacggggtctgcgcggcgggcgcgggccgaccagatccgggggacgcctccacctgcaggctctgctcagggtcgtcgctcatgctgcgggcgggagggcgggctgagccggggcacagggcgggagcggggacgcgggatcggctctcggggaaggaccgaggcatcggtgccccagaggctgagcgaggacccgcgtgccgggtcaggcccagtgcaagccactcaccgcaggttgaaggtggagcccaggaatgagggccgcagagactcggccgccgtggccacagtgtagggtggctgcggctggtcctcatc

SEQ ID NO: 102586 - DNA, 434 bp, Homo sapiens; identical to SEQ ID NO: 69573
  misc_feature 1..434: note = chr1:45251837-45252271
  misc_feature 1..434: note = Hyper
  source 1..434: mol_type = genomic DNA

SEQ ID NO: 102587 - DNA, 24 bp, Homo sapiens
  misc_feature 1..24: note = chr1:45264938-45264962
  misc_feature 1..24: note = Hypo
  source 1..24: mol_type = genomic DNA
aggcaaggtggctcacgcctgtaa

SEQ ID NO: 102588 - DNA, 100 bp, Homo sapiens; identical to SEQ ID NO: 38971
  misc_feature 1..100: note = chr1:45280516-45280616
  misc_feature 1..100: note = Hypo
  source 1..100: mol_type = genomic DNA

SEQ ID NO: 102589 - DNA, 100 bp, Homo sapiens; identical to SEQ ID NO: 69576
  misc_feature 1..100: note = chr1:45293217-45293317
  misc_feature 1..100: note = Hypo
  source 1..100: mol_type = genomic DNA

SEQ ID NO: 102590 - DNA, 80 bp, Homo sapiens; identical to SEQ ID NO: 69577
  misc_feature 1..80: note = chr1:45308235-45308315
  misc_feature 1..80: note = Hypo
  source 1..80: mol_type = genomic DNA

SEQ ID NO: 102591 - DNA, 113 bp, Homo sapiens; identical to SEQ ID NO: 69578
  misc_feature 1..113: note = chr1:45308747-45308860
  misc_feature 1..113: note = Hyper
  source 1..113: mol_type = genomic DNA

SEQ ID NO: 102592 - DNA, 104 bp, Homo sapiens; identical to SEQ ID NO: 69580
  misc_feature 1..104: note = chr1:45466045-45466149
  misc_feature 1..104: note = Hypo
  source 1..104: mol_type = genomic DNA

SEQ ID NO: 102593 - DNA, 30 bp, Homo sapiens; identical to SEQ ID NO: 69581
  misc_feature 1..30: note = chr1:45468126-45468156
  misc_feature 1..30: note = Hypo
  source 1..30: mol_type = genomic DNA

SEQ ID NO: 102594 - DNA, 16 bp, Homo sapiens
  misc_feature 1..16: note = chr1:45645619-45645635
  misc_feature 1..16: note = Hypo
  source 1..16: mol_type = genomic DNA
aggagccaagatggcc

SEQ ID NO: 102595 - DNA, 23 bp, Homo sapiens
  misc_feature 1..23: note = chr1:45936888-45936911
  misc_feature 1..23: note = Hypo
  source 1..23: mol_type = genomic DNA
caagactccgtctcaaaaaaaag

SEQ ID NO: 102596 - DNA, 38 bp, Homo sapiens; identical to SEQ ID NO: 14239
  misc_feature 1..38: note = chr1:46079131-46079169
  misc_feature 1..38: note = Hypo
  source 1..38: mol_type = genomic DNA

SEQ ID NO: 102597 - DNA, 352 bp, Homo sapiens
  misc_feature 1..352: note = chr1:46632620-46632972
  misc_feature 1..352: note = Hyper
  source 1..352: mol_type = genomic DNA
ccgcacttctagctgcgttcaaccaggctcaggaggtccttcaagatcttggcttccttttcctgactccgcgcccggcgcggttaattatagccccaccccgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctgctgccaaagctccgaagctctggatgt

SEQ ID NO: 102598 - DNA, 41 bp, Homo sapiens; identical to SEQ ID NO: 69590
  misc_feature 1..41: note = chr1:46653449-46653490
  misc_feature 1..41: note = Hypo
  source 1..41: mol_type = genomic DNA

SEQ ID NO: 102599 - DNA, 40 bp, Homo sapiens; identical to SEQ ID NO: 69591
  misc_feature 1..40: note = chr1:46668917-46668957
  misc_feature 1..40: note = Hyper
  source 1..40: mol_type = genomic DNA

SEQ ID NO: 102600 - DNA, 51 bp, Homo sapiens; identical to SEQ ID NO: 69594
  misc_feature 1..51: note = chr1:46859925-46859976
  misc_feature 1..51: note = Hyper
  source 1..51: mol_type = genomic DNA

SEQ ID NO: 102601 - DNA, 883 bp, Homo sapiens
  misc_feature 1..883: note = chr1:46913659-46914542
  misc_feature 1..883: note = Hyper
  source 1..883: mol_type = genomic DNA
gggccctgactaggacgttacgggaagggggtcttgaattctgatctcgtttctgcctaagacctatcgcctttttgaacctcagtttcccctttggctgcatagggaaggggtgcccacatgcccccgcccgcattcagttcgaaggaccagccagtaggccctgcgccgcccagggaccgcccggcctttgcgtccggcccagctcaagccccttccgccgcgcgcggcctcgggagcgctgggcaggcagcccgggtgggagcgcccacgtctcccgcggacacggacggacggatggacgggcggccgcgcaggcccgcgccccgctcccgccccgcctgccgcgcctcccggggcgcccgcattaaagcgcatatgcaagccatgaattatcaactgaaaggagtcaattaccggctctaaaaacgagtgtctgcgctcgcagcgccccgggccatccgcctatttacggagcgatctaccccgcccggctggggagggggcctcgggagggagagagacggagaaacggagcccgagaccgggagagagccggagaggcagggactggagagtctgggacacgaaggagaggcggggagagaccgagattcagcgagacgcgcggagggccggacgggagccaaggcggctcagttcctcttctcccccgagcaggcgaggagaggtggggtctcaggacctccaaggccctgttccccttccattggcatttgtgtaaggacgcaggccctccgcactgctgactgtggcactgggcagggagtcccctagactaggggtttggggttagatctggggctcaggcagcgctgggctgggcgtagtttgcagagggaccggccgtcctggcaggaaa

SEQ ID NO: 102602 - DNA, 111 bp, Homo sapiens; identical to SEQ ID NO: 69599
  misc_feature 1..111: note = chr1:46921772-46921883
  misc_feature 1..111: note = Hypo
  source 1..111: mol_type = genomic DNA

SEQ ID NO: 102603 - DNA, 249 bp, Homo sapiens; identical to SEQ ID NO: 69600
  misc_feature 1..249: note = chr1:46932507-46932756
  misc_feature 1..249: note = Hyper
  source 1..249: mol_type = genomic DNA

SEQ ID NO: 102604 - DNA, 593 bp, Homo sapiens
  misc_feature 1..593: note = chr1:46951169-46951762
  misc_feature 1..593: note = Hyper
  source 1..593: mol_type = genomic DNA
gggggtatctctgagcggtgaaggggagtagccgtcggagggcggggacagagcggtagctgccttgcgctgggattgggggtgggggtgggagtggggagggctctttaagcggcggccgcgctaataacctgtccaggagatggctcgtggcaaattgctttgttagtcttgtcagcgcggccggggccgccgtcagcgcgcgccatggatcaagatgatgaatcgctgcggacggcgcagatgcgggcggcccgcggccgggcccccgggtaggggtgggaggtggagggggccgcggggggcccggccgccgccattaactccggaattaggtctaagccgcccaccacccagccactgccccggggagcgccagccgttggggcgggagcgggcccaggatggggactgagacccgcgtcccccacccgaacctggacctagcctcctctgaacgcagagggcagtgggccgcccggaaggggcggggaggggccccggccctcaagccgcacagccaggtgttcccgctcttcgaggacatcccctgcccgcctggaggttgagagggcggccgcatggggcattcg

SEQ ID NO: 102605 - DNA, 40 bp, Homo sapiens; identical to SEQ ID NO: 69603
  misc_feature 1..40: note = chr1:46954864-46954904
  misc_feature 1..40: note = Hyper
  source 1..40: mol_type = genomic DNA

SEQ ID NO: 102606 - DNA, 930 bp, Homo sapiens
  misc_feature 1..930: note = chr1:46956241-46957171
  misc_feature 1..930: note = Hyper
  source 1..930: mol_type = genomic DNA
cagcttcctggtccacgcgaaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttgcgaggactgccagggtctttcctccctaggcttcccacactggatggccgtaactcagtcgttgacggcgacaggccaggggccctgatggactgtgcagggtcccgggcaccaccggctgaactttctggcggtcacaaattcccggaacctgcgcaggggcttcgttggcactggtggttcacttaaggagcttgagggaaacctcctcttccccaaattcgcaccaaatctggggccccgacttttcctggattccagccacactcggtttgggaggcagtgggctcctcaggcttgtgatttgcggcaggaaggagtcccggaatggaagaacggggaggacgagatccgaggccttttcaccctctttgcaagcatgcagttcaccaaagccgagaacccaccgggcctggagcgcagcctcagcgctggttccgacccgggccccagaaggtctttttcgtttgagaaaagtcctcggaggccggggcagggtgcgccgatattggtttactaagggcgcctccagtttgagggcgttggggaaagagg

SEQ ID NO: 102607 - DNA, 30 bp, Homo sapiens; identical to SEQ ID NO: 69607
  misc_feature 1..30: note = chr1:46958750-46958780
  misc_feature 1..30: note = Hyper
  source 1..30: mol_type = genomic DNA

SEQ ID NO: 102608 - DNA, 350 bp, Homo sapiens; identical to SEQ ID NO: 69609
  misc_feature 1..350: note = chr1:46998912-46999262
  misc_feature 1..350: note = Hyper
  source 1..350: mol_type = genomic DNA

SEQ ID NO: 102609 - DNA, 683 bp, Homo sapiens
  misc_feature 1..683: note = chr1:47009449-47010132
  misc_feature 1..683: note = Hyper
  source 1..683: mol_type = genomic DNA
ccctcagccccctcccgccagcgtcccccagctccttcacttgcctgagcccgtccgtggacactcccctgcgggtccgaccaggctgacccttgagcaccctgggtcagcaggaaggaaagaccccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggcacgctggcctgcgcgggtccccagccgcctcccgccacccggaacccctctccttcaagcgttgaccgccgacccacagctccccttcaacccggggcgagcggggttcttaccatacacctcccctctccgctcggttccatccttctcccgttctcctctaggcttcacggtttgcaagcacccttgcaaataactcctagcccacccacaccgtctcgtccgcactttccgagagccaggcacg

SEQ ID NO: 102610 - DNA, 30 bp, Homo sapiens; identical to SEQ ID NO: 69613
  misc_feature 1..30: note = chr1:47041243-47041273
  misc_feature 1..30: note = Hypo
  source 1..30: mol_type = genomic DNA

SEQ ID NO: 102611 - DNA, 137 bp, Homo sapiens; identical to SEQ ID NO: 69622
  misc_feature 1..137: note = chr1:47691603-47691740
  misc_feature 1..137: note = Hyper
  source 1..137: mol_type = genomic DNA

SEQ ID NO: 102612 - DNA, 793 bp, Homo sapiens
  misc_feature 1..793: note = chr1:47694793-47695586
  misc_feature 1..793: note = Hyper
  source 1..793: mol_type = genomic DNA
ttcctcaccccaggccggaacacaaggccttcctagacaccgtttccaccggcaccattcccctgaaaactcacctggggcatatttagagagaccggcccctctgaataggatctccactccgccggaaaggggcggaagccgaggaagaggatgcacacccgggtctttgctttccccctttttcgctgagaggcctgcagttacgctgcggtgtggtcctgggcgatctgccgcgcccaaagcgagtttccaggaaagataggggtggagagaaagaggcagggcaagagggagggagagagagaaatgggggtcaatggctgggaattacctcctgtccccgaccaaccagtccagggaatcgcaaacagctttccgcccccaacctgcaggtgtttggagcctttcctctaccccctcctccccccacccgccttaaaaaaccctatacatgaccaatcaggaatagctatttagtccaacagcaacaacaacccctcccgacaggctgtctggaacattttcgaaccctccaactgggatcggtctggttcagtgtttgttttctaagcagggaggtgtctacgcggttgcctcctcagccaggtctccggctgccgctacaccgcgaagggatagtcccgggcctggatgggcggaggtccgtgttgggaaaggcgaatagtcttcagactctggtcggtgggacagaaccttgaagtcccccccacctcattctctctctgacccccatccacccacctccagcccaaagcgaaaccagaaccca

SEQ ID NO: 102613 - DNA, 2314 bp, Homo sapiens
  misc_feature 1..2314: note = chr1:47695896-47698210
  misc_feature 1..2314: note = Hyper
  source 1..2314: mol_type = genomic DNA
aggtaaaaacaaacccgacactactttcaaggatgtagcaggattgagcttgcttttattttttcctagtggattttgtttaatttgttttgcctaaatcgtcaggcttatgatcacacatcgaagtcttggattaactgcgaaggcctccttctatttgccgcggctttggtggacatataggaataattcttccctggattgcaatacaatgcggaagattttctttctcctcttctaatccaaaagaggggaggggaggaaagaagaggggaatccatccattcccggcgtgttcgcggggggttaatgttgcgtgttcgctgggggttaatgtttgccttatgaccaagtctctgtgtccgtgcctctctccattttctcttcctacctcaaacccagcaacttagaaaacggctgtagcggaaaaaaacccgctgctttgttctcccgccaaaggagccaaaagggacaaactgctgcgctctgggatgattattttaattaaaatagatgttaatgatgacgattgtgatggtgatggcattagcaattacaataattgacaaaacaaaattctttcaacccgagctagggccccactaacccggtccctcccagagcccggattcggcctcggtctcggatgcgacgggtatcagacccaagcggcaacgtcgctcacccgaagagggggcgggaaaatcttcccaggaggtgatcccgaatgtccccacccgaggctcgaggcctggtgaatgtgcccattgtcctttcggggcctctcccttggagcccggcggccgcacccacgaaactgaccagaaatggatgaagccggagtgcagcgggaaccgaagcccgcagctaccggctcgaaggcgccggcctcggcgagcgctgctcagcttcaagcctggaggagcctcccactcaccaacgaacccctcaaacacctaggcacaggcgggcctccgggcagagcagccgccgaccgggcgctgtccgcccacccaagccaacaactggctcccgaatacatcataatttggaataaaatgtgaaatcccgctccccgcccccatgccgccgcccccaccagcgcctcgatctctcgctcgccctccccccactcccgcccccagcgatttgcaaacgcacctctaaaggacacaggcacacaggcatacaactcagtgcggacaggaccacacagggtccagccccacagaagggcagcaaacaaacaccacctagcactgccccagaagccgacttggtcagccccgcacactgcccaacaggacacaacgaaatcagtcaaacgcagcggctcacggacacacaatccagcacagtcgggatcacacacgcccgacataacgacgacaccacccaaacacagtcgcaggggccacacacccccacacacagaatcagatccctgctgagaacaccaacggagcacaatcgtacgcaacgaagaaaacgcagaagggcctcgaagggtccacatctacacaccccaaccgcgcaggcacaccacactcggacacagagcctgtcgccaagaagaccacacttagaagcagccaacgccgcccacagttctcatgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggagcgaagacctcttttgcggacgtggggaaaaagaggaggaaattgatgaagaattcggtgggaggccgcgggttgcttttcccctagaaaaaggccagaatgctcacgtttttccgctacgggggtacgcgtgtggccattttgaggcccggtcctgagcggcggcggcccggcccctcccgcggcccccgctcccccgcccgccccgcgcccgcccggcccctccaccgacgcgctgtaatcccactcacgttccaggcctcgttagcatgggccgaggcgcgccggggccgtgtgcgccgcagagataaggcactgccgcgggtccgcccgcccccgataagcgcctcggccattatgggccaaatgattcattttaatttggcaatttcaccggagggagtggggactggttgagcggcgctaggaccggctccggaacgcgctgcggggagcgttggacgcgctgtctaggaccc

SEQ ID NO: 102614 - DNA, 30 bp, Homo sapiens; identical to SEQ ID NO: 69630
  misc_feature 1..30: note = chr1:47701225-47701255
  misc_feature 1..30: note = Hyper
  source 1..30: mol_type = genomic DNA

SEQ ID NO: 102615 - DNA, 84 bp, Homo sapiens; identical to SEQ ID NO: 69633
  misc_feature 1..84: note = chr1:47749513-47749597
  misc_feature 1..84: note = Hypo
  source 1..84: mol_type = genomic DNA

SEQ ID NO: 102616 - DNA, 391 bp, Homo sapiens
  misc_feature 1..391: note = chr1:47881997-47882388
  misc_feature 1..391: note = Hyper
  source 1..391: mol_type = genomic DNA
gcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccg

SEQ ID NO: 102617 - DNA, 100 bp, Homo sapiens; identical to SEQ ID NO: 69637
  misc_feature 1..100: note = chr1:47882747-47882847
  misc_feature 1..100: note = Hyper
  source 1..100: mol_type = genomic DNA

SEQ ID NO: 102618 - DNA, 355 bp, Homo sapiens
  misc_feature 1..355: note = chr1:47904375-47904730
  misc_feature 1..355: note = Hyper
  source 1..355: mol_type = genomic DNA
gcgagccgggcaacccgggcaagggcaactactggacgctggacccggagtcggccgacatgttcgacaacggcagcttcctgcggcgtcgcaagcgcttcaagcggcagcccctgccgccgccgcacccacacccgcaccctcacccggagctgctgctgcgtggcggggccgcggcggcgggggatcccggcgctttcctgcccggcttcgctgcctacggcgcctacggctacggctacgggctggctctcccggcctacggcgcacccccgccggggccggccccgcatccgcacccgcacccgcacgccttcgctttcgccgcggcagccgccgccgctccttgccagct

SEQ ID NO: 102619 - DNA, 718 bp, Homo sapiens; identical to SEQ ID NO: 69640
  misc_feature 1..718: note = chr1:47909442-47910160
  misc_feature 1..718: note = Hyper
  source 1..718: mol_type = genomic DNA

SEQ ID NO: 102620 - DNA, 599 bp, Homo sapiens
  misc_feature 1..599: note = chr1:47910434-47911033
  misc_feature 1..599: note = Hyper
  source 1..599: mol_type = genomic DNA
ttccagctctagtttcgggaacggatttttccgcgggctagtgggcgcggcgcggcgcagggcggagcgggcaccgcctccttccgtagcggagcgagagctgccgctcgaggctgaggccgctccggaggcctggaggcttcggactgctggactagtggggaaggaaggcggtttcctccgcagcgccccggtgctgcactccgcaccgtcaccttctgggttgtttctggcgctccctctgctctcagcctcgagtcctgggtccctgcggagcgctgtcttttcgctccacgcggactctgagcggaagtcgctcgctgtccgcgactttgcatttctcctgcagcaggggtctctacccggtgccttcctcccggcacgctagcctcctcgccgaaatttcgtcgtcccggagtcggtaaccgagtcccaggctttactgccactccactccctgctgggttatttaagagatacgcggcttccgaggggttttcatcagaccccgcaagtgcgctcggctgggaaggatgcgctccgatgccgctacaggggttccgcgcgtttcaccgcgggaagcccgggcattggagatc

SEQ ID NO: 102621 - DNA, 30 bp, Homo sapiens; identical to SEQ ID NO: 69643
  misc_feature 1..30: note = chr1:47911260-47911290
  misc_feature 1..30: note = Hyper
  source 1..30: mol_type = genomic DNA

SEQ ID NO: 102622 - DNA, 63 bp, Homo sapiens
  misc_feature 1..63: note = chr1:47911816-47911879
  misc_feature 1..63: note = Hyper
  source 1..63: mol_type = genomic DNA
cagttcactgggtgccggctgccccagccagctatggtctgcagagcccgaaggcaggcagga

SEQ ID NO: 102623 - DNA, 30 bp, Homo sapiens; identical to SEQ ID NO: 69645
  misc_feature 1..30: note = chr1:47944568-47944598
  misc_feature 1..30: note = Hypo
  source 1..30: mol_type = genomic DNA

SEQ ID NO: 102624 - DNA, 382 bp, Homo sapiens
  misc_feature 1..382: note = chr1:48058924-48059306
  misc_feature 1..382: note = Hyper
  source 1..382: mol_type = genomic DNA
ccgcacctcctgctccgcggcccgccgccgccagcccggggctgacctctcagagcagggcggaggattttcacagcacagcttcccgagagagcgggattaagggggaactgctcgggtgggccagagccaggggctagggggaggccgggcggaaacccaaaacctccgcagctgtttccagtttgccgccctggctggaccgcggtggctgcgtgcagagcgagcaaggctgcgcgggcctggagcgcccacggggcgcgggacctctctctgtctccccccgccccgcggggctctctctcgtcctctctgtcttggtggggctcagtctgtctctcgttttctctccctgtttctaagatctcgtggaatcaaagac

SEQ ID NO: 102625 - DNA, 51 bp, Homo sapiens; identical to SEQ ID NO: 69647
  misc_feature 1..51: note = chr1:48175121-48175172
  misc_feature 1..51: note = Hyper
  source 1..51: mol_type = genomic DNA

SEQ ID NO: 102626 - DNA, 304 bp, Homo sapiens; identical to SEQ ID NO: 69648
  misc_feature 1..304: note = chr1:48190874-48191178
  misc_feature 1..304: note = Hyper
  source 1..304: mol_type = genomic DNA

SEQ ID NO: 102627 - DNA, 154 bp, Homo sapiens; identical to SEQ ID NO: 69649
  misc_feature 1..154: note = chr1:48247049-48247203
  misc_feature 1..154: note = Hypo
  source 1..154: mol_type = genomic DNA

SEQ ID NO: 102628 - DNA, 338 bp, Homo sapiens; identical to SEQ ID NO: 69650
  misc_feature 1..338: note = chr1:48462159-48462497
  misc_feature 1..338: note = Hyper
  source 1..338: mol_type = genomic DNA

SEQ ID NO: 102629 - DNA, 714 bp, Homo sapiens
  misc_feature 1..714: note = chr1:49242299-49243013
  misc_feature 1..714: note = Hyper
  source 1..714: mol_type = genomic DNA
cttgtggagcaacagcgcgccccagtcgcggggggcgcgcggggggctctcgggcccggcgcccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcgccgggggcgggccccggtcgggcagctcagcccgcggggcgggcgcggaggtggggatccggcggggggcgcgagtctcgctacggtgctggggggggcgggggcggctccccaggacccaggctccccccactgttattgttcctgaaagcaccgttctgccaatcggctgctttcgcctgggcgcggaaaagggagggagggggggaaagggggacgaggggcggatgaggggggtttggaagcgcactgccacttgcaaagtcagacccgagcaatcacagccggagcgcgattcgaatggggagggaaaagggttcagagattcagttgcaataaaaataataacaagagcattgcaggaaaaaaatgcattgattaaaaggtgcgctgcgtgcaggattatattgcttcaacaatcgcgctgccaaattgcattgcaacaaaactgcattgccaagtagagaagtgtatgagtgagtgaatgcgggataggggtggg

SEQ ID NO: 102630 - DNA, 225 bp, Homo sapiens; identical to SEQ ID NO: 69654
  misc_feature 1..225: note = chr1:50489447-50489672
  misc_feature 1..225: note = Hyper
  source 1..225: mol_type = genomic DNA

SEQ ID NO: 102631 - DNA, 601 bp, Homo sapiens; identical to SEQ ID NO: 69655
  misc_feature 1..601: note = chr1:50513629-50514230
  misc_feature 1..601: note = Hyper
  source 1..601: mol_type = genomic DNA

SEQ ID NO: 102632 - DNA, 984 bp, Homo sapiens
  misc_feature 1..984: note = chr1:50798652-50799636
  misc_feature 1..984: note = Hyper
  source 1..984: mol_type = genomic DNA
aaaggccagctggggcgccagacgactcgccctgccccgtcgacgccccagacggtgttgccgacctccgccccgcagcgctggtgtgggcgcggccggacctcactcagcctgcactgccccgcgccgctcgccgcgtccacactgtccttgggaggacgcgcggggaagccgcgcacgatgcggcagcgccccctgccgggctccgggcgctccgctcccagccggctcggcgagtgctccgggaaaggggtccggaccccacacgcactgggttccaggacaggctctcgctcgggctgggccgactctggcccgcctaggccccgggcacgctgcagtgaaggcggtaccctcaccacagtcacagaacgtgtcggctgcccgcgcgtcctcccaaggacagtggacgggagctggggctggagagggtaacgacctgcccaaggtcacacagcaccgcagtggcacagccaggactggcacccacacctcccgcggaaccttgcaggggcccaaaccacctgggttctagagctccttgaactggcctcttgggctttagggaagagctggggacgagggaatggggtggggccacaccacattagcacggacccttgggtgacttgggcggaagacggggcgtcagggccgcctgcgcgcgcgtgacctccaagggtccttctggcgctcctccggcgctgcgtgcggcgctgggctgcggctcacccgacacaccggcggcagccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcctcaaatccgccttcagtaagag

SEQ ID NO: 102633 - DNA, 4730 bp, Homo sapiens
  misc_feature 1..4730: note = chr1:50880848-50885578
  misc_feature 1..4730: note = Hyper
  source 1..4730: mol_type = genomic DNA
aaggtgctagtgtgtcgctgctgctgctgttgtgcaggaggggtggggcggggaagctccccaccagtcggagctacccgcggcggcccgggttcgcatcctcccactgctcagaccgagtcggctccagcttgctttgggaagcattcaggaataaacgtggacagtagcggtcaggaaggagattcccgtttccccttctcccaggaggaaaagaggtaacgctgccgccactgccctctctttccagggtgggaacgccgcccgagaccggggtaccccacactcctccctagcgctgatcccagcggagctcaggccgcagtcccctcctgccggctgcggaagctcccagaagcggagactcaatcgcccccctgcccctgctaccaggccagagtctggagtacagatactggctccctggggcctgggtgtgcgaccccaggccggtcattgcaggtctctgcgcctccctgttcctgactgtgcaatgggcagcgggtcaggggcgcaccgtgggcgcagtacgttcccaggcgccaagggctgtgactgaccgacctgggcttccaccgcggggcctgggccatggagacgctccgggcccaggaacgggggacctcgggtgccccactacctcactcctagaacgcccaccgctcacgaagccttcctgagctctacccgaaggtgctgacagcctggagctgaggccaaggcgcttgggggcacgctgcttctccctgggcctcctatgttcacggaaggagagtttccgcaaacctctcactctcggccagcagaccccgcttcatgagaggaggagacccactaggggcggtggagaggcgaagtgatccagggtcccggaaagttggacaattccctggaccagatggctctcagtttcctcctctgtaaaatggggccggtaataagcaactctctggattcaccccggtttgctgcgaggatgaactaatataatagtctttaagtctgtgacgctccagatgttcttgggaatgagtaacgcgggtccacaggccgccccctcgggtccggccagagcatcggcaggaaccgaggagcctcgggggacccagcgtaggtccttcccgaaaccaacaccttgggtgcggtggggcagaggacggggatgaggcggccggaaccgccctacgaggagaggctgggaggctccgaaaacctggggtagggggagcgcaccggggctttagagggcgcagcggccaagggcaagaaagtttacactcccagaagcttccgcacgctttctcccgcctgcctcttttctttctaactcttccctctcctgtctcctctcgccctcttttttctccttttttatccccttttcgtccatcgctcttgccggcatctttcttctctgggtccttctcccccactttcatctcatcgcgctcgcacttcatcaccagacagccaaaccccctttccaattaaagtggaattaggcaactcaatcaaattagttccccattaaagcccttctttattaaaccgttttcttgtcctgctattaagtttcactgcctggcggaactcgagccggccccagaagtttaccttgggatgtcgccggacccagccgaggggaggagtcattcttttcctggagcgggggagtcaccctgcggggagcgggagggactggaggttgaaggagagggtcggcccaggagcggctaatttgctcagctcggcgtgaggagggaaggtgaaaagggtgagagacgaggtctggctcgaagtcgcgtgctcacggcccctctcccaaattacactttttcaaggaaggcagcatgccacccccaactccccagaaccccataactcccaggctgtagcccttgtcagaagaatggtagcagccaccctgcccagccgtcgccttcgttgcctgtggttccaaatctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgcttcagtgcgcaccttgacggctccttagggacagaccagccgcaggcaagaggggcaggtgggcaggattcatcccgagtttccaatatatttaatctctaaacctgataagtacaatgcgcgcatagtctaatttttttccattttgtccctttttttgcttgttttgaatgtttttcacgttaataccgaggtcacctacagattacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaatttatatttgttagagcgaatatttaaattttttaaaagtgagggctggggagacacagaaaagactctcggattatcctgccatccactgagagccggatgagcacagctaaggagccgcaggagcctgcgctgctgtcgcagcctctgaattctcatgaattcccagccttttggaaagggggccgggtgaggctggaagagggatccggaggtaggagatgaggacccaggccgcgcaccccctccgagaacacctgcacctgtctgtagctgctccccctttgctcagccttccccacccaccctcctaaacaaaacccaaaaaccaccttagagtgagaagacgcccagccagggcgcagagagagcgctgggcgaagaggggtcgatggcccgcgggaacagggctggggttcctgtttggggaccggccggctgccaggcccctcgccctactgcttctccggagcgccgttgaccataggcccgtacaggccgccgccgtaggtcggctccttgtgcaccgccgcagcagcggcggccgagcggtcacgcatgagatcgctaaaggcgtagtccatgggtgggcggaagccgagcgtgggcaccaagccggcagtggagtagggcgccatgaaggccagaccgcggctgtgcgccgccgccgcggagtaggccaggcgcagggggctgaggccgagcggcgcgcccagcgggtaggcgcccgcgtcggcaccgaagtgactggcgttgggctgcagcggcgagaaggccgagcggctgctcagcgagcccagcgccccaggcgccatggcgccggccagcaagggtctgtggtgcggaggtgcggcgggccccgcctgcagcggcgcaggcagcccaggccccccggcggcggcggcggcggcggcggcggcgtcgacgcggctgggccacgcgtcgtctgcagctgctgcagcacccacggcggccttatctgggggcgccgcagggcccaggccggccgccaggcccccacggtggtggttcagcacctgctcgatggcctgcaccacgtcgccgccgcagccctgcaacaccagctccaggacgcctcgccggtggcctgggaacacgcgtgtcaagatatccagcggcgtccgctgccgtggacccgagcctccgcccagccctggcgccggcgcggcctcaccctcttctttgtcagcctctgaaccggattcagagcccagagggctagcggagcccgggctgtcctcctcgccgccgccgccagggccagcgctgcctgggcagctgccacctgcctctttggaggcccgagctaggggcgaaccagaaaaggactcgccatcgccgttctccgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggttagctagaagacagcagtcacagcacctcggccctttggatctcagtttcctctccctcagccccacagcccttattcactaggctccagtgcccctctttctttttgctctagcattccttccgctctgagccccta

SEQ ID NO: 102634 - DNA, 1350 bp, Homo sapiens
  misc_feature 1..1350: note = chr1:50885950-50887300
  misc_feature 1..1350: note = Hyper
  source 1..1350: mol_type = genomic DNA
ctcccaagtttagagcggatccctcctttccctcaacggctctggcctaatttcttccctccccacaaaaagccacgggggtccagaaaaagagggtggtgctaggcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtagcgatgcagcggccgccgcggctgccgccaccgacgccaccgacgccacaggcggccccgtcgctgttgccgccgccgccgtcgccgcgccgggcacgctgggcagctccgagcgcagctccatgacaggacctgacgggaaagaaggtgggagaggggagagacctggtgaggagcacaccgcgcgctaggccaaagcgccgccttgaggaaccc

SEQ ID NO: 102635 - DNA, 30 bp, Homo sapiens; identical to SEQ ID NO: 26294
  misc_feature 1..30: note = chr1:50887723-50887753
  misc_feature 1..30: note = Hyper
  source 1..30: mol_type = genomic DNA

SEQ ID NO: 102636 - DNA, 3258 bp, Homo sapiens
  misc_feature 1..3258: note = chr1:50888226-50891484
  misc_feature 1..3258: note = Hyper
  source 1..3258: mol_type = genomic DNA
gtctggagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctccgggatcctcctcctccgctggcgctgcacgcgcctcccggctccactggcgacgctggagctcttggccgcttccctttgcccccggccccttatctgaccacgtcaccctccttcagtcaccatgtccgaacttccggacccctcagaacgcagcgcagtccaaccctcccttcagaaatccgggtcggaggctcgtctgcgggccgcgtggttggaacccgcgacctgactctcgccgtgccgggtcccctcgcggtgcgcgccggacgctgcgcgcagccggggcccagttgcccggcgctgccagactctcaatgagccgctcgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaagctcagcgaagagaaatgagattgcacttcctgtcggtgcccgccacgtccctcgcgccctgagcctttcctctccccgcccctcttttcgcgtccctcagccccttttgagctctcttttcctcacttttcagcatctcgatttcttttccgtggtggtgggattctttttgtcgttattgcaaatgaacaaatagcccccccccctttttttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctctgattttatctctgtgtcttttcccctctaatttctaaagttctgtttttccctctaattctgtttttccctctaatttctaatgttctgtcactctcgtttttgttctctacttttctctctctccttcagaataaagaaaattcgtttaaataatgaggaaaatgagcgttcctgtcgttctccctccactcttgaccgtgcgtctctgcgttgctctttcgaacctccaggccggcgggaatctgggcgcgcagactcggcccgggtcgtcgcggcctcaggacgcagcccattccgcctggcacgactactgggccgcgtcttgtcagtctatcagcttctgagcccaggaatgggggtgggggaaggacggtgcgactaacgggcccccacccgaagaccgcagaacctggcgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatgatagcgataaaaagctggttactcgctcccagaaaatgccacttgctggagtctgtgaatgggtttaggagagagaagggtgtcagcccccgcgagggtctcccgcgtgaagtgaggataagggagtgcttcagggataatatgtcctctaggagcgcaggacccagaccccaccttccaacacctggaggttccgaggccaagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgcgtgaggaacttcat

SEQ ID NO: 102637 - DNA, 1724 bp, Homo sapiens
  misc_feature 1..1724: note = chr1:50892153-50893877
  misc_feature 1..1724: note = Hyper
  source 1..1724: mol_type = genomic DNA
cacagatttccacctcggtgatagcacacgccgacaggagcacattcttacgcaggtatgccctggtttatgcgcggagctccagtcttacttctacagttgggccccgggcagaaaaagccaaaaccctccgggacaaatgaggcggctgagagcagagggtcttcctcacacatccacacgcgtactcttagctcagaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccaggggcgccgatgggggacccgggaggcattgacttttgcgctgtttgcccgcggcctcggagcaagcagacgccatctgtttgccggctgcgacgcgtcccgtttaattaccctcccggcagcctaatagagatgatattaaactaaatctttctgacattaaaagtaattatccccaaaccggtggctccgggacggaatggcccctcccgcacccaccccttccctggccgcgccggattccgttagtttggctgatactctccgcccgggaatggggcgcagaggaaagggggaaagtgcctttgggagaaggaatctccacgggttgccctacacgcgttttcccgcacaaccacagactctcctgttcctatgtgaacacacgcacgtgtacacacagacacgtagcgacattttcctccagatcaactcatgagtcatgctgatgaagaccctcagccgcgcacaccctctgtggacagggagacgcgcagcttggtttcctgtccccgtcctctgacaccgctaaaatggtcattttccgtggtcatagccacggatctatgccacgacctgggaccgggcataatttcggagccagaaagtactcctgtggtggcgccgggtttctcaggcgctcttccagctaagggccaggagcccagcgatttccctacagttgcttactgaagtcgcaccattctctgcgaggcaggtccgattattccacttgtcaggtgagaaaacagactcggagaggtgagatgacttgttccacattatcacaattagtgagtaacagtgcaaaaatcaaacccgggagtaccctcatccaaagccaggtctgtctgcacagtgcaggcgcagcgggcgctgcgaatcggctcctggcccaatgcacccctccacacccgttggccgggaacccgctggtgctcagcttctatccggaccccggacctaaaggccgggcagaacaaccaactgaaggtggaggagcgagggcactggtgctgattgagcggcaggagcccccgaggcggagtcccagcggctgcagccctcctttggatcaagccctcgcgtcttccgggcaggcggaagggaggcgtctgcccagtgtcgccaggcttctcacgattttctggttgggagcatctaagcctgagacaaacgcatggagagcggtgttcaccgccccactatttgtttctatttgtgagcgtctactgagtacagccactctgataaacactcggtgtgtgctctct

SEQ ID NO: 102638 - DNA, 379 bp, Homo sapiens; identical to SEQ ID NO: 69674
  misc_feature 1..379: note = chr1:50896073-50896452
  misc_feature 1..379: note = Hyper
  source 1..379: mol_type = genomic DNA

SEQ ID NO: 102639 - DNA, 30 bp, Homo sapiens; identical to SEQ ID NO: 38979
  misc_feature 1..30: note = chr1:50918985-50919015
  misc_feature 1..30: note = Hypo
  source 1..30: mol_type = genomic DNA

SEQ ID NO: 102640 - DNA, 225 bp, Homo sapiens; identical to SEQ ID NO: 69676
  misc_feature 1..225: note = chr1:51099269-51099494
  misc_feature 1..225: note = Hypo
  source 1..225: mol_type = genomic DNA

SEQ ID NO: 102641 - DNA, 20 bp, Homo sapiens
  misc_feature 1..20: note = chr1:51176289-51176309
  misc_feature 1..20: note = Hypo
  source 1..20: mol_type = genomic DNA
ttcgagacagagtctcgctc

SEQ ID NO: 102642 - DNA, 30 bp, Homo sapiens; identical to SEQ ID NO: 69678
  misc_feature 1..30: note = chr1:51439947-51439977
  misc_feature 1..30: note = Hypo
  source 1..30: mol_type = genomic DNA

SEQ ID NO: 102643 - DNA, 481 bp, Homo sapiens; identical to SEQ ID NO: 69679
  misc_feature 1..481: note = chr1:51442325-51442806
  misc_feature 1..481: note = Hyper
  source 1..481: mol_type = genomic DNA

SEQ ID NO: 102644 - DNA, 35 bp, Homo sapiens; identical to SEQ ID NO: 69680
  misc_feature 1..35: note = chr1:51727596-51727631
  misc_feature 1..35: note = Hypo
  source 1..35: mol_type = genomic DNA

SEQ ID NO: 102645 - DNA, 159 bp, Homo sapiens; identical to SEQ ID NO: 69681
  misc_feature 1..159: note = chr1:51761751-51761910
  misc_feature 1..159: note = Hypo
  source 1..159: mol_type = genomic DNA

SEQ ID NO: 102646 - DNA, 209 bp, Homo sapiens; identical to SEQ ID NO: 69682
  misc_feature 1..209: note = chr1:51763180-51763389
  misc_feature 1..209: note = Hypo
  source 1..209: mol_type = genomic DNA

SEQ ID NO: 102647 - DNA, 213 bp, Homo sapiens; identical to SEQ ID NO: 38985
  misc_feature 1..213: note = chr1:51795524-51795737
  misc_feature 1..213: note = Hypo
  source 1..213: mol_type = genomic DNA

SEQ ID NO: 102648 - DNA, 42 bp, Homo sapiens
  misc_feature 1..42: note = chr1:51810611-51810653
  misc_feature 1..42: note = Hyper
  source 1..42: mol_type = genomic DNA
ccccttggtcccgtccgcgccttccgccgagtccccacccct

SEQ ID NO: 102649 - DNA, 30 bp, Homo sapiens; identical to SEQ ID NO: 69685
  misc_feature 1..30: note = chr1:52068030-52068060
  misc_feature 1..30: note = Hypo
  source 1..30: mol_type = genomic DNA

SEQ ID NO: 102650 - DNA, 37 bp, Homo sapiens; identical to SEQ ID NO: 69686
  misc_feature 1..37: note = chr1:52084092-52084129
  misc_feature 1..37: note = Hypo
  source 1..37: mol_type = genomic DNA

SEQ ID NO: 102651 - DNA, 37 bp, Homo sapiens; identical to SEQ ID NO: 69687
  misc_feature 1..37: note = chr1:52094622-52094659
  misc_feature 1..37: note = Hypo
  source 1..37: mol_type = genomic DNA

SEQ ID NO: 102652 - DNA, 45 bp, Homo sapiens
  misc_feature 1..45: note = chr1:52194923-52194968
  misc_feature 1..45: note = Hyper
  source 1..45: mol_type = genomic DNA
ctccatcaacccccacgcgacacaactttccggaagtaagcaaaa

SEQ ID NO: 102653 - DNA, 128 bp, Homo sapiens; identical to SEQ ID NO: 38986
  misc_feature 1..128: note = chr1:52455042-52455170
  misc_feature 1..128: note = Hypo
  source 1..128: mol_type = genomic DNA

SEQ ID NO: 102654 - DNA, 117 bp, Homo sapiens; identical to SEQ ID NO: 69691
  misc_feature 1..117: note = chr1:52456223-52456340
  misc_feature 1..117: note = Hyper
  source 1..117: mol_type = genomic DNA

SEQ ID NO: 102655 - DNA, 39 bp, Homo sapiens; identical to SEQ ID NO: 69692
  misc_feature 1..39: note = chr1:52524541-52524580
  misc_feature 1..39: note = Hypo
  source 1..39: mol_type = genomic DNA

SEQ ID NO: 102656 - DNA, 80 bp, Homo sapiens; identical to SEQ ID NO: 69693
  misc_feature 1..80: note = chr1:52832632-52832712
  misc_feature 1..80: note = Hypo
  source 1..80: mol_type = genomic DNA

SEQ ID NO: 102657 - DNA, 796 bp, Homo sapiens
  misc_feature 1..796: note = chr1:53067865-53068661
  misc_feature 1..796: note = Hyper
  source 1..796: mol_type = genomic DNA
cctggctctggggtccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgattcggagtccagtgaag

SEQ ID NO: 102658 - DNA, 707 bp, Homo sapiens
  misc_feature 1..707: note = chr1:53098659-53099366
  misc_feature 1..707: note = Hyper
  source 1..707: mol_type = genomic DNA
tgtctgccccagccccgaatgccccgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttcgtctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtggtgcgcggcttcagctgcccgcggccggggggcgaggcggccgctgtcttctgctgcggcttccgcgaccacaagtactgctgcgacgacccgcacagcttcttcccctacgagcacagctacatgtggtggctcaggtaccgtccctggccctca

SEQ ID NO: 102659 - DNA, 32 bp, Homo sapiens; identical to SEQ ID NO: 69698
  misc_feature 1..32: note = chr1:53129138-53129170
  misc_feature 1..32: note = Hypo
  source 1..32: mol_type = genomic DNA

SEQ ID NO: 102660 - DNA, 368 bp, Homo sapiens; identical to SEQ ID NO: 69699
  misc_feature 1..368: note = chr1:53168827-53169195
  misc_feature 1..368: note = Hyper
  source 1..368: mol_type = genomic DNA

SEQ ID NO: 102661 - DNA, 1007 bp, Homo sapiens
  misc_feature 1..1007: note = chr1:53308268-53309275
  misc_feature 1..1007: note = Hyper
  source 1..1007: mol_type = genomic DNA
gggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctgacgctcagaaggatgccctgggctgctgcgtggtacaggtgagcaccggggtgcgggcggcgacgcggacctcggcgccacgtccagctccggcgagcgcggcgagtctcctgggacgctgccgaggcacttgctggggagtgtggcccgcgcggggctgcggtctagatgccgagccccttccaggcgcaggcgtcgctgcggaggtgcgttgtcgggggaggcggcctgggcgccgcggagcggggggtgcttttctgcgcccggcgaagcgcgtggaacttgcgccctgaggcagcgcggcgagagcccagtcccagagaccggggcgagcctcctcaggattcctcgccccagtgcgggctgctgtgagcttagacgtaggtgcagggcatggcactcggcttggcccgtagtggacggtgtttttgcagtcatgaacccaaacgccgcaaaccttgaccgtttccccacccgtgttgtggacgcagcgccccgcggaggcggtgaccctttggccgttaccacctgaggcctttgggcccggggccgggcgagtagcttagtccggctgggggaactggaacccgaagtctgagattctttcagttccgcgcgtccgcccccgtccccgtcccgtccccagcctttgccgaatgcctgttact

SEQ ID NO: 102662 - DNA, 30 bp, Homo sapiens; identical to SEQ ID NO: 69702
  misc_feature 1..30: note = chr1:53392828-53392858
  misc_feature 1..30: note = Hyper
  source 1..30: mol_type = genomic DNA

SEQ ID NO: 102663 - DNA, 39 bp, Homo sapiens; identical to SEQ ID NO: 69703
  misc_feature 1..39: note = chr1:53479895-53479934
  misc_feature 1..39: note = Hypo
  source 1..39: mol_type = genomic DNA

SEQ ID NO: 102664 - DNA, 136 bp, Homo sapiens; identical to SEQ ID NO: 69704
  misc_feature 1..136: note = chr1:53527470-53527606
  misc_feature 1..136: note = Hyper
  source 1..136: mol_type = genomic DNA

SEQ ID NO: 102665 - DNA, 970 bp, Homo sapiens
  misc_feature 1..970: note = chr1:53527817-53528787
  misc_feature 1..970: note = Hyper
  source 1..970: mol_type = genomic DNA
ggggcgggagagaggcggggaggagaaaacccacaacaaaacttgcgtcgcggagagcgcccagcttgacttgaatggaaggagcccgagcccgcggagcgcagctgagactgggggagcgcgttcggcctgtggggcgccgctcggcgccggggcgcagcaggtacagggcgctggcagccggggtgggccgaggggccgggggctgagcccgggcagcgcactcagacgtccccgcctctccggatggctccagcagctgcctggggcgggcccgccgcatctcaccccctctgtaggaccctgcacccagggcacggccggagatctcctcctctggagtgcgacccctgcgcagtcaggacccaggcaggggccttctcctctctgagcagaggctggtccccgtccccaggcccctcccgctgcgcacatctggaaagaatctgagggcggttgggggcgggggctggagtgggaggacgccggcgggcgacagggaatgtggggggcaggtggaactgcgtaggggcggggacccctgtcatgagagcctgggcccgaagtatccccgcgtctttccacgtcaactcatcaggccccctagcgactccaacctccacctctttatagatagagaaactgaggcccagagaggggcagaggtctggccccagggcgcgtcggacgccgggtgggtcccctccggggctcggcttccccggccactgtgccgccccagcttagtgccaaccactagttgagctaaaggtctcagctggcggtctggagtccgtctatctgtctacgcggctgcttcccagccgggacagctggagggaggaaggggtgggggtccgcgaagcgcgaggagcgagatccgcgccttcctgcgaatgaggcagaagccccaggttccaggtccccgagccacagcccggcctggggcgggggacgagatcttggcgtt

SEQ ID NO: 102666 - DNA, 30 bp, Homo sapiens; identical to SEQ ID NO: 69707
  misc_feature 1..30: note = chr1:53561195-53561225
  misc_feature 1..30: note = Hypo
  source 1..30: mol_type = genomic DNA

SEQ ID NO: 102667 - DNA, 30 bp, Homo sapiens; identical to SEQ ID NO: 69708
  misc_feature 1..30: note = chr1:53573022-53573052
  misc_feature 1..30: note = Hypo
  source 1..30: mol_type = genomic DNA

SEQ ID NO: 102668 - DNA, 24 bp, Homo sapiens
  misc_feature 1..24: note = chr1:53703048-53703072
  misc_feature 1..24: note = Hypo
  source 1..24: mol_type = genomic DNA
aaaaccttccaagcccggccgggc

SEQ ID NO: 102669 - DNA, 27 bp, Homo sapiens
  misc_feature 1..27: note = chr1:53705674-53705701
  misc_feature 1..27: note = Hypo
  source 1..27: mol_type = genomic DNA
tcagtcttaacacggagtccttttctc

SEQ ID NO: 102670 - DNA, 102 bp, Homo sapiens; identical to SEQ ID NO: 69711
  misc_feature 1..102: note = chr1:53990535-53990637
  misc_feature 1..102: note = Hypo
  source 1..102: mol_type = genomic DNA

SEQ ID NO: 102671 - DNA, 38 bp, Homo sapiens; identical to SEQ ID NO: 69712
  misc_feature 1..38: note = chr1:54142594-54142632
  misc_feature 1..38: note = Hypo
  source 1..38: mol_type = genomic DNA

SEQ ID NO: 102672 - DNA, 1271 bp, Homo sapiens
  misc_feature 1..1271: note = chr1:54203433-54204704
  misc_feature 1..1271: note = Hyper
  source 1..1271: mol_type = genomic DNA
aatctccacaggagccgccaggcacgttggcagggccgaactcacccttcccggcggcggcggccttggatggaccgtagtctcggggactgcggggccggaggaggtcgtgggcgcgcggtggcggcgcaggcggccgggctagcaggtcccgcgggcccctgtccccgcagccgccgccactcacggtgaccctgaaggccatgtgcgcgccgaggctggcggggccgcggtcggggccgggcgcaccaggggcctccttaggcctcttgtccgagtgtgcctcagccacctcgcaatgcatggcgccggggcggggcgcacggctgggggtcgcgccgggctcctggggaggggagacagcacagccagttagaatgcggaaagcggcccccgtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaacaggagtcccaagctgggcgctgaatcctgcgacgcgaacccatcacgcgcagccgggacacccacattcctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgctccctgcgccatccccaagctgccggggttcgagcgtc

SEQ ID NO: 102673 - DNA, 43 bp, Homo sapiens; identical to SEQ ID NO: 69714
  misc_feature 1..43: note = chr1:54530324-54530367
  misc_feature 1..43: note = Hypo
  source 1..43: mol_type = genomic DNA

SEQ ID NO: 102674 - DNA, 407 bp, Homo sapiens; identical to SEQ ID NO: 14242
  misc_feature 1..407: note = chr1:54586590-54586997
  misc_feature 1..407: note = Hypo
  source 1..407: mol_type = genomic DNA

SEQ ID NO: 102675 - DNA, 119 bp, Homo sapiens
  misc_feature 1..119: note = chr1:54587510-54587629
  misc_feature 1..119: note = Hyper
  source 1..119: mol_type = genomic DNA
gacgcgcaggcagcacgcacaggccgcctctttctccaggcatagtcgtactcacacgcactctcccgcccacccagaccccagatcccccgacactcacagcacggcaggagcatagg

SEQ ID NO: 102676 - DNA, 30 bp, Homo sapiens; identical to SEQ ID NO: 69719
  misc_feature 1..30: note = chr1:54683784-54683814
  misc_feature 1..30: note = Hypo
  source 1..30: mol_type = genomic DNA

SEQ ID NO: 102677 - DNA, 30 bp, Homo sapiens; identical to SEQ ID NO: 69720
  misc_feature 1..30: note = chr1:54712302-54712332
  misc_feature 1..30: note = Hypo
  source 1..30: mol_type = genomic DNA

SEQ ID NO: 102678 - DNA, 186 bp, Homo sapiens; identical to SEQ ID NO: 69721
  misc_feature 1..186: note = chr1:54722666-54722852
  misc_feature 1..186: note = Hypo
  source 1..186: mol_type = genomic DNA

SEQ ID NO: 102679 - DNA, 30 bp, Homo sapiens; identical to SEQ ID NO: 69722
  misc_feature 1..30: note = chr1:54757013-54757043
  misc_feature 1..30: note = Hypo
  source 1..30: mol_type = genomic DNA

SEQ ID NO: 102680 - DNA, 35 bp, Homo sapiens; identical to SEQ ID NO: 69723
  misc_feature 1..35: note = chr1:54757429-54757464
  misc_feature 1..35: note = Hypo
  source 1..35: mol_type = genomic DNA

SEQ ID NO: 102681 - DNA, 52 bp, Homo sapiens; identical to SEQ ID NO: 69724
  misc_feature 1..52: note = chr1:54766254-54766306
  misc_feature 1..52: note = Hypo
  source 1..52: mol_type = genomic DNA

SEQ ID NO: 102682 - DNA, 30 bp, Homo sapiens; identical to SEQ ID NO: 69725
  misc_feature 1..30: note = chr1:54808954-54808984
  misc_feature 1..30: note = Hypo
  source 1..30: mol_type = genomic DNA

SEQ ID NO: 102683 - DNA, 30 bp, Homo sapiens; identical to SEQ ID NO: 69726
  misc_feature 1..30: note = chr1:54814665-54814695
  misc_feature 1..30: note = Hypo
  source 1..30: mol_type = genomic DNA

SEQ ID NO: 102684 - DNA, 33 bp, Homo sapiens; identical to SEQ ID NO: 38995
  misc_feature 1..33: note = chr1:54839900-54839933
  misc_feature 1..33: note = Hypo
  source 1..33: mol_type = genomic DNA

SEQ ID NO: 102685 - DNA, 20 bp, Homo sapiens
  misc_feature 1..20: note = chr1:54849481-54849501
  misc_feature 1..20: note = Hypo
  source 1..20: mol_type = genomic DNA
ataaaaagcaagaaccggcc

SEQ ID NO: 102686 - DNA, 17 bp, Homo sapiens
  misc_feature 1..17: note = chr1:54880702-54880719
  misc_feature 1..17: note = Hypo
  source 1..17: mol_type = genomic DNA
cccggccacgtagagca

SEQ ID NO: 102687 - DNA, 373 bp, Homo sapiens; identical to SEQ ID NO: 69730
  misc_feature 1..373: note = chr1:54940331-54940704
  misc_feature 1..373: note = Hyper
  source 1..373: mol_type = genomic DNA

SEQ ID NO: 102688 - DNA, 23 bp, Homo sapiens
  misc_feature 1..23: note = chr1:55231044-55231067
  misc_feature 1..23: note = Hypo
  source 1..23: mol_type = genomic DNA
tttgtttttttgagacggagttt

SEQ ID NO: 102689 - DNA, 65 bp, Homo sapiens; identical to SEQ ID NO: 69732
  misc_feature 1..65: note = chr1:55446357-55446422
  misc_feature 1..65: note = Hyper
  source 1..65: mol_type = genomic DNA

SEQ ID NO: 102690 - DNA, 63 bp, Homo sapiens; identical to SEQ ID NO: 69734
  misc_feature 1..63: note = chr1:55462125-55462188
  misc_feature 1..63: note = Hyper
  source 1..63: mol_type = genomic DNA

SEQ ID NO: 102691 - DNA, 261 bp, Homo sapiens; identical to SEQ ID NO: 69735
  misc_feature 1..261: note = chr1:55462673-55462934
  misc_feature 1..261: note = Hyper
  source 1..261: mol_type = genomic DNA

SEQ ID NO: 102692 - DNA, 117 bp, Homo sapiens; identical to SEQ ID NO: 69736
  misc_feature 1..117: note = chr1:55505045-55505162
  misc_feature 1..117: note = Hyper
  source 1..117: mol_type = genomic DNA

SEQ ID NO: 102693 - DNA, 43 bp, Homo sapiens; identical to SEQ ID NO: 69737
  misc_feature 1..43: note = chr1:55505516-55505559
  misc_feature 1..43: note = Hyper
  source 1..43: mol_type = genomic DNA

SEQ ID NO: 102694 - DNA, 155 bp, Homo sapiens; identical to SEQ ID NO: 69738
  misc_feature 1..155: note = chr1:55529091-55529246
  misc_feature 1..155: note = Hypo
  source 1..155: mol_type = genomic DNA

SEQ ID NO: 102695 - DNA, 32 bp, Homo sapiens; identical to SEQ ID NO: 69739
  misc_feature 1..32: note = chr1:55731721-55731753
  misc_feature 1..32: note = Hypo
  source 1..32: mol_type = genomic DNA

SEQ ID NO: 102696 - DNA, 184 bp, Homo sapiens; identical to SEQ ID NO: 69741
  misc_feature 1..184: note = chr1:56943121-56943305
  misc_feature 1..184: note = Hyper
  source 1..184: mol_type = genomic DNA

SEQ ID NO: 102697 - DNA, 30 bp, Homo sapiens
  misc_feature 1..30: note = chr1:57110648-57110678
  misc_feature 1..30: note = Hyper
  source 1..30: mol_type = genomic DNA
gcctcctgcctccctcggcaccctcgccta

SEQ ID NO: 102698 - DNA, 616 bp, Homo sapiens; identical to SEQ ID NO: 69743
  misc_feature 1..616: note = chr1:57110882-57111498
  misc_feature 1..616: note = Hyper
  source 1..616: mol_type = genomic DNA

SEQ ID NO: 102699 - DNA, 221 bp, Homo sapiens; identical to SEQ ID NO: 69744
  misc_feature 1..221: note = chr1:57224849-57225070
  misc_feature 1..221: note = Hypo
  source 1..221: mol_type = genomic DNA

SEQ ID NO: 102700 - DNA, 30 bp, Homo sapiens; identical to SEQ ID NO: 69745
  misc_feature 1..30: note = chr1:57687138-57687168
  misc_feature 1..30: note = Hypo
  source 1..30: mol_type = genomic DNA

SEQ ID NO: 102701 - DNA, 303 bp, Homo sapiens; identical to SEQ ID NO: 69747
  misc_feature 1..303: note = chr1:57887764-57888067
  misc_feature 1..303: note = Hyper
  source 1..303: mol_type = genomic DNA

SEQ ID NO: 102702 - DNA, 2288 bp, Homo sapiens
  misc_feature 1..2288: note = chr1:57888297-57890585
  misc_feature 1..2288: note = Hyper
  source 1..2288: mol_type = genomic DNA
gcctccccacccccacgccattccttcagactctcccagcctaagcggaagtgccccagcagacccccaacaatgaggatttgtgcgatgcagttgggggttgggggtagttcacacggagtgaaacgtacacagtctggcgggtctgggagcagccaagtggcgtccgcctctccaggcagcgatcccttgtgcccactgccccccatcaggcccaccagcaccaccaaaaaacaaaaacagagaaaagaaaaagcgccttaaaaagtgcagagaaaagatgcgccctcccaccaggggtcacaataatactcctcgggacgcagccagcggaggcagggtcctggctgcagcagccaccctggttttgaaatttactttgtacactcacccagtggcccctttcagacgccgcgacacgacctccccccatctcggactccctgcctctgggttctctcggcggttgacaccctcttgtgtgcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagaggatccgaagaaaggccggggtccgaggaacgcgggatccagttctcacggtgcccgcgaaagggctgggattactgggatagagtcggtttttcgagaggtcgaagccgaatctcagcgctacggaggagtagggaagtgagaacggggttcggccgaatgaggaaaagggtctggccaccagcgagggagggagggagtttcgggagcccaggacagcgggagaaggcaggctcgaggtccgatatagccaggaccgcaggaggaaagagggcgcagggggtcttggagagagacgcgtgtcaggggtggacaagtctggagacaggatcgcgcgtggtcggaagtagggagacaggggcgcggggatggggggcaggacagagaaagagaagtcgcccttttcctcccagcaagtggagggagaaggcgaaaaactgctgcagtcgccatcctcccagcacccctagccaaactgctgagtggcgcgtcccaggagccctcctccgcgccccggggctccagcgaagcctcctggctccccggcgccctgtcctcgcggggcacctgcggcgctgaactcaagggttgccgcgcgcccccgccgcgcctcacctcgcctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgggggcgccgcggcttgcagtcgcgcctctggagcccctgcactctctctccatcccagcgtggaagggggagagacgagccgagagcgaggggtccccgccccagccgcgccagcgtggagagggtaagggaggggggttgtcacaaagtatccagtgttttctcccccatcaccaccactggacgcagctccgcctggcctctctcatttttctctaagatctacccttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 102703 - DNA, 1118 bp, Homo sapiens
  misc_feature 1..1118: note = chr1:58715153-58716271
  misc_feature 1..1118: note = Hyper
  source 1..1118: mol_type = genomic DNA
cagaaagaaagcatgcgtccggatggcgggagggttaaaattacagtctttgggtaagacccctggccagcttgcctggtttctagatacataagtggacagaaaagaaatgaagagaacgcggactgagcgaggaaatgctcaagaccacaggactgaaccccccggaagtctcgacgctgcccagccagccagagtccagtcgtcgacgcggatgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggcggccctcgcctgcgcctttgcgcgccacccaaaactttgcgcacactgcagccgccgccttcccgctcttcgcggtgagacgcgcgccgccaagtgccgcaggcagccctccacagccgccgcggcagccgctgcctggcttctggctccagacttttcccccactgcctccagttcccacccaggaggctccctcgcggccgcgagagctcggcgcccgacccacagtaggcagtgcgggcacagtgttgcagaccaccacctcgccaggtccgggcagcgcccactagacggacaggcgcccgcggccgcccctaccccggcgcgcccacctcgagcctctcacgccgcggcgggcgggcgcaacatattctcctacctccagccgccgaggaccacactctccgctcagccctctcgactcatcctccggctgcagtagagggcgagcgggctccgcttttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagcccctcagcatttcgccacctagcgcgg

SEQ ID NO: 102704 - DNA, 30 bp, Homo sapiens; identical to SEQ ID NO: 69756
  misc_feature 1..30: note = chr1:58721839-58721869
  misc_feature 1..30: note = Hypo
  source 1..30: mol_type = genomic DNA

SEQ ID NO: 102705 - DNA, 508 bp, Homo sapiens
  misc_feature 1..508: note = chr1:59042049-59042557
  misc_feature 1..508: note = Hyper
  source 1..508: mol_type = genomic DNA
taatagatgagcgtgcgctccacctgcaggggttctccgcgcacgcgcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggccctcggggtcgcagtcggggtcgtagaggccatcgttgtccacgagcgcgtgctcactcggcc

SEQ ID NO: 102706 - DNA, 51 bp, Homo sapiens; identical to SEQ ID NO: 69761
  misc_feature 1..51: note = chr1:59348317-59348368
  misc_feature 1..51: note = Hypo
  source 1..51: mol_type = genomic DNA

SEQ ID NO: 102707 - DNA, 455 bp, Homo sapiens; identical to SEQ ID NO: 69762
  misc_feature 1..455: note = chr1:59612368-59612823
  misc_feature 1..455: note = Hyper
  source 1..455: mol_type = genomic DNA

SEQ ID NO: 102708 - DNA, 209 bp, Homo sapiens; identical to SEQ ID NO: 69766
  misc_feature 1..209: note = chr1:60662398-60662607
  misc_feature 1..209: note = Hypo
  source 1..209: mol_type = genomic DNA

SEQ ID NO: 102709 - DNA, 37 bp, Homo sapiens; identical to SEQ ID NO: 69770
  misc_feature 1..37: note = chr1:61339518-61339555
  misc_feature 1..37: note = Hypo
  source 1..37: mol_type = genomic DNA

SEQ ID NO: 102710 - DNA, 267 bp, Homo sapiens; identical to SEQ ID NO: 69772
  misc_feature 1..267: note = chr1:61508687-61508954
  misc_feature 1..267: note = Hyper
  source 1..267: mol_type = genomic DNA

SEQ ID NO: 102711 - DNA, 340 bp, Homo sapiens
  misc_feature 1..340: note = chr1:61519364-61519704
  misc_feature 1..340: note = Hyper
  source 1..340: mol_type = genomic DNA
gagaacgaggccgtccgggctaggttcccggggctcaaagacgcaaagggaaggcgacaaaggtttctcacaggtcgccgttagggagagggggcagcgcaggaaacccgtttatttaaagttcagttgtgttgggcatctgatccaggacaactcgcccaggagcccggcgggtttcagctgccaccacgaaagtaaggatcggttctgccgcgtcgccccctccttccccttgggatgtgccaggcgggcgacagataagggggcgcggcgcggggtcagccaccgagccagagggcggcgcccggttgcagcgctccacagccgcctcctgcagcct

SEQ ID NO: 102712 - DNA, 77 bp, Homo sapiens; identical to SEQ ID NO: 69775
  misc_feature 1..77: note = chr1:61541784-61541861
  misc_feature 1..77: note = Hypo
  source 1..77: mol_type = genomic DNA

SEQ ID NO: 102713 - DNA, 102 bp, Homo sapiens; identical to SEQ ID NO: 26338
  misc_feature 1..102: note = chr1:61549208-61549310
  misc_feature 1..102: note = Hyper
  source 1..102: mol_type = genomic DNA

SEQ ID NO: 102714 - DNA, 48 bp, Homo sapiens; identical to SEQ ID NO: 69777
  misc_feature 1..48: note = chr1:61555978-61556026
  misc_feature 1..48: note = Hypo
  source 1..48: mol_type = genomic DNA

SEQ ID NO: 102715 - DNA, 16 bp, Homo sapiens
  misc_feature 1..16: note = chr1:61653734-61653750
  misc_feature 1..16: note = Hypo
  source 1..16: mol_type = genomic DNA
gttgagacagagtctc

SEQ ID NO: 102716 - DNA, 147 bp, Homo sapiens; identical to SEQ ID NO: 69784
  misc_feature 1..147: note = chr1:62189753-62189900
  misc_feature 1..147: note = Hypo
  source 1..147: mol_type = genomic DNA

SEQ ID NO: 102717 - DNA, 73 bp, Homo sapiens; identical to SEQ ID NO: 69785
  misc_feature 1..73: note = chr1:62207769-62207842
  misc_feature 1..73: note = Hyper
  source 1..73: mol_type = genomic DNA

SEQ ID NO: 102718 - DNA, 22 bp, Homo sapiens
  misc_feature 1..22: note = chr1:62657668-62657690
  misc_feature 1..22: note = Hypo
  source 1..22: mol_type = genomic DNA
attctttttctttttcgagacg

SEQ ID NO: 102719 - DNA, 291 bp, Homo sapiens; identical to SEQ ID NO: 69792
  misc_feature 1..291: note = chr1:62784355-62784646
  misc_feature 1..291: note = Hyper
  source 1..291: mol_type = genomic DNA

SEQ ID NO: 102720 - DNA, 308 bp, Homo sapiens; identical to SEQ ID NO: 69793
  misc_feature 1..308: note = chr1:62784870-62785178
  misc_feature 1..308: note = Hyper
  source 1..308: mol_type = genomic DNA

SEQ ID NO: 102721 - DNA, 30 bp, Homo sapiens; identical to SEQ ID NO: 69794
  misc_feature 1..30: note = chr1:62793243-62793273
  misc_feature 1..30: note = Hypo
  source 1..30: mol_type = genomic DNA

SEQ ID NO: 102722 - DNA, 553 bp, Homo sapiens; identical to SEQ ID NO: 69802
  misc_feature 1..553: note = chr1:63539428-63539981
  misc_feature 1..553: note = Hyper
  source 1..553: mol_type = genomic DNA

SEQ ID NO: 102723 - DNA, 30 bp, Homo sapiens; identical to SEQ ID NO: 69804
  misc_feature 1..30: note = chr1:63783677-63783707
  misc_feature 1..30: note = Hyper
  source 1..30: mol_type = genomic DNA

SEQ ID NO: 102724 - DNA, 325 bp, Homo sapiens; identical to SEQ ID NO: 69805
  misc_feature 1..325: note = chr1:63784115-63784440
  misc_feature 1..325: note = Hyper
  source 1..325: mol_type = genomic DNA

SEQ ID NO: 102725 - DNA, 86 bp, Homo sapiens; identical to SEQ ID NO: 69806
  misc_feature 1..86: note = chr1:63784701-63784787
  misc_feature 1..86: note = Hyper
  source 1..86: mol_type = genomic DNA

SEQ ID NO: 102726 - DNA, 1408 bp, Homo sapiens
  misc_feature 1..1408: note = chr1:63784987-63786395
  misc_feature 1..1408: note = Hyper
  source 1..1408: mol_type = genomic DNA
ctctcctgggaagttcgcttgttgagactcaaagagtcactcaaactcataattgcgtgtgtgtgtctactcattctccctctatctctccaataaccctttgagactcagaaactttttatccacatacaccctttatcacattttcttccccccactacatgtgtctcactttctctctgtatctgtctcgcttcttccgtctctgtcctacagcttggcggtaactgacgacctgtgagcttttagctgcaaactgcaactacgcggcaaacaatttatttagcccgacatctagccggtctccggcaggaccctgcaccgcgtcgggatcggacccttccgctggggcggcctcctgcgtcaaggccagcaggaaccttcctgtcgccctccccggccgccgcttcgcctccttcccgcccccggaggttgtgcaggcgctatggtccgcctggagggagaaagccggcggccggttcctgagccgagagcggccgcggaaaaatcctctgcctccgctggaaatcgatattaggccggcgcgggcgcgggacgtcggggccgcagccagtaggttgtgcacgtctcatcatttagctaatcgagtcgaaaagtttctgtaagggccggacccagcatcagatggtaacactgattgaacaagagattagcacaatagatctctaaccgaggggaagcgttgcttttcacgctacgcgccgtaattaatggtatgaatcaattaatttgacttttattgtgtcgaaggaaaaaagcgcaacaaatggaaccggcagctgggagttgttcgtcctccacccccttccccagggaggttccaaggagacaccggggaatggacggatcaggctgggccgtggcagagggagggtaggaggcagcgaccagcagcgtggagggagtccagagagctagcctctgcggacggcggaatcgaaattaggctcatttggagactacttcgagaccggtgaggggagccctgtagccaccatcctccggcgcgcatccacacatactagtccacgcgggcccagccaccaaggccgcggcagggccagcgctgcgccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctgtggagctacggaaatcaactctgagatgcgttttagggccgtgtgcaacctcgggatcatttagat

SEQ ID NO: 102727 - DNA, 3812 bp, Homo sapiens
  misc_feature 1..3812: note = chr1:63786656-63790468
  misc_feature 1..3812: note = Hyper
  source 1..3812: mol_type = genomic DNA
gcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactgacttgccttgcactccgcgtgcattggccacacatcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcccgcacccctcacgtttcttcagccgcccctgggcgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggtaggacctgagtggtttggttgggggagggggaaaaagacatctcagcaggtgtcttccccggaatgagcactgaggccagaggggaatctgaaatctaattagcaggagggagccgggtgcgctgctcttactctttaaagctaaaaacaatgaaacaaaaagcaaaacagagactaagttttgctttttaaaacacgatatgggaacctcgttctaggtcgcccagtccctgtctaaggagtgtgacaaagtgggggggagaagggcggaagggagagggggcggggaaggcagggcagcgacagtcgcacagtcccgcggacgctcccaggcccacgccctgactcgctcacacccacccacactcacacccacccgctccctgggccccagggcccggatccagcctgggtgggggggtctccgggcgggccgcagcgccctccgtgccccggggatgctggcgcacagtgcggagcggagttgcgcgtctctcgtccctttgttgacaattccctgaaccaacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaatagggacgcgccaatggccgggacccagggtccggcggcggcctcgagcaacaaatgcacctccaggctgcgcgccctgtcccaagcccggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagta

SEQ ID NO: 102728 - DNA, 39 bp, Homo sapiens; identical to SEQ ID NO: 69816
  misc_feature 1..39: note = chr1:63791977-63792016
  misc_feature 1..39: note = Hyper
  source 1..39: mol_type = genomic DNA

SEQ ID NO: 102729 - DNA, 523 bp, Homo sapiens
  misc_feature 1..523: note = chr1:63792549-63793072
  misc_feature 1..523: note = Hyper
  source 1..523: mol_type = genomic DNA
acttataaaattactcgctcatatttccgcgcatagcagcaataccggccgagcctgcgccagcagcgtgacactcagccacaagccaccgccggagactcgcagggctttttccagcgctacattcattaggcggcggggtgaacgggagagacctgccggcaactttccttccagccagttcttacccttgaacgacggcctaaagatggtccccttcctttatgtcgtggaaggcaggaaactctcggacccagaccctcaagctgccagcggttgtttaaagtcctggcagatgtcaggaagatgggcccggccgtcgcaccctcaaaagctctttttcgtttaagctttttaaacctcgaagatttagcacaaaatgggaaatgcaaatatcatagacaatgatcgcaagcacttagtggtggggctgggggaagcctgaaacccttgtttgatgttatggaacgcaggcacctgcgacaaacggcactggaaacagctctctcgttgagatttaaag

SEQ ID NO: 102730 - DNA, 307 bp, Homo sapiens
  misc_feature 1..307: note = chr1:63793338-63793645
  misc_feature 1..307: note = Hyper
  source 1..307: mol_type = genomic DNA
gtggatctggatgtccggggaaaggcgaatgaagagtagagcaaaacatgtgccggctgttgagggctgtcgatgcgatggcagatgtggcctgtagggggcgacgagcagacggaaaacttcgcggtttgtctggaatggtccagccccagccccggacgcctctccttccctcccaggctctgagcctcctgacatccttgcttattctcaggccccggaagcctaggtcgaatctcgagaagctgatttcctcctttcccccgcctgtgtcctgggaggaacagagtcccgaggggagtttgtc

SEQ ID NO: 102731 - DNA, 1152 bp, Homo sapiens
  misc_feature 1..1152: note = chr1:63795348-63796500
  misc_feature 1..1152: note = Hyper
  source 1..1152: mol_type = genomic DNA
aaagacagacacagacgcgccgggccggtggaactcagctccgggaaggctgtggacctggaccctggggctccccgctgcctgggcgcctctagcccggcgatgagtggttctgcggggaccgacggccccatttccttcttgcctcgtgatgtgggagggaagaaagaaggcggcaactgcaggcccgaagctcccctcgcccagcggcccaaccacagtgctgtcgtgtcggggatcggtccccaagggagcccccaaccccctgcccacgccgagatcacccccgtgccaacctcgagggctcggcctgcgggactccagctgcccctgcctggagggagggaagggagaagagaatacgaattaattacgaaggaaacccaggtgtgaaaggcacccgccgcggagctgggcgtgcagcggggcgcgcggtgggacctctgctcccgtccccgtcccgcggctactcagttgcccgctcatgggaggctcgcgacggaaaataaatcccctcagagtgaacctgggaggccgagaggacccagcctgggatctctgggggaaataggggcaagtttaccacggtttaattaagccacagccctagcacgaggaccccggcgacccatccgggctgggggatggactggagtgccccccaccccaggccgcgaaccggcagcgagaagcacactctccgccatccccggccccgccgcttccgcctctgcggactccgcgtttgccatgctccttcccggggtccagggaccggagctgcggtgcacgtcttattgaaggggagagctttggttcttttcctccctgcatccctcccactttcctctcaacagatagtaagcaagactcaattttctccaaaaaagcccgttacccctttctgcaaggggcgcatgcctaggttcacagggagctctcttgtcagccccagaacaaccctaaactccaaatgttctgtttgctctcgaggtacccctgggatgcagcgtctcctccgcgaagccttcctgagcctccctgcccagaccagttgctccttcttgaagctcaccgtgccaattaatgagccattgtcattagtgttgccctctgagttcctggtgagttcctgaccgtctagcattgctg

SEQ ID NO: 102732 - DNA, 667 bp, Homo sapiens
  misc_feature 1..667: note = chr1:64240116-64240783
  misc_feature 1..667: note = Hyper
  source 1..667: mol_type = genomic DNA
gcccgccgctcctggcgctgctggccgcgctgctgctggccgcacgcggggctgctgcccaaggtaagaggcgcccgccggcccccgcccgcccagaccccctgacccgtggccacccttccgccgtccagccgggcgcgggacacgcaggaagcgccgcgctggctccggggcgcgtccggccacccgccacggggctcgccggcgccgccaggccagggtttgccccggagccccgccaggccagggtttgccccggagccccgcggcgggccggggcgcgcccagggactcgttcctcggtgcgcagcagcgattgtcagcgctgacaggaagcgtggaggggtttgagggtcctgggggtgatcggggcacttctgtgcagggcgtccccccttgtctccctggacctctagcgcgccccagccggtgttcaggcaagtctatcctgcccccaagttgcgagccggcccggaaggcgcggtccaggagggagtttggattttcagtggtgctcgccagagcccaggcggctcgcggatcgacgcaaacaaaagccctgtcctcctggggctccggcggcctcgcatcgccaccgcccccggccctccggccctcccgagagtcatcatagaggccaaaacttgtgcgccgctgcagccgctgc

SEQ ID NO: 102733 - DNA, 39 bp, Homo sapiens; identical to SEQ ID NO: 69827
  misc_feature 1..39: note = chr1:64240997-64241036
  misc_feature 1..39: note = Hyper
  source 1..39: mol_type = genomic DNA

SEQ ID NO: 102734 - DNA, 17 bp, Homo sapiens
  misc_feature 1..17: note = chr1:64734652-64734669
  misc_feature 1..17: note = Hypo
  source 1..17: mol_type = genomic DNA
atgttctgaattagccg

SEQ ID NO: 102735 - DNA, 16 bp, Homo sapiens
  misc_feature 1..16: note = chr1:64734789-64734805
  misc_feature 1..16: note = Hypo
  source 1..16: mol_type = genomic DNA
gcgacaaagcaggact

SEQ ID NO: 102736 - DNA, 96 bp, Homo sapiens; identical to SEQ ID NO: 69837
  misc_feature 1..96: note = chr1:64937203-64937299
  misc_feature 1..96: note = Hyper
  source 1..96: mol_type = genomic DNA

SEQ ID NO: 102737 - DNA, 358 bp, Homo sapiens; identical to SEQ ID NO: 69847
  misc_feature 1..358: note = chr1:65468302-65468660
  misc_feature 1..358: note = Hyper
  source 1..358: mol_type = genomic DNA

SEQ ID NO: 102738 - DNA, 619 bp, Homo sapiens
  misc_feature 1..619: note = chr1:65731231-65731850
  misc_feature 1..619: note = Hyper
  source 1..619: mol_type = genomic DNA
gggggaagagagaaacgaatttaaataaaaactcaaaaaaggaaagggctaaccgaaaaatgagccaaccaaattttaagttcaacaacaagcattctggaggattctggggttttaaattcggaggctccttaaatattctgccgcagttgggggaggagcgatggacccctaggtctccggaggctacacgtgttccccgatcccgtttccagggggagcccttccttcctattgcgctggtcgtgctcctggcccgcgtgcccaggaagggcgcagcggagtcgcgtgcccgtccgggcggaggacgccgtctccgcgcggcggtgccgggcccctgcttccggaacgctaattttagggttcgccggcccccctttcttttcacccgctttccgtgcgagccgctgcgcagcagtctgcgcttcgagtgcgctgtgttttaaggaggccccggcgcttgccccttgggctcgggggcttgggtgcgcaggtgggggctggcacgcagcccgttgggcaggtttcgcgcagcgaccctccccacgccggagctaagttctttgggtgagacgtgcaacaacgcaggccccaaagctctctgcgcgcagcgccgcgg

SEQ ID NO: 102739 - DNA, 69 bp, Homo sapiens; identical to SEQ ID NO: 69850
  misc_feature 1..69: note = chr1:65774834-65774903
  misc_feature 1..69: note = Hyper
  source 1..69: mol_type = genomic DNA

SEQ ID NO: 102740 - DNA, 30 bp, Homo sapiens; identical to SEQ ID NO: 69851
  misc_feature 1..30: note = chr1:65775296-65775326
  misc_feature 1..30: note = Hyper
  source 1..30: mol_type = genomic DNA

SEQ ID NO: 102741 - DNA, 30 bp, Homo sapiens; identical to SEQ ID NO: 69852
  misc_feature 1..30: note = chr1:65775826-65775856
  misc_feature 1..30: note = Hyper
  source 1..30: mol_type = genomic DNA

SEQ ID NO: 102742 - DNA, 21 bp, Homo sapiens
  misc_feature 1..21: note = chr1:65940402-65940423
  misc_feature 1..21: note = Hypo
  source 1..21: mol_type = genomic DNA
agaaaaggccaggtgcggtgg

SEQ ID NO: 102743 - DNA, 892 bp, Homo sapiens
  misc_feature 1..892: note = chr1:65990955-65991847
  misc_feature 1..892: note = Hyper
  source 1..892: mol_type = genomic DNA
tgggggtgggagggacgggggaaccccagtgcctatctcaagcctgcggtcaccgacgcgggtccggggtgggggggtactgccagggaactcgcggcaccgcgtgcttgctgagttcgcctgggctctcggcctccctgcgggcaggggtcctccctccccagcgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaactcgagaatggggctttgggacgcgcgtggcagacgcggagccccgcgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagccggcagcgcctggagcgaacctgctcgggaccaccgagagagcatgccacccggccaacttcttttccaggcttcgtgcctactttgga

SEQ ID NO: 102744 - DNA, 23 bp, Homo sapiens
  misc_feature 1..23: note = chr1:66030258-66030281
  misc_feature 1..23: note = Hypo
  source 1..23: mol_type = genomic DNA
cgtgaatccgtttcttaatgttt

SEQ ID NO: 102745 - DNA, 702 bp, Homo sapiens
  misc_feature 1..702: note = chr1:66258145-66258847
  misc_feature 1..702: note = Hyper
  source 1..702: mol_type = genomic DNA
tcaaaccaggattttcggtctctggctttggataggcacgcagggctgtgcgtaatccttcagctctggtggtaagggagatgcagtgagctcccggctgggagagagggttattttgcaaaactcccctggtaccgtgcccgcggaatattgcaggaggtctgtgaggtaggtgggggaaaaaataacctgggagggcaatcagggagaggccagacgactggggacggcgtgctttgcaccctagaattgacaggtggtggcctcagcagttacaacctactacacagcatctcgtccgtgcgatacggtcacattgttattccccgcacccggctgaggagcgcagcgcggcagaccaagtggcaccggcgagctgtctctcttccggggggcgggggtggacagtagggagagggggtttaaagggccagaggacgagagaagagctgaggggcgcgtcgccagcgcctgtgtctccctggcgcgggttccccaggctagcccgctggcccgtccgcgcgcgcgcccccggcccgcgcgccccttcccggggctcctggcctcgcctcagcggctgcaggctcttcgtcgcgggccgggctgcacgcgagcgccctccgggcagactttcgtcccccacccccgggagcgcggaaggctcactcgcagcgcatggtctacccgcgccgggcggagccc

SEQ ID NO: 102746 - DNA, 354 bp, Homo sapiens; identical to SEQ ID NO: 69863
  misc_feature 1..354: note = chr1:66259077-66259431
  misc_feature 1..354: note = Hyper
  source 1..354: mol_type = genomic DNA

SEQ ID NO: 102747 - DNA, 622 bp, Homo sapiens; identical to SEQ ID NO: 69867
  misc_feature 1..622: note = chr1:66998790-66999412
  misc_feature 1..622: note = Hyper
  source 1..622: mol_type = genomic DNA

SEQ ID NO: 102748 - DNA, 201 bp, Homo sapiens; identical to SEQ ID NO: 69868
  misc_feature 1..201: note = chr1:66999472-66999673
  misc_feature 1..201: note = Hyper
  source 1..201: mol_type = genomic DNA

SEQ ID NO: 102749 - DNA, 378 bp, Homo sapiens; identical to SEQ ID NO: 64
  misc_feature 1..378: note = chr1:67217965-67218343
  misc_feature 1..378: note = Hyper
  source 1..378: mol_type = genomic DNA

SEQ ID NO: 102750 - DNA, 116 bp, Homo sapiens
  misc_feature 1..116: note = chr1:67390334-67390450
  misc_feature 1..116: note = Hyper
  source 1..116: mol_type = genomic DNA
cggaacttacaacccgaagttctgctgcttgtgactgcctgccggagagactggcatggtggcgaccagctggggagtggtgcaccacccctttttttggccgcctctgaagtccc

SEQ ID NO: 102751 - DNA, 29 bp, Homo sapiens
  misc_feature 1..29: note = chr1:67391067-67391096
  misc_feature 1..29: note = Hyper
  source 1..29: mol_type = genomic DNA
agttcgcctcgccccgttcgcttcggtcc

SEQ ID NO: 102752 - DNA, 648 bp, Homo sapiens; identical to SEQ ID NO: 69872
  misc_feature 1..648: note = chr1:67773132-67773780
  misc_feature 1..648: note = Hyper
  source 1..648: mol_type = genomic DNA

SEQ ID NO: 102753 - DNA, 86 bp, Homo sapiens; identical to SEQ ID NO: 69875
  misc_feature 1..86: note = chr1:68297687-68297773
  misc_feature 1..86: note = Hyper
  source 1..86: mol_type = genomic DNA

SEQ ID NO: 102754 - DNA, 222 bp, Homo sapiens
  misc_feature 1..222: note = chr1:68298379-68298601
  misc_feature 1..222: note = Hyper
  source 1..222: mol_type = genomic DNA
cactcgggggtccctcgcggggtgcgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactg

SEQ ID NO: 102755 - DNA, 262 bp, Homo sapiens; identical to SEQ ID NO: 69878
  misc_feature 1..262: note = chr1:68696775-68697037
  misc_feature 1..262: note = Hyper
  source 1..262: mol_type = genomic DNA

SEQ ID NO: 102756 - DNA, 30 bp, Homo sapiens; identical to SEQ ID NO: 69879
  misc_feature 1..30: note = chr1:68698056-68698086
  misc_feature 1..30: note = Hyper
  source 1..30: mol_type = genomic DNA

SEQ ID NO: 102757 - DNA, 30 bp, Homo sapiens; identical to SEQ ID NO: 69880
  misc_feature 1..30: note = chr1:68698513-68698543
  misc_feature 1..30: note = Hyper
  source 1..30: mol_type = genomic DNA

SEQ ID NO: 102758 - DNA, 123 bp, Homo sapiens; identical to SEQ ID NO: 69881
  misc_feature 1..123: note = chr1:68703942-68704065
  misc_feature 1..123: note = Hypo
  source 1..123: mol_type = genomic DNA

SEQ ID NO: 102759 - DNA, 30 bp, Homo sapiens; identical to SEQ ID NO: 69882
  misc_feature 1..30: note = chr1:68761411-68761441
  misc_feature 1..30: note = Hypo
  source 1..30: mol_type = genomic DNA

SEQ ID NO: 102760 - DNA, 301 bp, Homo sapiens; identical to SEQ ID NO: 69885
  misc_feature 1..301: note = chr1:70032971-70033272
  misc_feature 1..301: note = Hyper
  source 1..301: mol_type = genomic DNA

SEQ ID NO: 102761 - DNA, 111 bp, Homo sapiens; identical to SEQ ID NO: 26378
  misc_feature 1..111: note = chr1:70033503-70033614
  misc_feature 1..111: note = Hyper
  source 1..111: mol_type = genomic DNA

SEQ ID NO: 102762 - DNA, 652 bp, Homo sapiens
  misc_feature 1..652: note = chr1:70033922-70034574
  misc_feature 1..652: note = Hyper
  source 1..652: mol_type = genomic DNA
ggagccttctgggggcggggagggagctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggcggcgaagatgtggtaggttgcagagcatttggaaatggggtgctaactgggcgggtgcatgggagcaccgagtagcttgagct

SEQ ID NO: 102763 - DNA, 336 bp, Homo sapiens
  misc_feature 1..336: note = chr1:70035088-70035424
  misc_feature 1..336: note = Hyper
  source 1..336: mol_type = genomic DNA
cccttgaggatcttgcgtcctcctctccgagttattaaggatgcaggacgtgtttcggattcgacgtggaaagagggagggaagcacattagcattaaggtaatcatggcaccctggctcgtggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccggctcttctctggc

SEQ ID NO: 102764 - DNA, 29 bp, Homo sapiens
  misc_feature 1..29: note = chr1:70599140-70599169
  misc_feature 1..29: note = Hypo
  source 1..29: mol_type = genomic DNA
cgatccgaccgcctcggcctcccaaagtg

SEQ ID NO: 102765 - DNA, 75 bp, Homo sapiens; identical to SEQ ID NO: 69893
  misc_feature 1..75: note = chr1:70672852-70672927
  misc_feature 1..75: note = Hypo
  source 1..75: mol_type = genomic DNA

SEQ ID NO: 102766 - DNA, 38 bp, Homo sapiens; identical to SEQ ID NO: 69895
  misc_feature 1..38: note = chr1:70710368-70710406
  misc_feature 1..38: note = Hypo
  source 1..38: mol_type = genomic DNA

SEQ ID NO: 102767 - DNA, 32 bp, Homo sapiens; identical to SEQ ID NO: 69896
  misc_feature 1..32: note = chr1:70793696-70793728
  misc_feature 1..32: note = Hypo
  source 1..32: mol_type = genomic DNA

SEQ ID NO: 102768 - DNA, 30 bp, Homo sapiens; identical to SEQ ID NO: 69897
  misc_feature 1..30: note = chr1:70859409-70859439
  misc_feature 1..30: note = Hypo
  source 1..30: mol_type = genomic DNA

SEQ ID NO: 102769 - DNA, 885 bp, Homo sapiens; identical to SEQ ID NO: 69900
  misc_feature 1..885: note = chr1:71512862-71513747
  misc_feature 1..885: note = Hyper
  source 1..885: mol_type = genomic DNA

SEQ ID NO: 102770 - DNA, 30 bp, Homo sapiens; identical to SEQ ID NO: 69901
  misc_feature 1..30: note = chr1:71520000-71520030
  misc_feature 1..30: note = Hypo
  source 1..30: mol_type = genomic DNA

SEQ ID NO: 102771 - DNA, 30 bp, Homo sapiens; identical to SEQ ID NO: 69902
  misc_feature 1..30: note = chr1:71532563-71532593
  misc_feature 1..30: note = Hypo
  source 1..30: mol_type = genomic DNA

SEQ ID NO: 102772 - DNA, 194 bp, Homo sapiens; identical to SEQ ID NO: 69904
  misc_feature 1..194: note = chr1:72118097-72118291
  misc_feature 1..194: note = Hypo
  source 1..194: mol_type = genomic DNA

SEQ ID NO: 102773 - DNA, 153 bp, Homo sapiens; identical to SEQ ID NO: 69905
  misc_feature 1..153: note = chr1:72383459-72383612
  misc_feature 1..153: note = Hypo
  source 1..153: mol_type = genomic DNA

SEQ ID NO: 102774 - DNA, 436 bp, Homo sapiens; identical to SEQ ID NO: 69906
  misc_feature 1..436: note = chr1:72747831-72748267
  misc_feature 1..436: note = Hyper
  source 1..436: mol_type = genomic DNA

SEQ ID NO: 102775 - DNA, 379 bp, Homo sapiens; identical to SEQ ID NO: 69907
  misc_feature 1..379: note = chr1:72748650-72749029
  misc_feature 1..379: note = Hyper
  source 1..379: mol_type = genomic DNA

SEQ ID NO: 102776 - DNA, 869 bp, Homo sapiens
  misc_feature 1..869: note = chr1:72749709-72750578
  misc_feature 1..869: note = Hyper
  source 1..869: mol_type = genomic DNA
acgcagcagcccctccgcagctcgccgggctgttttcagccctgccctggcccaaggcagaaggagatactaggcgtggggccacccctactcttttttcttctttccttcttgaactcatttccagattcaagatccttaagcttttccgggccatttgcaaatcaatgcgagaaccgaggctgagtcgttagcagttacaccaatcaatcttgttcagcgaggagtttgggaagcagagcggggaagtgaaaatggaaaataagtaattaaaaaataagctccctccccctcacacactttttcccttcctccaccccatccccctttagcagtgtttgaagaagatattctttgccagatcccagttcttcttttggaggaaatgaagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctag

SEQ ID NO: 102777 - DNA, 30 bp, Homo sapiens
  misc_feature 1..30: note = chr1:75593985-75594015
  misc_feature 1..30: note = Hyper
  source 1..30: mol_type = genomic DNA
ctcctttttccccttcgtggccgttttatt

SEQ ID NO: 102778 - DNA, 164 bp, Homo sapiens; identical to SEQ ID NO: 69913
  misc_feature 1..164: note = chr1:75595334-75595498
  misc_feature 1..164: note = Hyper
  source 1..164: mol_type = genomic DNA

SEQ ID NO: 102779 - DNA, 651 bp, Homo sapiens
  misc_feature 1..651: note = chr1:75595733-75596384
  misc_feature 1..651: note = Hyper
  source 1..651: mol_type = genomic DNA
cctccaaaccacaggcgtgcttaaggcgctattgtcggcttggaaatgtcacaatgaataaatggtgtgatggactttagcgtttcgcgccatagcttttagccgggaagctttccaggctgccctgcttaatttcggcgtggttcctaattttctctctcccatcctctctcttagactggaaacgcttcccctatttcttccgtagcggaccgggagagcttactggcgctctgcgaaccggctggaaagaaacaccgagtcactcgtacagactcttggtcgcagaacttggctttccgctattggtcctccagaaccgcttgaaacaactggccccagctggcgcatcagaccgcagtgaggaatgccgcggggcgggtggcgaaggcagggtctgcccgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgc

SEQ ID NO: 102780 - DNA, 973 bp, Homo sapiens
  misc_feature 1..973: note = chr1:75596611-75597584
  misc_feature 1..973: note = Hyper
  source 1..973: mol_type = genomic DNA
aattctgccagaatccgcaccttcttatgatcgcgaaagtctccccatcctccaccgcctcctacagtcctatggcccactgtacccttggcgctggagccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccccgatctccacaggtctgacccaggcgagtccctagaaggcgggcgggaggagccgtagcaggggcagtttcgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccctctctccagcccggacctccaatcaaggcctggctccacgggatctagaccccttccctgcccccatctgtttttagggagatacactcaaggcttcccttaagcaggagaggcacagcctgggacaggacgcactccgaagtctctcaggctgtctttcccatgggcttgcaaaaagccctgtggtccacggatgttggtagacaccttgggtgggcctgccgcctctgattttca

SEQ ID NO: 102781 - DNA, 981 bp, Homo sapiens; identical to SEQ ID NO: 69919
  misc_feature 1..981: note = chr1:75597825-75598806
  misc_feature 1..981: note = Hyper
  source 1..981: mol_type = genomic DNA

SEQ ID NO: 102782 - DNA, 315 bp, Homo sapiens; identical to SEQ ID NO: 69920
  misc_feature 1..315: note = chr1:75599376-75599691
  misc_feature 1..315: note = Hyper
  source 1..315: mol_type = genomic DNA

SEQ ID NO: 102783 - DNA, 1320 bp, Homo sapiens
  misc_feature 1..1320: note = chr1:75600108-75601428
  misc_feature 1..1320: note = Hyper
  source 1..1320: mol_type = genomic DNA
aaggaattttaagaacggttcatcagaaagtggtcaggccacagcggcctctttggacgaagacacacttgtagcattatccttctcggcatcagcttttattagtggatcggggcgggggaggggggagatcggcagacacggacagcctctgaccctctggagttggtatgtgataagcagccctagcagtgccatgtattggaagaacgatcagatgtttgtgtgtaaactagtagcaaaggacgtgccggagctggcagttccccctgagaaggtgagcgagccgacgcctggccagaccagctgaatcgcagtgtccttgaaactcgagttgtttgggctcctaaacaaggttcagaaactacctgtaacggcctcatcttcagacctggcaattttttttttttattacgtagtagcgttagtcagtaatcattgcactccctccccaaaagctcacttaacctgagacatggagactgtaatttgggagatgaagcctcgagcctaaggcgctctcaggtccatgtgagtcgtgcttttgttctatttgctgtggtgatcgtggcggtccgggagagtgggtcgggaggactgggcggctgtcgggtggaaccggagacctggctcgtttcgttcggctgcccgcggacacttgcctgccctgaggcacacctccctctgcggggctccagaaaggcctccgggatccctgggcttgccgggagagccattttacctaaaatgccaaaagaaaaccgcagggcacaaaacgagtcacgcggtttgtctgagtagactggggaagctgacaagctctcacctcactcgggaggcaggacctgtgggtatttggtgttttaagtttgaaatcatctgcagcctgtctgagggcctcagcaggacgcgcgcggggcgcccctgactatttctttgctccgaagccggttggggacaccaggcgaaagcggagctgttctgtttaaacgccctttgtgtgtgaggacgcggcctcagtgcagctacgctgggtcccgcgtagggagcgcaccccagaaagggagggtctcggccgacggtccgggaggcccccaggttggtatcttgcctggtgcttccagagggagggagaaggggaggcgaacagtcagaaatgcagaagtgcgagccgctcgagttcggggtacccacccgcccccgagctagagtttttggaaacgaaagcggtctaagcccagggacgctgcgttttcgtttaagaacaaaactccagcaaatacttggaaacacttgagtaacgcgcgttgtttctttaaa

SEQ ID NO: 102784 - DNA, 1526 bp, Homo sapiens; identical to SEQ ID NO: 69925
  misc_feature 1..1526: note = chr1:75601633-75603159
  misc_feature 1..1526: note = Hyper
  source 1..1526: mol_type = genomic DNA

SEQ ID NO: 102785 - DNA, 775 bp, Homo sapiens
  misc_feature 1..775: note = chr1:76080278-76081053
  misc_feature 1..775: note = Hyper
  source 1..775: mol_type = genomic DNA
gaaaagcaaaaagcacgccaaagcctgagcgctgctgtagtccaagccaatgtattcagtaatacccttcacccctcagttctcatctgagttcctgtccttttttatataaccccaaaggctcagtaagtcgctgcctcccaggtcattgggcccattgtgttgaaatccaacttcgaacgacgccccttccttgccaccatcctcaggtccagttcccccgcgcacagccttcctcaccgcgcatggtgtcgagcccacttccacctctctgcagtgctgcagacaacctctagggctctgcgagtcccccagcgagagctagggagccgacaagctgcgacctctgcgagtccgcgctgcgggagcgggtggcttgcacctgctccccgcgcgccggctctgcgacccctaggcaagacgcagcccaggaggctccctcccgagtcgcgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggagggggga

SEQ ID NO: 102786 - DNA, 484 bp, Homo sapiens; identical to SEQ ID NO: 69928
  misc_feature 1..484: note = chr1:76081342-76081826
  misc_feature 1..484: note = Hyper
  source 1..484: mol_type = genomic DNA

SEQ ID NO: 102787 - DNA, 341 bp, Homo sapiens; identical to SEQ ID NO: 69929
  misc_feature 1..341: note = chr1:76082037-76082378
  misc_feature 1..341: note = Hyper
  source 1..341: mol_type = genomic DNA

SEQ ID NO: 102788 - DNA, 30 bp, Homo sapiens; identical to SEQ ID NO: 39004
  misc_feature 1..30: note = chr1:76259201-76259231
  misc_feature 1..30: note = Hypo
  source 1..30: mol_type = genomic DNA

SEQ ID NO: 102789 - DNA, 24 bp, Homo sapiens
  misc_feature 1..24: note = chr1:76354586-76354610
  misc_feature 1..24: note = Hypo
  source 1..24: mol_type = genomic DNA
tttttttttttgagacggagtctc

SEQ ID NO: 102790 - DNA, 24 bp, Homo sapiens
  misc_feature 1..24: note = chr1:76354730-76354754
  misc_feature 1..24: note = Hypo
  source 1..24: mol_type = genomic DNA
caacacgcccggctaggactggga

SEQ ID NO: 102791 - DNA, 44 bp, Homo sapiens; identical to SEQ ID NO: 69933
  misc_feature 1..44: note = chr1:76540206-76540250
  misc_feature 1..44: note = Hyper
  source 1..44: mol_type = genomic DNA

SEQ ID NO: 102792 - DNA, 161 bp, Homo sapiens
  misc_feature 1..161: note = chr1:76540496-76540657
  misc_feature 1..161: note = Hyper
  source 1..161: mol_type = genomic DNA
tgcccctgacccaggcgcgcccgctgctcggtggcaggagggccggcggagcgccatggcctgcatcctgaaggtaacgacttggatctgtggctcggacgcgtggttggccagccccttgctgctcagaggcacggagtcagccgcggtcccaccgcatc

SEQ ID NO: 102793 - DNA, 170 bp, Homo sapiens; identical to SEQ ID NO: 69936
  misc_feature 1..170: note = chr1:76955378-76955548
  misc_feature 1..170: note = Hypo
  source 1..170: mol_type = genomic DNA

SEQ ID NO: 102794 - DNA, 678 bp, Homo sapiens
  misc_feature 1..678: note = chr1:77332866-77333544
  misc_feature 1..678: note = Hyper
  source 1..678: mol_type = genomic DNA
tgtttttatcaacatcgcaaaacagaaaatttaggttgcagattttcacatggctatcacgttcagaatccaatcaggttctccttctttactacttgatgacttctttaaagataaataagcccgcggaccaagaagtgggtacactggctcggttaactctctctccccagaaatttcactactgaaaagattattatttgggggcggggaaggggatgtagaggtctttaggacccagcaggcggcggcaggcggcagttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatggtgagtcagttgtggcaactccaccgggcaaagagggggatccccgggctcagggtccacgggacgcaccgtggagactccgagacgcctaaccctgggccgcgaggtcgcctgttacaaagggacaactttctacccgctccgcgttccctcccgattctccagctct

SEQ ID NO: 102795 - DNA, 1151 bp, Homo sapiens
  misc_feature 1..1151: note = chr1:77333763-77334914
  misc_feature 1..1151: note = Hyper
  source 1..1151: mol_type = genomic DNA
caaacttgcaaggatcgcaaggatccagggccccaggaaaggaggggtgtgaaggactcaaaattccagcagcttggctggggtggctgcgccagacgggcccttccccaaagtgcaaacccacccctgtcctcggccccggcgcgctccctccctcagcccggggccgtacaccacctgccctctaccgagagatctgggcggcggcggccgaaagcagcgacgcgcccggagcatcccttgcgatacgctaggggacggtgctttctctgtcccagttgcgtgcggcggggctggggcccaggccgccccaaatctcccccactagagtgaccaccgcacagttgtccccgctgggcgcgctcctccggtgtctgcgctcagccgctctcctcttctctctcccgcccgcccgcagcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtgggctagttccaacttggtatgaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggccgccgagtcgctgcctggtgggaggaaactggggttggcgcgggtaccagcctgagcgttcctctgacccggaaccggagggtgagcgcagccagcccgcggccactgctcgggatccagcgttcccctctgatctctccagcgcattgctttgggc

SEQ ID NO: 102796 - DNA, 1527 bp, Homo sapiens
  misc_feature 1..1527: note = chr1:77747299-77748826
  misc_feature 1..1527: note = Hyper
  source 1..1527: mol_type = genomic DNA
ttcctgggagttcctcggagacccggaggtaaccgtgtatgtgcgtgcgagtgtgtctgtgtgcgtacaaggtccggagaagcgaaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatgaaggggcttgtagaagcgcactcgcccgctcccccgagggtagtcgcctttcccgcgggttgccagggtccttgtcagaaggctgggcttagaagcctgcatctcacagatcaagtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggac

SEQ ID NO: 102797 - DNA, 22 bp, Homo sapiens
  misc_feature 1..22: note = chr1:78122948-78122970
  misc_feature 1..22: note = Hypo
  source 1..22: mol_type = genomic DNA
gagccaccgcacccagcctaaa

SEQ ID NO: 102798 - DNA, 158 bp, Homo sapiens; identical to SEQ ID NO: 69952
  misc_feature 1..158: note = chr1:78244687-78244845
  misc_feature 1..158: note = Hypo
  source 1..158: mol_type = genomic DNA

SEQ ID NO: 102799 - DNA, 927 bp, Homo sapiens; identical to SEQ ID NO: 69953
  misc_feature 1..927: note = chr1:78354035-78354962
  misc_feature 1..927: note = Hyper
  source 1..927: mol_type = genomic DNA

SEQ ID NO: 102800 - DNA, 949 bp, Homo sapiens
  misc_feature 1..949: note = chr1:78511435-78512384
  misc_feature 1..949: note = Hyper
  source 1..949: mol_type = genomic DNA
gtttgccttctaaggcgtattgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggcgcgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggaggtaaggcgccaggtgctcaggctctcccgcctctccgccgcgccgcgccgcgccgcgcgtatttctgtgggcccaggagggttgagcggcgtttcccggagcgcgaaatccgatgccgtgttgagtccgccgggggcgtcccgggggaaagtgagtgtgccttccctggaagggaaaatttaacttggcaggaccgcagaaagtcacagtcccccttgctccgagatctggcctttgggaagcgggttgagggaggcaacctttcttccgcttgcaaatgtgtttgctccagatgtcccggattccgccggccgttcaaggcgtgagcaccttcccagactcgagatctggcggggcagattaata

SEQ ID NO: 102801 - DNA, 757 bp, Homo sapiens
  misc_feature 1..757: note = chr1:78956796-78957553
  misc_feature 1..757: note = Hyper
  source 1..757: mol_type = genomic DNA
cgatcaggatctccgcgctgggatcggtggaacttgaggcagcggcggcgcggggcgccatggcacaccgagcggctccgtcttctgctcctcagagagcccggctggcggcctgggatgacaaggtaccatccctccagaggctgatcccaatgcatcggcttcgcttatctagacccagatttaatcaactcaccccctgagacacccagccacagcttctgctggctgagcctgacactgagtttggaccagattccccaagctagggagacgcatagagaaagaagggtactcgagctaacccatccccattctgagctgctctgcgggggattgggtagaaagggtctcagaagagggaaatcggcacagattccgcttctcgccgttgcggggttccctgcgggcggcactgcgagttcctcacccgggcacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctgctcgggaaacgccaatcgaattagctcagagaagagtggccgtggccttgtgtat

SEQ ID NO: 102802 - DNA, 222 bp, Homo sapiens; identical to SEQ ID NO: 69959
  misc_feature 1..222: note = chr1:79294494-79294716
  misc_feature 1..222: note = Hypo
  source 1..222: mol_type = genomic DNA

SEQ ID NO: 102803 - DNA, 36 bp, Homo sapiens; identical to SEQ ID NO: 69960
  misc_feature 1..36: note = chr1:79472423-79472459
  misc_feature 1..36: note = Hyper
  source 1..36: mol_type = genomic DNA

SEQ ID NO: 102804 - DNA, 77 bp, Homo sapiens; identical to SEQ ID NO: 69963
  misc_feature 1..77: note = chr1:80515982-80516059
  misc_feature 1..77: note = Hypo
  source 1..77: mol_type = genomic DNA

SEQ ID NO: 102805 - DNA, 35 bp, Homo sapiens; identical to SEQ ID NO: 26422
  misc_feature 1..35: note = chr1:82266147-82266182
  misc_feature 1..35: note = Hyper
  source 1..35: mol_type = genomic DNA

SEQ ID NO: 102806 - DNA, 89 bp, Homo sapiens; identical to SEQ ID NO: 69967
  misc_feature 1..89: note = chr1:82266766-82266855
  misc_feature 1..89: note = Hyper
  source 1..89: mol_type = genomic DNA

SEQ ID NO: 102807 - DNA, 44 bp, Homo sapiens; identical to SEQ ID NO: 69968
  misc_feature 1..44: note = chr1:82267616-82267660
  misc_feature 1..44: note = Hyper
  source 1..44: mol_type = genomic DNA

SEQ ID NO: 102808 - DNA, 491 bp, Homo sapiens; identical to SEQ ID NO: 69969
  misc_feature 1..491: note = chr1:82267888-82268379
  misc_feature 1..491: note = Hyper
  source 1..491: mol_type = genomic DNA

SEQ ID NO: 102809 - DNA, 271 bp, Homo sapiens; identical to SEQ ID NO: 69970
  misc_feature 1..271: note = chr1:82268689-82268960
  misc_feature 1..271: note = Hyper
  source 1..271: mol_type = genomic DNA

SEQ ID NO: 102810 - DNA, 34 bp, Homo sapiens; identical to SEQ ID NO: 69971
  misc_feature 1..34: note = chr1:82269276-82269310
  misc_feature 1..34: note = Hyper
  source 1..34: mol_type = genomic DNA

SEQ ID NO: 102811 - DNA, 30 bp, Homo sapiens; identical to SEQ ID NO: 26428
  misc_feature 1..30: note = chr1:84158496-84158526
  misc_feature 1..30: note = Hyper
  source 1..30: mol_type = genomic DNA

SEQ ID NO: 102812 - DNA, 465 bp, Homo sapiens; identical to SEQ ID NO: 69977
  misc_feature 1..465: note = chr1:84464413-84464878
  misc_feature 1..465: note = Hyper
  source 1..465: mol_type = genomic DNA

SEQ ID NO: 102813 - DNA, 35 bp, Homo sapiens; identical to SEQ ID NO: 69978
  misc_feature 1..35: note = chr1:84543374-84543409
  misc_feature 1..35: note = Hyper
  source 1..35: mol_type = genomic DNA

SEQ ID NO: 102814 - DNA, 293 bp, Homo sapiens; identical to SEQ ID NO: 69979
  misc_feature 1..293: note = chr1:84544218-84544511
  misc_feature 1..293: note = Hyper
  source 1..293: mol_type = genomic DNA

SEQ ID NO: 102815 - DNA, 38 bp, Homo sapiens; identical to SEQ ID NO: 69980
  misc_feature 1..38: note = chr1:84944530-84944568
  misc_feature 1..38: note = Hypo
  source 1..38: mol_type = genomic DNA

SEQ ID NO: 102816 - DNA, 658 bp, Homo sapiens
  misc_feature 1..658: note = chr1:85358311-85358969
  misc_feature 1..658: note = Hyper
  source 1..658: mol_type = genomic DNA
tttcctaatcaccatcgatggcaatgagactgagtttggaaagaaccacgtgtgcaaaggcagacgcaacccgtgcggcgctctcctggcctctgcgcccagcccgccagccctcagcagcggacgcaacgccgattttgcatctagattgctttttgctcctagcggggaaaaaggtgggaaaagagcaagttgtgccatacacccgccgggagagtcttgtcccggggtttggagtgggtctggagcccaggcttgcacgccaggcaaccccgaaaagccgcaggctagagccctgcaggcgccgctgcgccccggcctccccacgacgcacgccctggtgactgcggctcggggtaccctccctgcgcccggaccctcactcaccgctcacgttcacccgcgccgccgagcccgggagcgggggcccctgcggctgccgcatgccctcggggtcgagcgcgacggggcgaccgggcgccgggctccagccgggcgcggagaagcagcggaggacgcggcgggcgggcggagcgcctcctctccagcgacccctgcgacgcgtccagagccaaaggaaagtttggcggtgcgagggagggacctagggacagcggcccctccctgccccgccccgccccgccgggtgcgttcgacg

SEQ ID NO: 102817 - DNA, 178 bp, Homo sapiens; identical to SEQ ID NO: 69983
  misc_feature 1..178: note = chr1:85359170-85359348
  misc_feature 1..178: note = Hyper
  source 1..178: mol_type = genomic DNA

SEQ ID NO: 102818 - DNA, 256 bp, Homo sapiens; identical to SEQ ID NO: 69984
  misc_feature 1..256: note = chr1:85463282-85463538
  misc_feature 1..256: note = Hyper
  source 1..256: mol_type = genomic DNA

SEQ ID NO: 102819 - DNA, 16 bp, Homo sapiens
  misc_feature 1..16: note = chr1:85463598-85463614
  misc_feature 1..16: note = Hyper
  source 1..16: mol_type = genomic DNA
gcgcctggccccttct

SEQ ID NO: 102820 - DNA, 78 bp, Homo sapiens; identical to SEQ ID NO: 69986
  misc_feature 1..78: note = chr1:85463869-85463947
  misc_feature 1..78: note = Hyper
  source 1..78: mol_type = genomic DNA

SEQ ID NO: 102821 - DNA, 37 bp, Homo sapiens; identical to SEQ ID NO: 69987
  misc_feature 1..37: note = chr1:85513662-85513699
  misc_feature 1..37: note = Hyper
  source 1..37: mol_type = genomic DNA

SEQ ID NO: 102822 - DNA, 30 bp, Homo sapiens; identical to SEQ ID NO: 26435
  misc_feature 1..30: note = chr1:85527927-85527957
  misc_feature 1..30: note = Hyper
  source 1..30: mol_type = genomic DNA

SEQ ID NO: 102823 - DNA, 62 bp, Homo sapiens; identical to SEQ ID NO: 69989
  misc_feature 1..62: note = chr1:85774021-85774083
  misc_feature 1..62: note = Hyper
  source 1..62: mol_type = genomic DNA

SEQ ID NO: 102824 - DNA, 682 bp, Homo sapiens; identical to SEQ ID NO: 69992
  misc_feature 1..682: note = chr1:86621263-86621945
  misc_feature 1..682: note = Hyper
  source 1..682: mol_type = genomic DNA

SEQ ID NO: 102825 - DNA, 561 bp, Homo sapiens
  misc_feature 1..561: note = chr1:86622190-86622751
  misc_feature 1..561: note = Hyper
  source 1..561: mol_type = genomic DNA
accatgcttcaaacccgcaacaagaaaaaaaggaggggagggggtgaagtcgggaggaggtaggaaatagcacccgaaggggaggacaggcttcctagctctctggctcggtaacgaacgagcccagggttgcgctccccggggagggcgggcgaggaggtaaacctcactgggaggcctcggggcgccggcggcagcgggagccgggctgctagtgcagcactcaagttcacttgcggttcaaaggcgactctgtgactccagtggagtcctctgctttgggcctgggaggagaaaggggtgggggtagggaaggagatgaagtgggggaggaagtccttggaaacagcccgcgcccgaacgtttgtcaaacaagcacacacacccacttcggaaatcaagtcggtgcgagggggccggtggcaactgcaggcgctcggcgttgactgccgccggctgctttgcctggaagaagaggagccaagcaaatccggccggtgttaaatttcaccgctcactgacttgcaatgacatcaccaaacactgcgcacacctccccct

SEQ ID NO: 102826 - DNA, 221 bp, Homo sapiens; identical to SEQ ID NO: 69994
  misc_feature 1..221: note = chr1:86860814-86861035
  misc_feature 1..221: note = Hypo
  source 1..221: mol_type = genomic DNA

SEQ ID NO: 102827 - DNA, 30 bp, Homo sapiens; identical to SEQ ID NO: 69995
  misc_feature 1..30: note = chr1:87229260-87229290
  misc_feature 1..30: note = Hypo
  source 1..30: mol_type = genomic DNA

SEQ ID NO: 102828 - DNA, 30 bp, Homo sapiens; identical to SEQ ID NO: 69997
  misc_feature 1..30: note = chr1:87617400-87617430
  misc_feature 1..30: note = Hyper
  source 1..30: mol_type = genomic DNA

SEQ ID NO: 102829 - DNA, 174 bp, Homo sapiens; identical to SEQ ID NO: 69998
  misc_feature 1..174: note = chr1:87617684-87617858
  misc_feature 1..174: note = Hyper
  source 1..174: mol_type = genomic DNA

SEQ ID NO: 102830 - DNA, 187 bp, Homo sapiens; identical to SEQ ID NO: 70000
  misc_feature 1..187: note = chr1:88928315-88928502
  misc_feature 1..187: note = Hyper
  source 1..187: mol_type = genomic DNA

SEQ ID NO: 102831 - DNA, 30 bp, Homo sapiens; identical to SEQ ID NO: 70002
  misc_feature 1..30: note = chr1:89664391-89664421
  misc_feature 1..30: note = Hyper
  source 1..30: mol_type = genomic DNA

SEQ ID NO: 102832 - DNA, 62 bp, Homo sapiens; identical to SEQ ID NO: 70004
  misc_feature 1..62: note = chr1:90292117-90292179
  misc_feature 1..62: note = Hypo
  source 1..62: mol_type = genomic DNA

SEQ ID NO: 102833 - DNA, 55 bp, Homo sapiens; identical to SEQ ID NO: 70005
  misc_feature 1..55: note = chr1:90309435-90309490
  misc_feature 1..55: note = Hyper
  source 1..55: mol_type = genomic DNA

SEQ ID NO: 102834 - DNA, 124 bp, Homo sapiens; identical to SEQ ID NO: 70006
  misc_feature 1..124: note = chr1:90847612-90847736
  misc_feature 1..124: note = Hypo
  source 1..124: mol_type = genomic DNA

SEQ ID NO: 102835 - DNA, 748 bp, Homo sapiens; identical to SEQ ID NO: 70008
  misc_feature 1..748: note = chr1:91171967-91172715
  misc_feature 1..748: note = Hyper
  source 1..748: mol_type = genomic DNA

SEQ ID NO: 102836 - DNA, 161 bp, Homo sapiens; identical to SEQ ID NO: 70009
  misc_feature 1..161: note = chr1:91172920-91173081
  misc_feature 1..161: note = Hyper
  source 1..161: mol_type = genomic DNA

SEQ ID NO: 102837 - DNA, 564 bp, Homo sapiens
  misc_feature 1..564: note = chr1:91176389-91176953
  misc_feature 1..564: note = Hyper
  source 1..564: mol_type = genomic DNA
aggaactccaggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccggcgctcagccgcgggcagcagaacagctgcgaggctcgaggagcgtccgcctgccgcccagcccctgccggcgttgtcatcgctgcccagcgcttcggaccctcgctgccccaggaagacccctagaagaaggaggaggggaggacagagggatcaccacaccggtgaagctggggcctctatgcaggtcaggacggcagcaaagttggccgccgacttagccagcacccgcagcctgcaagtacagattttctcccacagcctcctgggttgctttgaaaccatccatttaaaaagaaaggaactcatacatatcaaataatggttcggaagaggccagcacgaaaaatggagctg

SEQ ID NO: 102838 - DNA, 112 bp, Homo sapiens; identical to SEQ ID NO: 70012
  misc_feature 1..112: note = chr1:91177380-91177492
  misc_feature 1..112: note = Hyper
  source 1..112: mol_type = genomic DNA

SEQ ID NO: 102839 - DNA, 417 bp, Homo sapiens; identical to SEQ ID NO: 69
  misc_feature 1..417: note = chr1:91177840-91178257
  misc_feature 1..417: note = Hyper
  source 1..417: mol_type = genomic DNA

SEQ ID NO: 102840 - DNA, 90 bp, Homo sapiens; identical to SEQ ID NO: 70014
  misc_feature 1..90: note = chr1:91178931-91179021
  misc_feature 1..90: note = Hyper
  source 1..90: mol_type = genomic DNA

SEQ ID NO: 102841 - DNA, 64 bp, Homo sapiens; identical to SEQ ID NO: 70015
  misc_feature 1..64: note = chr1:91179460-91179524
  misc_feature 1..64: note = Hyper
  source 1..64: mol_type = genomic DNA

SEQ ID NO: 102842 - DNA, 231 bp, Homo sapiens; identical to SEQ ID NO: 70016
  misc_feature 1..231: note = chr1:91180075-91180306
  misc_feature 1..231: note = Hyper
  source 1..231: mol_type = genomic DNA

SEQ ID NO: 102843 - DNA, 1063 bp, Homo sapiens; identical to SEQ ID NO: 70017
  misc_feature 1..1063: note = chr1:91181807-91182870
  misc_feature 1..1063: note = Hyper
  source 1..1063: mol_type = genomic DNA

SEQ ID NO: 102844 - DNA, 906 bp, Homo sapiens
  misc_feature 1..906: note = chr1:91183087-91183993
  misc_feature 1..906: note = Hyper
  source 1..906: mol_type = genomic DNA
aggcgaaggcgaaggcgaaggcgcaggcgaaggcgaaggcgcaggcggcgggaagctacgccaaagccgccgccgccgccgctgccggggtctgcccacagcctggcaccgggcggcagcggtggcggcggcggacgcggcaggtgcagcgaccgcgaagcccgggcggccgcgcgccctcggaactcccccgcggctcccgaggtggcagccgcgcgccactcggcagccccgtagccgagtttctgaactttcttggaaagttgcggggcagacacggccgcagcggttgcggcaacccgaggaggaggaggaagaggaggacgacgagaaggagcaggcacagaaggaggaagcggcggagacgcgatgccgggcgactccggccgctgccgggcgcgttcgcttgtaatccggctgctggcgggcggcgccgaccccctcccgtgacgtcacggccactaccgccgctccccgcgccgcgccgcgccgggcccgcgcccccgccaccgaggccgcgcgtccggccccgcgcccctattggccgcgcccgcgcgagcgagggacgccgacgtgccagggagccaataggcgcagcgctcgtgagcccgtcagcggactcggctcggactccgctgctcttttgagaacccgcacatccctgagcccgcagccctgagccgaactccgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggacttacctttaggctccagcgcggcggccctcgcagcctccccaaa

SEQ ID NO: 102845 - DNA, 871 bp, Homo sapiens
  misc_feature 1..871: note = chr1:91184194-91185065
  misc_feature 1..871: note = Hyper
  source 1..871: mol_type = genomic DNA
tccgcgtccaccaggcgctctcggggaggacgaggcctgaggctccaagctggggaaccagcctggtctccagctggaaaaaatgcctggccagacgctttctcccgaacgggggagctaatgcccgaggcgttctctggtggcgagggcagccacggttcactgcggtgtcgggcgggcgcggggctcaggacccatagcggctggtctgcagcccgcgcccctgccgcgccccgcggcagtccgtccacctctgtcccccggcccctttcggcgagcgctcatttggaaaggaaacagtcactgcggatccacttgggacccggagcatgactgtaacgcctcgttggagtgtatcaacttgcattattttctctaggacgtctccaacctgtctcatgttgaatgtcagagtaatgggaagtgccagtgacaagacggcgtattactcctgattaagtgccgtgtcaacctaattagcagagtaattataaggtgctaatgaatgattcaaagttctttgagttacattttactccaaattaccattttaagaaccctatgaatctgcgaggcgggcatcgcttccgtggctaggtctggaatgatgttcgagtggcctttaatgtctccaaaggctgggccgaaatctggagtttagttgcagttctggaggtcactttctgggccacagcttttatctgttgaggacgaagggaggggtgtcagggaggcaaatgacctcctgggacaagctcttgcctttcggtcggaactgcttctgtgtgagccctgggtccggaagcgggtagctgggcgactcatcctgcctgcgttttcctagggaaatcggtgtgtttgacccagaaaa

SEQ ID NO: 102846 - DNA, 871 bp, Homo sapiens
  misc_feature 1..871: note = chr1:91185125-91185996
  misc_feature 1..871: note = Hyper
  source 1..871: mol_type = genomic DNA
cgtctcagtggcatttttcctagggctgttccgagagaacagcggggattgaagggacggaggcaaggagatgcacaatccgggcagctctcgctcttctcggaaggcgaagggagtttggcggagaagacggggttggtgagccgaggcggggactccggacgtgctccatcccggcaggggccgacagtggccagaggggtgcggggaggccctcgggaacgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcgcagcctaaatatcctgcgcctctgtcacagttgaccgctgtggggaggacaggaagggctctagggctgcccgagactgcaggctgaccctacctactctaccctcttcaaatatcgattagggttcttcccattccaacatcatcatccaccaacttcccgaatatggtgcgttttctcctagccctgggaggttccaactcgaactcccctcgctgcatattcagggtgggaagtagggagggggagaaaacaaatttaaaatccagaactgacggcactgcacaaatcaattattctcgaccttgataaataattcatttaagcctgtttttgttttgttccgacgcctaaaatgactcaagagctcaaaaggctgatcgcacagcttgtgttgggcggttcgacagggtcttttt

SEQ ID NO: 102847 - DNA, 3834 bp, Homo sapiens
  misc_feature 1..3834: note = chr1:91188983-91192817
  misc_feature 1..3834: note = Hyper
  source 1..3834: mol_type = genomic DNA
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctgggcgtcggggacgaggacgcacgccagccaagacgtgcctcccacccagcccacgcgcgcttccccacccccctggccctccaaaatcggtaagagaattaagatttcgaatccctattttgaggagccttccgcatttcctaattgttaaattcctgcttttcaccaaattcccgggggagaaacatttggcaataagaagggactgtgaatttaaatgctaattgagtgggtcctttttccgcagctccacctgcctggcagcctctgttgaaaccaaacacactcggagcgcccagtgcaacattcttggggtgccgagtagaagcgcagtaaagagagaccctagcggactcctgtctggtttgctttttaccgactcttacagaaaaaaagagaatgccattggaagaagctcttttgcgtggtgggcgatgtgtgggtgggggacttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtccctaatggtgcgtaatgtgctcacactcacatttttctctctgaggatgggcggctgcaggctggtaggggaggagagacaggcaagcggcgggctggattagggcgtgacgccccccaccacgcacacaaacatacacagcccactggatgtctgccgggtgggagccgcaatctccgcgcggtcgatggggccctccgctgcgcactcggccctgcgccgagcaccctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccagggtgggcttgtaaaagacgcttccgcagagcaggtcccgtcagggtctttttcctgttcctggtgccagcggtcggcccgggcgccccgcagacctcggcgaggtagatgttaagctcggagagtgcccctcccgcaggcgccgtggcgagatcactctgaatatgtaacatatttgtaacgtgcgccgaggtgtgatgtgtgtgctgaaatagggggatgggggaattcgaagccggattgggaaggcgggggggaggcgcacagaactcacaatgtacttcgcaatctaacaatctgaacattcatttattaaaagctgctgcgtgacatttacactgagccaccagtctctgcctctaatccgggcgaaaacgattgtactgccgagttatggctgcagcgtatggggacgctgctgtccgcggccggacagagcccatcagctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctgttttccttttgtcagattcctcctccccgatcagtctgagtacacgatcagaactgctcagagagcaggaagcacattgatttcagcttgttctgtccacagacaggccctgacaaggttgttagaacagccggagaggtctatacaatcacttaattaccaaaactgtcagtcaggcgggacgcggatccgcgtcccgggctgcgctaggcattccagcactgggccgcgcgcgtgattgatcggtgctgatagcaccgcaaaataattacggcgaattttctgatgtgtgattttatcccaagttcatgcttcagagaggtaatcggagaatgagaagggtcagtgccatttcggattacctggaatctgcgagaaagggtaaaatgggggaaggagctccgaggaaaacgggagagatgggggtgcagagagagagggaagaagaaagcgagttatggattgctggagggactgcaagcaattcgtcaaactgtgcaagtgatttccttcagagccagcatatggcagattgattttgtccaacgtcggttttagccacatttaaaatgatccagcggttattactgcgattggcttaggaactgacaggcagttttaggcgcaaggagtatagatcctgtttaccggagatgtgttcgtaactgctgtcaaatacagttaagtaaatatcattagcgaagagctctgttaagagaaatgccaatccaataaatatgcttttcctccccgccctccgcatggctgcctgcgcttcctccagaggttctccttcctgctcctttgctgcttgggtcagacgtcccaggcatggtgctgactcccgccaccttggagccccgagctgagcctcgggcagaagatgacaggccagccgtggggcaaggaggccgcggaaacgcggaacggcttcggggagacggaagcgcccaatgagattcaccctgcagcccgggtccagcccaccttcctcggagattgccgcggccctcgaacccgggcctaggtcttcatgtcccggcggccagaggacgttgcggggaccactggggagctgccctcagtcagctctctgccccacgccggaggtcctggcgcggcttctttcccgaactagactggcgactctgggccaggccccaaggaccgccccggcctctccggctttgcggggagaatctgaggaaccgagtccaagatagccgacctaggctgttttcacccagaccctgcgtccccgacccgctggagtgaatct

SEQ ID NO: 102848 - DNA, 952 bp, Homo sapiens; identical to SEQ ID NO: 70031
  misc_feature 1..952: note = chr1:91194539-91195491
  misc_feature 1..952: note = Hyper
  source 1..952: mol_type = genomic DNA

SEQ ID NO: 102849 - DNA, 641 bp, Homo sapiens
  misc_feature 1..641: note = chr1:91195879-91196520
  misc_feature 1..641: note = Hyper
  source 1..641: mol_type = genomic DNA
taaaatcattgttcacgtgtcaatttaaaagaccattaaagcagcttattttggttttaattggaacctcctcccttccaactacaggcttaaaagaaaaaaaaaaaaaactctcccccacacccaggcgcgcgcacgcacgcgggcacgcagcagcgatggggatgtaggtcaccccgcgggttagggccacgcgcccgcactcccgccgcagccgcaaccgcagccgcagccgcagccaacgcggccgcggagcgacgcagtccgcagcctcgaatttccagaaattccagcactggcagcagcacgtctagttcgaacgcttccaattaaacaacaccgtattcgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaaagctggcagatgcagcaaaactaatatgtgtaaatgctttaaagcaataatctgcttacagcgacacttccccgaacggcggcaggactgaggg

SEQ ID NO: 102850 - DNA, 1125 bp, Homo sapiens; identical to SEQ ID NO: 70034
  misc_feature 1..1125: note = chr1:91316237-91317362
  misc_feature 1..1125: note = Hyper
  source 1..1125: mol_type = genomic DNA

SEQ ID NO: 102851 - DNA, 515 bp, Homo sapiens; identical to SEQ ID NO: 70038
  misc_feature 1..515: note = chr1:91869861-91870376
  misc_feature 1..515: note = Hyper
  source 1..515: mol_type = genomic DNA

SEQ ID NO: 102852 - DNA, 55 bp, Homo sapiens; identical to SEQ ID NO: 70039
  misc_feature 1..55: note = chr1:92048970-92049025
  misc_feature 1..55: note = Hypo
  source 1..55: mol_type = genomic DNA

SEQ ID NO: 102853 - DNA, 48 bp, Homo sapiens; identical to SEQ ID NO: 70041
  misc_feature 1..48: note = chr1:92494924-92494972
  misc_feature 1..48: note = Hypo
  source 1..48: mol_type = genomic DNA

SEQ ID NO: 102854 - DNA, 128 bp, Homo sapiens; identical to SEQ ID NO: 26473
  misc_feature 1..128: note = chr1:92495704-92495832
  misc_feature 1..128: note = Hyper
  source 1..128: mol_type = genomic DNA

SEQ ID NO: 102855 - DNA, 1142 bp, Homo sapiens; identical to SEQ ID NO: 70043
  misc_feature 1..1142: note = chr1:92948324-92949466
  misc_feature 1..1142: note = Hyper
  source 1..1142: mol_type = genomic DNA

SEQ ID NO: 102856 - DNA, 516 bp, Homo sapiens; identical to SEQ ID NO: 70044
  misc_feature 1..516: note = chr1:92949691-92950207
  misc_feature 1..516: note = Hyper
  source 1..516: mol_type = genomic DNA

SEQ ID NO: 102857 - DNA, 2116 bp, Homo sapiens; identical to SEQ ID NO: 70045
  misc_feature 1..2116: note = chr1:92950434-92952550
  misc_feature 1..2116: note = Hyper
  source 1..2116: mol_type = genomic DNA

SEQ ID NO: 102858 - DNA, 156 bp, Homo sapiens; identical to SEQ ID NO: 39010
  misc_feature 1..156: note = chr1:93222691-93222847
  misc_feature 1..156: note = Hypo
  source 1..156: mol_type = genomic DNA

SEQ ID NO: 102859 - DNA, 18 bp, Homo sapiens
  misc_feature 1..18: note = chr1:93543647-93543665
  misc_feature 1..18: note = Hypo
  source 1..18: mol_type = genomic DNA
gcccggctgcatctgctt

SEQ ID NO: 102860 - DNA, 30 bp, Homo sapiens; identical to SEQ ID NO: 70052
  misc_feature 1..30: note = chr1:94045521-94045551
  misc_feature 1..30: note = Hypo
  source 1..30: mol_type = genomic DNA

SEQ ID NO: 102861 - DNA, 30 bp, Homo sapiens; identical to SEQ ID NO: 39011
  misc_feature 1..30: note = chr1:94048058-94048088
  misc_feature 1..30: note = Hypo
  source 1..30: mol_type = genomic DNA

SEQ ID NO: 102862 - DNA, 82 bp, Homo sapiens; identical to SEQ ID NO: 70054
  misc_feature 1..82: note = chr1:94048417-94048499
  misc_feature 1..82: note = Hypo
  source 1..82: mol_type = genomic DNA

SEQ ID NO: 102863 - DNA, 37 bp, Homo sapiens; identical to SEQ ID NO: 70056
  misc_feature 1..37: note = chr1:94343568-94343605
  misc_feature 1..37: note = Hypo
  source 1..37: mol_type = genomic DNA

SEQ ID NO: 102864 - DNA, 41 bp, Homo sapiens; identical to SEQ ID NO: 70057
  misc_feature 1..41: note = chr1:94345747-94345788
  misc_feature 1..41: note = Hypo
  source 1..41: mol_type = genomic DNA

SEQ ID NO: 102865 - DNA, 30 bp, Homo sapiens; identical to SEQ ID NO: 70058
  misc_feature 1..30: note = chr1:94490609-94490639
  misc_feature 1..30: note = Hypo
  source 1..30: mol_type = genomic DNA

SEQ ID NO: 102866 - DNA, 30 bp, Homo sapiens; identical to SEQ ID NO: 70059
  misc_feature 1..30: note = chr1:94701656-94701686
  misc_feature 1..30: note = Hyper
  source 1..30: mol_type = genomic DNA

SEQ ID NO: 102867 - DNA, 55 bp, Homo sapiens; identical to SEQ ID NO: 70060
  misc_feature 1..55: note = chr1:94702935-94702990
  misc_feature 1..55: note = Hyper
  source 1..55: mol_type = genomic DNA

SEQ ID NO: 102868 - DNA, 33 bp, Homo sapiens; identical to SEQ ID NO: 70061
  misc_feature 1..33: note = chr1:94703324-94703357
  misc_feature 1..33: note = Hyper
  source 1..33: mol_type = genomic DNA

SEQ ID NO: 102869 - DNA, 229 bp, Homo sapiens; identical to SEQ ID NO: 70062
  misc_feature 1..229: note = chr1:95007667-95007896
  misc_feature 1..229: note = Hyper
  source 1..229: mol_type = genomic DNA

SEQ ID NO: 102870 - DNA, 154 bp, Homo sapiens; identical to SEQ ID NO: 70063
  misc_feature 1..154: note = chr1:95071346-95071500
  misc_feature 1..154: note = Hypo
  source 1..154: mol_type = genomic DNA

SEQ ID NO: 102871 - DNA, 884 bp, Homo sapiens; identical to SEQ ID NO: 70064
  misc_feature 1..884: note = chr1:95391740-95392624
  misc_feature 1..884: note = Hyper
  source 1..884: mol_type = genomic DNA

SEQ ID NO: 102872 - DNA, 72 bp, Homo sapiens; identical to SEQ ID NO: 70065
  misc_feature 1..72: note = chr1:95392995-95393067
  misc_feature 1..72: note = Hyper
  source 1..72: mol_type = genomic DNA

SEQ ID NO: 102873 - DNA, 151 bp, Homo sapiens; identical to SEQ ID NO: 70066
  misc_feature 1..151: note = chr1:95428423-95428574
  misc_feature 1..151: note = Hyper
  source 1..151: mol_type = genomic DNA

SEQ ID NO: 102874 - DNA, 34 bp, Homo sapiens; identical to SEQ ID NO: 70073
  misc_feature 1..34: note = chr1:97185220-97185254
  misc_feature 1..34: note = Hypo
  source 1..34: mol_type = genomic DNA

SEQ ID NO: 102875 - DNA, 193 bp, Homo sapiens; identical to SEQ ID NO: 70078
  misc_feature 1..193: note = chr1:98338299-98338492
  misc_feature 1..193: note = Hypo
  source 1..193: mol_type = genomic DNA

SEQ ID NO: 102876 - DNA, 1190 bp, Homo sapiens
  misc_feature 1..1190: note = chr1:98510732-98511922
  misc_feature 1..1190: note = Hyper
  source 1..1190: mol_type = genomic DNA
tctctcttgctcccacgccttcgcagctgacctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttccgcggggacccagcccccgggcccccgccccctccccatctcggccgccaagtctggttgcggagcagcgcggccggccgggggtggggctccggcaccgccccgggctcgggattcgcgaagtcacgcgcttccgcaggcttgcgggggcaccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatccataactcgatttccctaaagaaggatccaaagctgtgctcggctgcttcctgcc

SEQ ID NO: 102877 - DNA, 315 bp, Homo sapiens; identical to SEQ ID NO: 26483
  misc_feature 1..315: note = chr1:98513940-98514255
  misc_feature 1..315: note = Hyper
  source 1..315: mol_type = genomic DNA

SEQ ID NO: 102878 - DNA, 247 bp, Homo sapiens; identical to SEQ ID NO: 70084
  misc_feature 1..247: note = chr1:98514484-98514731
  misc_feature 1..247: note = Hyper
  source 1..247: mol_type = genomic DNA

SEQ ID NO: 102879 - DNA, 309 bp, Homo sapiens
  misc_feature 1..309: note = chr1:98515068-98515377
  misc_feature 1..309: note = Hyper
  source 1..309: mol_type = genomic DNA
cttgggaagggacctcggcgcctcgcgctggctgtgccccagtgccttcgcgtggtggcggcttgctcatgcttccgaggagtcccaggcgatagccttcagctgatgcgagcttccagaaaggagtggggaagggaaaaaatcatctaatgcaatcaaatcgatctgatctacaccatctgtcgcctgccactatacacaaacgttaaaataggaaaacggaaaacactgacagccgagagggttggtctgcaaagagttcatttttagcagagcataattcgatatggtcggcgtacagttacaaaa

SEQ ID NO: 102880 - DNA, 1051 bp, Homo sapiens
  misc_feature 1..1051: note = chr1:98518986-98520037
  misc_feature 1..1051: note = Hyper
  source 1..1051: mol_type = genomic DNA
ataccagagtgatctcggcgctcgcgcagttttgagagagggtcccgaaaaccgccggaggccaggtgtcgcggacgggccccgggctaaactctcgtctggcgaagtgaagagcgcaaagtctccaggcccagcgcgccttcgcggggcaggccggacaccctagccccgggccgggctcgctcttctctgaagccctggagcgggcaaggggcaccattctggccacaggaactctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccagagaccacggctcactccctaacgccctcgcaaggacggctgcccgtcgggccaagggcgccccgggctggaggccggagcaagacggccccgcgggactcgggagccttggtaaggcggaggctcagaccccgttcacgaaaacgcctggctcctccaggatttgtcaggtcttaagcagctccgagaaggctccgctggctcttggggaaccccgctgtgcggctcacccccgtttgtctctctcaagctctcgccctcctcccctggtcctcccttctccagatcccctgccctgcccgaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaacagaaaacaaaacaaaaacaaacaaagcgccaaaccccactc

SEQ ID NO: 102881 - DNA, 40 bp, Homo sapiens; identical to SEQ ID NO: 70095
  misc_feature 1..40: note = chr1:99127631-99127671
  misc_feature 1..40: note = Hyper
  source 1..40: mol_type = genomic DNA

SEQ ID NO: 102882 - DNA, 1286 bp, Homo sapiens
  misc_feature 1..1286: note = chr1:99469561-99470847
  misc_feature 1..1286: note = Hyper
  source 1..1286: mol_type = genomic DNA
gatcccctctctcctcgccggcccgcccgccgctgctcttcttccaggcacaatcgaagaggaggcagtgagcgagtcaaggccacagagtggatggaatcaaggttcacccccaaagctcacctcctttgcaacccggatccccactcctcaccacctacggcccctcttcccttccatccccgcccagtcacccaacgctgaagccaccgcggggtgtgggggggtgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcgagcgcccccgggcttaccacgagcacggggaccccggcggccagcgagtagaggagcacggggggcacggcgctgctgtcctccgggcccgggtagggtttgcggtaggcgctgtcgtggcagaagaagccctgcacgttcacggtgaacgtgtccgtatactcgaagtagtacgccagcatcaccgtccctgccatgatcaccatctggaaatagagcatgctgctggtgagcgccgcgggcagcaggggcatgcacgcctcccgggccgggccgagccgagccgagcgggcggtcgacgcggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccgggcgacgggcagcggccgctgcgcccctgcacgagaccattcgagaagcagcggcgctgggtcaatcccccaggctagcccggaggaggcgctgcgtgggcggacggggcggcagccggcgggacagcggcacctgtacccctcacagggcggacgctgtggggctggagaagctcctggcgggggtaaaatcaaaagggggggaggggaggcagtagagatggagcttccagaaactcttccgaggcaccagctgagaggtttaagaaacccgcacaacgcctgggaaaatggtgcgtggacgcgtcttccgagcgca

SEQ ID NO: 102883 - DNA, 89 bp, Homo sapiens; identical to SEQ ID NO: 70101
  misc_feature 1..89: note = chr1:99611990-99612079
  misc_feature 1..89: note = Hypo
  source 1..89: mol_type = genomic DNA

SEQ ID NO: 102884 - DNA, 88 bp, Homo sapiens; identical to SEQ ID NO: 70102
  misc_feature 1..88: note = chr1:99612139-99612227
  misc_feature 1..88: note = Hypo
  source 1..88: mol_type = genomic DNA

SEQ ID NO: 102885 - DNA, 197 bp, Homo sapiens; identical to SEQ ID NO: 39017
  misc_feature 1..197: note = chr1:100436557-100436754
  misc_feature 1..197: note = Hypo
  source 1..197: mol_type = genomic DNA

SEQ ID NO: 102886 - DNA, 86 bp, Homo sapiens; identical to SEQ ID NO: 4943
  misc_feature 1..86: note = chr1:100437183-100437269
  misc_feature 1..86: note = Hypo
  source 1..86: mol_type = genomic DNA

SEQ ID NO: 102887 - DNA, 34 bp, Homo sapiens; identical to SEQ ID NO: 39019
  misc_feature 1..34: note = chr1:100814764-100814798
  misc_feature 1..34: note = Hypo
  source 1..34: mol_type = genomic DNA

SEQ ID NO: 102888 - DNA, 30 bp, Homo sapiens; identical to SEQ ID NO: 39020
  misc_feature 1..30: note = chr1:100928393-100928423
  misc_feature 1..30: note = Hypo
  source 1..30: mol_type = genomic DNA

SEQ ID NO: 102889 - DNA, 1359 bp, Homo sapiens
  misc_feature 1..1359: note = chr1:101004456-101005815
  misc_feature 1..1359: note = Hyper
  source 1..1359: mol_type = genomic DNA
agtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatgggg

SEQ ID NO: 102890 - DNA, 363 bp, Homo sapiens; identical to SEQ ID NO: 67394
  misc_feature 1..363: note = chr1:101701718-101702081
  misc_feature 1..363: note = Hyper
  source 1..363: mol_type = genomic DNA

SEQ ID NO: 102891 - DNA, 427 bp, Homo sapiens
  misc_feature 1..427: note = chr1:101702369-101702796
  misc_feature 1..427: note = Hyper
  source 1..427: mol_type = genomic DNA
ccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgca

SEQ ID NO: 102892 - DNA, 79 bp, Homo sapiens; identical to SEQ ID NO: 67397
  misc_feature 1..79: note = chr1:101703188-101703267
  misc_feature 1..79: note = Hyper
  source 1..79: mol_type = genomic DNA

SEQ ID NO: 102893 - DNA, 76 bp, Homo sapiens; identical to SEQ ID NO: 26499
  misc_feature 1..76: note = chr1:101703566-101703642
  misc_feature 1..76: note = Hyper
  source 1..76: mol_type = genomic DNA

SEQ ID NO: 102894 - DNA, 83 bp, Homo sapiens; identical to SEQ ID NO: 67399
  misc_feature 1..83: note = chr1:101721485-101721568
  misc_feature 1..83: note = Hypo
  source 1..83: mol_type = genomic DNA

SEQ ID NO: 102895 - DNA, 394 bp, Homo sapiens; identical to SEQ ID NO: 26500
  misc_feature 1..394: note = chr1:101775094-101775488
  misc_feature 1..394: note = Hyper
  source 1..394: mol_type = genomic DNA

SEQ ID NO: 102896 - DNA, 30 bp, Homo sapiens; identical to SEQ ID NO: 67401
  misc_feature 1..30: note = chr1:101918826-101918856
  misc_feature 1..30: note = Hypo
  source 1..30: mol_type = genomic DNA

SEQ ID NO: 102897 - DNA, 122 bp, Homo sapiens; identical to SEQ ID NO: 67405
  misc_feature 1..122: note = chr1:103572643-103572765
  misc_feature 1..122: note = Hyper
  source 1..122: mol_type = genomic DNA

SEQ ID NO: 102898 - DNA, 746 bp, Homo sapiens
  misc_feature 1..746: note = chr1:103573422-103574168
  misc_feature 1..746: note = Hyper
  source 1..746: mol_type = genomic DNA
ctccctttattgtcccgcctacattcatctctttctccagtttccaattccaacctggtagcagctacaatctggattgtatttaagggaattgcttttttttttttttcttgaagagcggggaggaagggtaaagtggggggaggggcgcagaagcagtaggaccgacggcaatctcccacctccccaaatccattttttcttacctcctctgacctctctagcttggaagaggaaggtcaatgcgagggttgttacggtgaaatcccagagccaccgtttcgttttccacctagaggaccacggctccatctccgagccccgcactcacaactgtgaactcaacccacgaaattgcgactgcagaccaacttcgtcctttccaaggtatcgccagggatgtttgctacacagccattggggagggagagggggaaaaagtcaaagggctttttcttctaaatttgatggtttgcgttcttcgtgtctctagccctttcctctccctctgagttggccccaccggccgggaccctccggccgcgaccctctgatccttcctctgccgggccctgccttcagaatgaaggcagatgaggggcttccaccaacaagctgagagtactgtgtgcccctaaaggcttcatgccgtcagtgggctggacgagtggctccgggcagccccctcctccgcccactcccctccctgctcccagctccccctcccagggcgaaactgacaagca

SEQ ID NO: 102899 - DNA, 23 bp, Homo sapiens
  misc_feature 1..23: note = chr1:107161642-107161665
  misc_feature 1..23: note = Hypo
  source 1..23: mol_type = genomic DNA
tgagaccccgtctaaatatatat

SEQ ID NO: 102900 - DNA, 18 bp, Homo sapiens
  misc_feature 1..18: note = chr1:107598664-107598682
  misc_feature 1..18: note = Hypo
  source 1..18: mol_type = genomic DNA
gtgagttaggccgggcgc

SEQ ID NO: 102901 - DNA, 109 bp, Homo sapiens; identical to SEQ ID NO: 67421
  misc_feature 1..109: note = chr1:107600250-107600359
  misc_feature 1..109: note = Hyper
  source 1..109: mol_type = genomic DNA

SEQ ID NO: 102902 - DNA, 1874 bp, Homo sapiens
  misc_feature 1..1874: note = chr1:107682621-107684495
  misc_feature 1..1874: note = Hyper
  source 1..1874: mol_type = genomic DNA
gaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgaggtagtataaggtttgctatccttccacttgctggcagttgcagaagaagatctgctttttaagtgaaacgtacatgccacccctccgagggctgcggcttccccgggcttgcttctttgccgctcctctttccggctctcgcgctcactctttaattggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggcggggagtggcgggccggcgctgggttctcggtcctcggggtcctctcccgccggcggccgggcgcgatcggaatccccgggctgcggcggtggcggcggctcgggtcctcacgcccacccctcccgctccgcccgctcccgcctggggaggaggctccgcgggagctgccgccctccgcccgtacgccgcccgcgggctccgctgctgcggccgccgcccgaggcggaccaggctggctgcgcagggccgccgccccgcgccgtcggctcggctcccgcccggcgcaagggcaaacgagccacacggtaagtgcctgcggctcgcctctcctactgcgacccgagcctctcgcccgtgcccctctcccccgggtttccccaccccccgccgccccccgccccacccgctgcgatgcacaggcgggagggaaggctccgggtgggcgaggaactttgtaaagcgccccgaggaggcagcgcgcggagccctacgcgcacacacagcggcacacgctcacacccacacacaagtcttcccgggggtgcgccccgggccggtgatgcgtcctcttgttgtgtccggagcccaggcgtggggtctgagcctccatccgccgactgacaggggccccgcgctctccctctctcacgcacacctggccacacacatcgctcaggcggcttgtcgttattttttctttctttcgccaattatatttg

SEQ ID NO: 102903 - DNA, 190 bp, Homo sapiens; identical to SEQ ID NO: 67429
  misc_feature 1..190: note = chr1:108432636-108432826
  misc_feature 1..190: note = Hypo
  source 1..190: mol_type = genomic DNA

SEQ ID NO: 102904 - DNA, 1992 bp, Homo sapiens
  misc_feature 1..1992: note = chr1:108506595-108508587
  misc_feature 1..1992: note = Hyper
  source 1..1992: mol_type = genomic DNA
ctgcaggaaggaaagcggaatctctagtgaaacttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctcacaccatctccggacgcaaagctttcgcattcagcttgaggagctaaaccatttcaagccaaggtaggaaacgccaaagtggtgccgaagtggtcccaaagcagaaggctgggaagcagggcaagctcagcgcacctagacgtttgcatttacacaaagaaattagccgcatgattaatgggagctgccggctggaggcggggcgcccgtgccggcctcctcacctgggacatctgcggcctcaggttgatctccttcaggttgatggagtgcgcccggaggttgttaagcagctggcagagcaggactccatcgcggagggtctgcgcaaggtcgaacacctgagccgagtcccaggtcacccggtggttggtgggcagcaccttgcaatggatgagccactgcgcgcactgcttccacggctccatgcccgacggctccgggacgcggctgggccggggcgggcggcaaggatgcggccgccgccgccgccgccgcggttcctccgcgccccgccgacgccaacagccgccggccctttccccgcgcgggatcgagggagcaggagccgcggctgacgggtcgcgggcgccgcgctaggctcggctccggtcccggcccgggtgcgccgcgacccggccgccgctgcagcgagtcccgcgcgctctccgtgcgccccggccggctcggcggcggctgccgcgcacaggcttccgactccagcgcccggcccgccactgagcatgcccagcacgccggccggtctcgctgcggtccgcaagtccccagacgcgcgggtgggagcgcgccggcggccggggctggggtctgtggccgagggcggggcgcgggggaggggccggcggaggggggcggcggccagaaaggggatcccgcgcccccgcctgcagccttgcggggctcacgcagcccccggcgtcctggggtcttctctcggggcggcttcccggctttgcggggagtgtggctgaatactgtaatacgatggggtcccccaggaccccctaaacaacaaatgctcaaaggagcgacggattaattggggcacccagactccccagagcaatgaaaaaagtgcctagagcatcagtagagcacggcgctgaaagttttagagatcgtcgccccctcgccccttgcagctctatcccctccattctctatagctgattcctcagcctattcctcctagttgcccctagtggtgttttggcaccctcaaagtgagtgagagtgcgtgtgtggagacgcctgcggaaaccgccccgatccctgagcctatttcctcgcgaggtgattttcacttggagctggtttgcccctgcactgtcaggctcggaactgtttgccgttgctgttctggcccttttgctgaccccacaaaaacctgcttgagaaaggcctgtgccacggtgctagactgcgcatgcgtcggcgactggcggccgggtttgagagcaaagcgcgttagccctgggcagctcctgccgggctgttctggga

SEQ ID NO: 102905 - DNA, 30 bp, Homo sapiens; identical to SEQ ID NO: 39021
  misc_feature 1..30: note = chr1:109076927-109076957
  misc_feature 1..30: note = Hypo
  source 1..30: mol_type = genomic DNA

SEQ ID NO: 102906 - DNA, 643 bp, Homo sapiens; identical to SEQ ID NO: 67439
  misc_feature 1..643: note = chr1:109203578-109204221
  misc_feature 1..643: note = Hyper
  source 1..643: mol_type = genomic DNA

SEQ ID NO: 102907 - DNA, 30 bp, Homo sapiens; identical to SEQ ID NO: 39022
  misc_feature 1..30: note = chr1:109370476-109370506
  misc_feature 1..30: note = Hypo
  source 1..30: mol_type = genomic DNA

SEQ ID NO: 102908 - DNA, 98 bp, Homo sapiens; identical to SEQ ID NO: 67445
  misc_feature 1..98: note = chr1:109585374-109585472
  misc_feature 1..98: note = Hypo
  source 1..98: mol_type = genomic DNA

SEQ ID NO: 102909 - DNA, 37 bp, Homo sapiens; identical to SEQ ID NO: 67446
  misc_feature 1..37: note = chr1:109585772-109585809
  misc_feature 1..37: note = Hypo
  source 1..37: mol_type = genomic DNA

SEQ ID NO: 102910 - DNA, 28 bp, Homo sapiens
  misc_feature 1..28: note = chr1:109593505-109593533
  misc_feature 1..28: note = Hypo
  source 1..28: mol_type = genomic DNA
tcaagggccaggcaccgcggctcacgcc

SEQ ID NO: 102911 - DNA, 36 bp, Homo sapiens; identical to SEQ ID NO: 39026
  misc_feature 1..36: note = chr1:109631646-109631682
  misc_feature 1..36: note = Hypo
  source 1..36: mol_type = genomic DNA

SEQ ID NO: 102912 - DNA, 30 bp, Homo sapiens; identical to SEQ ID NO: 67450
  misc_feature 1..30: note = chr1:109642384-109642414
  misc_feature 1..30: note = Hypo
  source 1..30: mol_type = genomic DNA

SEQ ID NO: 102913 - DNA, 103 bp, Homo sapiens; identical to SEQ ID NO: 39027
  misc_feature 1..103: note = chr1:109644233-109644336
  misc_feature 1..103: note = Hypo
  source 1..103: mol_type = genomic DNA

SEQ ID NO: 102914 - DNA, 35 bp, Homo sapiens; identical to SEQ ID NO: 67452
  misc_feature 1..35: note = chr1:109646883-109646918
  misc_feature 1..35: note = Hypo
  source 1..35: mol_type = genomic DNA

SEQ ID NO: 102915 - DNA, 71 bp, Homo sapiens; identical to SEQ ID NO: 26513
  misc_feature 1..71: note = chr1:109656220-109656291
  misc_feature 1..71: note = Hyper
  source 1..71: mol_type = genomic DNA

SEQ ID NO: 102916 - DNA, 576 bp, Homo sapiens; identical to SEQ ID NO: 67454
  misc_feature 1..576: note = chr1:109656494-109657070
  misc_feature 1..576: note = Hyper
  source 1..576: mol_type = genomic DNA

SEQ ID NO: 102917 - DNA, 30 bp, Homo sapiens; identical to SEQ ID NO: 67455
  misc_feature 1..30: note = chr1:109679322-109679352
  misc_feature 1..30: note = Hypo
  source 1..30: mol_type = genomic DNA

SEQ ID NO: 102918 - DNA, 30 bp, Homo sapiens; identical to SEQ ID NO: 39028
  misc_feature 1..30: note = chr1:109701309-109701339
  misc_feature 1..30: note = Hypo
  source 1..30: mol_type = genomic DNA

SEQ ID NO: 102919 - DNA, 110 bp, Homo sapiens; identical to SEQ ID NO: 67457
  misc_feature 1..110: note = chr1:109772113-109772223
  misc_feature 1..110: note = Hypo
  source 1..110: mol_type = genomic DNA

SEQ ID NO: 102920 - DNA, 30 bp, Homo sapiens; identical to SEQ ID NO: 67458
  misc_feature 1..30: note = chr1:109797867-109797897
  misc_feature 1..30: note = Hypo
  source 1..30: mol_type = genomic DNA

SEQ ID NO: 102921 - DNA, 61 bp, Homo sapiens; identical to SEQ ID NO: 67459
  misc_feature 1..61: note = chr1:109941488-109941549
  misc_feature 1..61: note = Hypo
  source 1..61: mol_type = genomic DNA

SEQ ID NO: 102922 - DNA, 78 bp, Homo sapiens; identical to SEQ ID NO: 67460
  misc_feature 1..78: note = chr1:110009016-110009094
  misc_feature 1..78: note = Hyper
  source 1..78: mol_type = genomic DNA

SEQ ID NO: 102923 - DNA, 235 bp, Homo sapiens; identical to SEQ ID NO: 26515
  misc_feature 1..235: note = chr1:110009583-110009818
  misc_feature 1..235: note = Hyper
  source 1..235: mol_type = genomic DNA

SEQ ID NO: 102924 - DNA, 30 bp, Homo sapiens; identical to SEQ ID NO: 67462
  misc_feature 1..30: note = chr1:110010091-110010121
  misc_feature 1..30: note = Hyper
  source 1..30: mol_type = genomic DNA

SEQ ID NO: 102925 - DNA, 80 bp, Homo sapiens; identical to SEQ ID NO: 67463
  misc_feature 1..80: note = chr1:110086023-110086103
  misc_feature 1..80: note = Hypo
  source 1..80: mol_type = genomic DNA

SEQ ID NO: 102926 - DNA, 30 bp, Homo sapiens; identical to SEQ ID NO: 67464
  misc_feature 1..30: note = chr1:110186147-110186177
  misc_feature 1..30: note = Hyper
  source 1..30: mol_type = genomic DNA

SEQ ID NO: 102927 - DNA, 21 bp, Homo sapiens
  misc_feature 1..21: note = chr1:110196410-110196431
  misc_feature 1..21: note = Hypo
  source 1..21: mol_type = genomic DNA
acagaagtgcccaggcgcgtt

SEQ ID NO: 102928 - DNA, 438 bp, Homo sapiens
  misc_feature 1..438: note = chr1:110230121-110230559
  misc_feature 1..438: note = Hyper
  source 1..438: mol_type = genomic DNA
agaagagctttgctccgttaggatctggctggtgtctcaagcgcacagccaagtcgctgtggacctagcaagggctggatggactcgtggagcctcagggctgggtagggaagctggcgaggccgagccccgccttgggcttctgggcgccctgacttcgctcccggaaccctcgggcctgggaggcgggaggaagtcttactgagtgcagccccaggcgccctctcccgggcctccagaatggcgcctttcgggttgtggcgggccgaggggcggggtcgcagcaaggccccgcctgtcccctctccggagctcttatactctgagccctgctcggtttaggcctgtctgcggaatccgcaccaaccagcaccatgcccatgatactggggtactgggacatccgcggggtgagcgagggtccgctggacggtggga

SEQ ID NO: 102929 - DNA, 697 bp, Homo sapiens; identical to SEQ ID NO: 67466
  misc_feature 1..697: note = chr1:110282542-110283239
  misc_feature 1..697: note = Hyper
  source 1..697: mol_type = genomic DNA

SEQ ID NO: 102930 - DNA, 55 bp, Homo sapiens; identical to SEQ ID NO: 67467
  misc_feature 1..55: note = chr1:110305550-110305605
  misc_feature 1..55: note = Hypo
  source 1..55: mol_type = genomic DNA

SEQ ID NO: 102931 - DNA, 3130 bp, Homo sapiens
  misc_feature 1..3130: note = chr1:110610349-110613479
  misc_feature 1..3130: note = Hyper
  source 1..3130: mol_type = genomic DNA
gcgacctgcagaactcgctgaggcccaggctcctgcagctcccgccgaagactcaaagccagagtggacataaacgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaaccgggaaataaggcgggttccctcttcgcccgccacttcccaccaagtaggctgtgcggccctgggggctgactgtcctcaagcagccaggctccaccgcgcgccgcgctgcgccgaggtccgctctgccgcagggacgctggcagcccgttgaacaccggcaagagcgccagaggctagcggccgccaggatctctaccaggctctgctcgcacccgcctgcctccctttcgtttggcctgtcctccgttcaactgaaatcgttaattttcttacccccttgttctcattttgatatattctacgctttaaacatgctccgttttcttttgtttagtctgctccctccctctttgtcctttcccccttctctagttatccgtttcgttcgatcttgctcctgctttttttattcgttcgttcctcatttattcattttagttcatcccagctcgccgactgccatttaccctctcgttctcgccgcgctctccgttgttttgttcaatttcccttccccttttcttggttgtcgctcgctttctttggttttctttctcggtatttcgttgtcaaggccacccttgccgtcggatcccggggtgctgggtttctcccggccgctcgttccgcaccagcgctctctgcagttcgcgcggcaccggtgtggtccgggggcccgagctgtcggtgccggatgcggcgcgcctagcagggacgcgggcctgggggggtggctcctgcccgacgcggagcgctgagccaggccgggtacctgtctctggcggtgctcaccgcactgcgcggcctctgccgtctggctgggatcagaggagccaggccaactgcttctcattaagtcccaactgtggtttttatcaggaaagcctctttcaaagggcacagacacgaagctccgcggactcgttcatttcctccgttgacccacacacacctccccgccctcccctacacattcccaccgccccggctgggcgaaagccggagatgcccggccactccgtggaggcccgcgaggcgccagccgggcggcggcagggggttgaggcggatcttggaggatccagttctgggcctaggctgcgggatatggcagcgcagataaggtgggtgcagtgcggaagccgagacgccttacaggtcatagggtgcggcggacggccgcagagctgccgatcagcctgccaggcccctgccttcaggcgcattctcggatgccggcgcggtccagccggccttagcacagggcaccggcccgtgagcccgcggcgccagggggttaggctgcccagggctgctcctgactgcccagcggtgatgatccagcgcggggaagccaagactgccagaagggcggctatcatagtgcataacggcagggaggccagcttagtatgagaaataagaatacagttattccgtcttgaggacagccctggcattgcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccaactgctttcgggccccgactggactccgggccgtcgccactgcaccttccctcgacctcccgccttccattcccgccgccgaggaacggtggttcaccctcccgccccacactggcctttgcctggcccgggccagcgccaacccggcttccgtggaagccgtggcgaaaggcgagaggggcaaaaagttgagaaataggcgagcgggagagataagcaggaaggcccgggtgggcccgggtaaggaagaagaagagagggtcgggctgcgcgctacgccccgcgccgcgcgttaccttccgcggggccctcgtagaagtggccgccgttgagggccgggccgggcccgaggtcctgcaggtacttggcgggcggcttggccggctctgggaggtagggctccaggggcccgcaggccggaaagcgggtcagccgcgggccgcggggcggcgcggggtgcaggtgaggcgcagcggcgggggttccctgcgggcccggaggctcgtcccccgaggccacataggggccgggtgcaggccccacgcggaaaggcgcgcagtgctcggggtccatgccggctcagggcgcacaggcctccggggctccggggctcgcgctgcccgcgccgcctgtgagcgcccgccaagggggagggacctgggcgcgggggcgcggagcccccgggagcggcgcgcgccgcggggggcggggggcggggggcaggggagggggccgcgcctctgacttaatgctggaaccatccacgtcacgtgtggccccgtgcgggttaacccctcggagcccgggaaccccctccc

SEQ ID NO: 102932 - DNA, 1286 bp, Homo sapiens
  misc_feature 1..1286: note = chr1:110626380-110627666
  misc_feature 1..1286: note = Hyper
  source 1..1286: mol_type = genomic DNA
cccctccgccaaaaccgtatgatattttagggaagcccctctttattcattagaaatcggctgctttgagtttggcccctaaaaacttgcctcctgccccggaagatttattttattaaatggtccacacctgaaagtaattgagtctcggcgtgggtgcggggactgcggagggagggtccaggcgcggcagcggcagtggcggcggctctcagctcctctccagcttcgcaccctgtgcctccgggcgccctagtctccccgccacgccgcgacctttcctcggcctcccgctcccgctttgcggaaaggtccggggcgcgtgtaggggaaggagagagaggtatgtggggcgagcgggagttgagcgtggatgtggggaagggggtgcgtcctgcgtcgcccccgcaccctcgcgtggccgggcgcagatccccgtgcacgggtcctccgcacacccttgccagcccgcagggattgttcgccgcgttggtgactccttcccaaaatgggaataaaagatcgaaatagctagtaagcatgcaaagtttattgtcaacctcaagtctctataaaaccagatcaaagggaacaggcgtttggtttcttcccagatcgctggggggcctcggggctcaggaagccccaggagtccagcccgctgccgctcactgcgctcttctctccagccgggtccaagggctcgagcatcgcaacctgcggcctgagttggccccgggcgcacgcgagggaaatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcaggacgggatgaaactcctctgggtttccagtcagatgtgcgagtgggctctctt

SEQ ID NO: 102933 - DNA, 519 bp, Homo sapiens
  misc_feature 1..519: note = chr1:110672833-110673352
  misc_feature 1..519: note = Hyper
  source 1..519: mol_type = genomic DNA
ctgtattttcagcctcggtttgacgtcaggctctcacggtcccaaaggatgggctttgtacatttccaggccgcagaccggagcctcccatccctttgggcctcttgggcggtccctacggccacctcccgcagctccctgggggcgggggaccgctggatgagggaggaggggaggtactggggggaaagggcggttggcgggaaggaagtccaggtgagacaggcccgcgttgggactatcgtgcgcggtatgtcggccggcaggtggggctggtccgggcgcaggaggcggtagagcaggagcagcagggggagccaggctggccgagctggggggtgagcacgtttgtctcaggcagctcatcgcctgacacccccgggaacgggctctgccccaaggcctaaaatgagggaagatgaggaaatgggggtggggacgatggagaggatggaaggggcggcgggggggtgcggtggtctgcgcggtacagcagcgtccctgcgggttcccctcatt

SEQ ID NO: 102934 - DNA, 1412 bp, Homo sapiens
  misc_feature 1..1412: note = chr1:110692884-110694296
  misc_feature 1..1412: note = Hyper
  source 1..1412: mol_type = genomic DNA
ggccccattcctctccgagggcagaagccctggcgagggctccagggtctgcatcccctgaccaggggcctcaagaagctaagcccccttgcaactccctctcccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtgagtcgctggccgcgccccgcctggctttaccgggccggccactgcaactttccctgttctggccccgccccagccagggagggctgaggaccaaggtgtgaggcggcgctgcccccgcatccgcccgaccctgcgctcgtcccgggctcctctcgccgctccagccgccgttgcctggcgacggagccccggggcccgctctccttcgcgcatcggggtccccagcggcgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcggctgccttggaaagaagcgtgatgtttccttt

SEQ ID NO: 102935 - DNA, 159 bp, Homo sapiens; identical to SEQ ID NO: 67480
  misc_feature 1..159: note = chr1:110726609-110726768
  misc_feature 1..159: note = Hypo
  source 1..159: mol_type = genomic DNA

SEQ ID NO: 102936 - DNA, 746 bp, Homo sapiens
  misc_feature 1..746: note = chr1:110754116-110754862
  misc_feature 1..746: note = Hyper
  source 1..746: mol_type = genomic DNA
ttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtgagtggcaggagcccgtgtctccccatcttgggtctgcaaggggtccgtggtgggtggtgg

SEQ ID NO: 102937 - DNA, 765 bp, Homo sapiens; identical to SEQ ID NO: 67483
  misc_feature 1..765: note = chr1:110883470-110884235
  misc_feature 1..765: note = Hypo
  source 1..765: mol_type = genomic DNA

SEQ ID NO: 102938 - DNA, 42 bp, Homo sapiens; identical to SEQ ID NO: 67486
  misc_feature 1..42: note = chr1:110949152-110949194
  misc_feature 1..42: note = Hypo
  source 1..42: mol_type = genomic DNA

SEQ ID NO: 102939 - DNA, 165 bp, Homo sapiens; identical to SEQ ID NO: 67488
  misc_feature 1..165: note = chr1:111039979-111040144
  misc_feature 1..165: note = Hypo
  source 1..165: mol_type = genomic DNA

SEQ ID NO: 102940 - DNA, 674 bp, Homo sapiens; identical to SEQ ID NO: 67490
  misc_feature 1..674: note = chr1:111097796-111098470
  misc_feature 1..674: note = Hyper
  source 1..674: mol_type = genomic DNA

SEQ ID NO: 102941 - DNA, 947 bp, Homo sapiens; identical to SEQ ID NO: 67491
  misc_feature 1..947: note = chr1:111149588-111150535
  misc_feature 1..947: note = Hyper
  source 1..947: mol_type = genomic DNA

SEQ ID NO: 102942 - DNA, 38 bp, Homo sapiens; identical to SEQ ID NO: 67494
  misc_feature 1..38: note = chr1:111204435-111204473
  misc_feature 1..38: note = Hypo
  source 1..38: mol_type = genomic DNA

SEQ ID NO: 102943 - DNA, 1373 bp, Homo sapiens
  misc_feature 1..1373: note = chr1:111216695-111218068
  misc_feature 1..1373: note = Hyper
  source 1..1373: mol_type = genomic DNA
tgaggatgaccagcacggacacgatggcgatgccccgggccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggccggttgcggtcgaagaagtactcgttgcggagcgggtcgaagtacctcatgcgccgcttggggtcgcccagcagcgtctcggggaactggcaaagggtcttcagctgcgtctcgaagcgcagcccggagatgttgatgaccacgcgctccccgcagcagtcctgctcgcccgcggccggcagtgagggcggcagcggctcgtagcggtcgcagccgccgccgccacagccgccttgaggcggggcccctccaccatcggccacctccggctccagcaggtggtccccgggcaccacggtcatgtcgggcggcagctcgcggcctgcggcgggctccgcgtagccgtggttcaccagcgtgtgggcaccgccgctgctcgctgggcgctgaggagggtgggcgcggtggcgggctgagggcggcggcggcgagcgcagaaggctgaggcgctcgtccatgcggcggggaagaggcggcagcggtgaggccaggtcgctcctcctcgcgctccccgccctttcgccgcctccgcccccgagccgagcccaccgcctgttgcagccaaagccgcgatgctctgtctgggtctggcgcggtcagccgggctcccgcacggggacgcctcctccctccttctcgcgctctccgccccctcccctgcggggcgcgcgcccgcctccgcgtccccttaggattcccgcccaccgcgcgggcgcgcgtcccgctctcgggggcagccgccgggcctgcatttcttgcagccctcaaggcccctcggtgtcagcgaaagagccctcatgttgtacctcggcgccccgcgggaatgcccacccagcagagccggcccacggggagtcaggctgccggcccgggcccctaggctccgcccgcttctggtcagcgcccctcgcccccggcccgcctggccgcgtcccagtcgccagggttttcggcccgtgggccgggagagctcccgccgcggccccgcgggcgccggccccctggcctccacacccctaggtacagcccggggagggcaggcgggcccagtgtccagggagggagtgcaggccaggcgggcgccctgggccagag

SEQ ID NO: 102944 - DNA, 715 bp, Homo sapiens; identical to SEQ ID NO: 67504
  misc_feature 1..715: note = chr1:111505931-111506646
  misc_feature 1..715: note = Hyper
  source 1..715: mol_type = genomic DNA

SEQ ID NO: 102945 - DNA, 41 bp, Homo sapiens; identical to SEQ ID NO: 26539
  misc_feature 1..41: note = chr1:111813546-111813587
  misc_feature 1..41: note = Hyper
  source 1..41: mol_type = genomic DNA

SEQ ID NO: 102946 - DNA, 199 bp, Homo sapiens; identical to SEQ ID NO: 39035
  misc_feature 1..199: note = chr1:112084890-112085089
  misc_feature 1..199: note = Hypo
  source 1..199: mol_type = genomic DNA

SEQ ID NO: 102947 - DNA, 16 bp, Homo sapiens
  misc_feature 1..16: note = chr1:112192214-112192230
  misc_feature 1..16: note = Hypo
  source 1..16: mol_type = genomic DNA
acgaccagaatattag

SEQ ID NO: 102948 - DNA, 496 bp, Homo sapiens; identical to SEQ ID NO: 67509
  misc_feature 1..496: note = chr1:112282866-112283362
  misc_feature 1..496: note = Hyper
  source 1..496: mol_type = genomic DNA

SEQ ID NO: 102949 - DNA, 279 bp, Homo sapiens; identical to SEQ ID NO: 67510
  misc_feature 1..279: note = chr1:112531573-112531852
  misc_feature 1..279: note = Hyper
  source 1..279: mol_type = genomic DNA

SEQ ID NO: 102950 - DNA, 679 bp, Homo sapiens; identical to SEQ ID NO: 67511
  misc_feature 1..679: note = chr1:112533107-112533786
  misc_feature 1..679: note = Hyper
  source 1..679: mol_type = genomic DNA

SEQ ID NO: 102951 - DNA, 152 bp, Homo sapiens; identical to SEQ ID NO: 39037
  misc_feature 1..152: note = chr1:112784462-112784614
  misc_feature 1..152: note = Hypo
  source 1..152: mol_type = genomic DNA

SEQ ID NO: 102952 - DNA, 530 bp, Homo sapiens
  misc_feature 1..530: note = chr1:113051583-113052113
  misc_feature 1..530: note = Hyper
  source 1..530: mol_type = genomic DNA
tccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtaagtgtggctctcaggctgggcgggtgaggcgcttggtaggagag

SEQ ID NO: 102953 - DNA, 30 bp, Homo sapiens
  misc_feature 1..30: note = chr1:113286877-113286907
  misc_feature 1..30: note = Hyper
  source 1..30: mol_type = genomic DNA
gccgggctcctctctcgctcccagggcctg

SEQ ID NO: 102954 - DNA, 671 bp, Homo sapiens; identical to SEQ ID NO: 67515
  misc_feature 1..671: note = chr1:113392209-113392880
  misc_feature 1..671: note = Hyper
  source 1..671: mol_type = genomic DNA

SEQ ID NO: 102955 - DNA, 217 bp, Homo sapiens
  misc_feature 1..217: note = chr1:113497971-113498188
  misc_feature 1..217: note = Hyper
  source 1..217: mol_type = genomic DNA
ccatgagtagaagggcgctgcggcggacgctggcagccacaggttgaatgacaaagagcccccgtcagcaccactcccaggagtctgcgggctgccccgtcccctccgcaaagtctactcgaaccctgcagtcacgccttggctgtggggaatgcggctctccgcaccactctcgcaagtcaccaggtggggcaaggatcggcgggccaagaaggtt

SEQ ID NO: 102956 - DNA, 30 bp, Homo sapiens; identical to SEQ ID NO: 67518
  misc_feature 1..30: note = chr1:113617180-113617210
  misc_feature 1..30: note = Hypo
  source 1..30: mol_type = genomic DNA

SEQ ID NO: 102957 - DNA, 86 bp, Homo sapiens; identical to SEQ ID NO: 39038
  misc_feature 1..86: note = chr1:113751201-113751287
  misc_feature 1..86: note = Hypo
  source 1..86: mol_type = genomic DNA

SEQ ID NO: 102958 - DNA, 59 bp, Homo sapiens; identical to SEQ ID NO: 67523
  misc_feature 1..59: note = chr1:114355897-114355956
  misc_feature 1..59: note = Hypo
  source 1..59: mol_type = genomic DNA

SEQ ID NO: 102959 - DNA, 120 bp, Homo sapiens; identical to SEQ ID NO: 67524
  misc_feature 1..120: note = chr1:114448980-114449100
  misc_feature 1..120: note = Hypo
  source 1..120: mol_type = genomic DNA

SEQ ID NO: 102960 - DNA, 893 bp, Homo sapiens
  misc_feature 1..893: note = chr1:114695312-114696205
  misc_feature 1..893: note = Hyper
  source 1..893: mol_type = genomic DNA
cctgccgcgactccccggagacgccgcagctgcgcgccagggtccagcccggcggggatcgggctcgggactcacccgctccggcgagctcgactcagctcgggctcccgcctcggctaggcagccgcctggggctgcgtcccgcgcagggtcagcgcggatcgggcaggaggcgccctcttggcaaagtcggctagaggcgccagctcagtcgcgcaccggccccgagtccgagtccgagagggacggagggagcgagttataggggcgagagggggtgggggaaggacgccgcaacaccctcataccctcccccaccccgccccctgtcccccgccccccagcggagacgcggaaaaccactcgcagccggagagacacccggacacaaagacctcgtgccagccgcagacccaagtttctcccggagagactgggggtccgcccgcgttcaccgcgagaacacacaaacggacggacagaccgacgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctcccaatccagaatcccgagctggggagttctctctaggttctggggctcctgggaccggggctttggggaagggagatcgcaggacggatatccaggaag

SEQ ID NO: 102961 - DNA, 804 bp, Homo sapiens
  misc_feature 1..804: note = chr1:114696412-114697216
  misc_feature 1..804: note = Hyper
  source 1..804: mol_type = genomic DNA
tgccgagcagcagctcgaacccgcgccccggccgcactggggcggggcacgacggccccaagaagaccctccctgcagcggccccctgcggctccgctctgcttttaatcacttccccgcagggtccccgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccgcattcactgcctggtgtgaccttgggcgtctctgagcctcaattttcctctccgtaaaggaggtgtaatgattttaagtacttcacggactccctggggatagaaagatcgtgtttgtgaaaacactgggtaaactgccacatgccacacgaatgacagagaaatagataaccccgtaacagaaagagcgacggtcaggcagggtctgggaggaccttggccgaggttcctgacgggagcagttagactggcccccgagtcccagcttcggaggtagaagaccccaagacaggcgggcgatgcgaactgcaagactttccgagctccgcaatcctgcggtccgcggtacccgcatgttgctatggcgacgggaggcagcggccgtctctctccatggcaacgggagggaaaagtttctggcaaacaggaatggggggtcatttcaagagggcgcagggcgctcagttccgccgacccacctccttgcttcggtgaaacagcacc

SEQ ID NO: 102962 - DNA, 257 bp, Homo sapiens; identical to SEQ ID NO: 67532
  misc_feature 1..257: note = chr1:114697661-114697918
  misc_feature 1..257: note = Hyper
  source 1..257: mol_type = genomic DNA

SEQ ID NO: 102963 - DNA, 96 bp, Homo sapiens; identical to SEQ ID NO: 67533
  misc_feature 1..96: note = chr1:115055222-115055318
  misc_feature 1..96: note = Hypo
  source 1..96: mol_type = genomic DNA

SEQ ID NO: 102964 - DNA, 693 bp, Homo sapiens
  misc_feature 1..693: note = chr1:115631944-115632637
  misc_feature 1..693: note = Hyper
  source 1..693: mol_type = genomic DNA
gccccctgccctgaccggccctcccggctcctggtctcacccagaagagcaggttgaagccaagcagcaggtacttgatgcaccgcaggcccccgcggaagcgccccatgctgcggcccggcggcgggatccccagtccccaggcccgcgctacgagcgcggggagcggcaggctccggcggggagggggcggagcggggaggaccggggcggggcctccggggggcggggcggggcccggcggggaggggcgcgtggaccccaagcggcgtggctggcgacgggtgggggcgccagcgggtggagatcgagcagcccgagggagcacgttcgctcttctcccggacccagggaccaccttccttccctccagtgggcgcaccgccgccggctatcggagcacctgcagggcgggagcgcccaccggggactggggacccatttaatcagcgccctgtgcggagaccggtttgaggcccgggcgatgcttgagggataagcacttggtctcgtggctatggaaatctaggaaggtgacctcgggtagaagagctaagtggggtcggaggttgccccgaagctggcaggaccagtcgcggggcacctgactgagtgtccagggctgcggctccgcggcgcggagcaagcacacaagcagcttctaggggaccctccctccggcccctcccccct

SEQ ID NO: 102965 - DNA, 30 bp, Homo sapiens; identical to SEQ ID NO: 67539
  misc_feature 1..30: note = chr1:115828832-115828862
  misc_feature 1..30: note = Hypo
  source 1..30: mol_type = genomic DNA

SEQ ID NO: 102966 - DNA, 1181 bp, Homo sapiens
  misc_feature 1..1181: note = chr1:115880037-115881218
  misc_feature 1..1181: note = Hyper
  source 1..1181: mol_type = genomic DNA
actcaaggcgctccccgccctaaccttccacgcccgcttctcccacacctggcagcagacagctggagatgaagcgtgtgacccaagtggcagggctgaaccttggcgacctctacctgaggttgtccaacgcggctccgtggagggccccggtacgccggacggaccccggcgttggctcgcagacttcctgcgttaacccccggggccctcagtcacgactcccagcccttccgagacgcgctgagggaactgccccaggtctagcgcgccccgttccgctcctccccctacctgggggccgcgcagcactttccctactcggcgctcacctcagccagcgcgctctgcgctccccccgcggtgctggccgccactcctcccgccctggcgcgccagctgccggcgcatccctctccgcgcccattcgctctccctcacttgcgcgttatccacttctagccctcgagctagaccctggcatggccgtgggcttctgcaggcgccagggctgctccctggactgcaggccatcctgggactagggactccacgaccagaactaacgctgttccctcggtccgactcgtcctcccgcgagggtcccgcgcccccacacccactcgggacatttctcagggctgctcttcggcctgcgggagcctcgggggtaaccagagagctcgccagaccggtatccttgcaaactctcccgcgaagcccagccacccctgcccgcgcccgcgctgcgcccctctcgggatcggctcggggcagcctgactcaccgctgcgctcccctccggctcccagcgctctctgctgtgccggagcgccgagctgctctcacacaggcttcttgaattcttagcccctcctcccgtactcctgagtcacacgctccaaatcctggcccccatccctcccctccccaccaccagccccgcacctgctgtggctgggctgtggtgcccggctggagggggtcctggggactacagacggatcgctcctggagggctggccagacccagccagagaaggactttaaaccttcagaggtcaaagggaaacccactggggtctgaggggccgcgcgcgcaaagccgggagggggagtttctggggcaccggcaggggtcgttgggccgactggctggggctgggcggagttgctcgcag

SEQ ID NO: 102967 - DNA, 142 bp, Homo sapiens; identical to SEQ ID NO: 67546
  misc_feature 1..142: note = chr1:116213911-116214053
  misc_feature 1..142: note = Hypo
  source 1..142: mol_type = genomic DNA

SEQ ID NO: 102968 - DNA, 196 bp, Homo sapiens; identical to SEQ ID NO: 67547
  misc_feature 1..196: note = chr1:116214288-116214484
  misc_feature 1..196: note = Hypo
  source 1..196: mol_type = genomic DNA

SEQ ID NO: 102969 - DNA, 45 bp, Homo sapiens; identical to SEQ ID NO: 39042
  misc_feature 1..45: note = chr1:116214942-116214987
  misc_feature 1..45: note = Hypo
  source 1..45: mol_type = genomic DNA

SEQ ID NO: 102970 - DNA, 30 bp, Homo sapiens; identical to SEQ ID NO: 67549
  misc_feature 1..30: note = chr1:116247777-116247807
  misc_feature 1..30: note = Hypo
  source 1..30: mol_type = genomic DNA

SEQ ID NO: 102971 - DNA, 574 bp, Homo sapiens
  misc_feature 1..574: note = chr1:116371021-116371595
  misc_feature 1..574: note = Hyper
  source 1..574: mol_type = genomic DNA
caccgtgtccacaggcgcccactggtgtggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacacgtcagtcaattcagtggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatcccaaaccagacaagaagccaaagacaaatcccagcccacatgcagatccgacgcggaaaggagcgcgg

SEQ ID NO: 102972 - DNA, 1644 bp, Homo sapiens; identical to SEQ ID NO: 67552
  misc_feature 1..1644: note = chr1:116380300-116381944
  misc_feature 1..1644: note = Hyper
  source 1..1644: mol_type = genomic DNA

SEQ ID NO: 102973 - DNA, 111 bp, Homo sapiens; identical to SEQ ID NO: 26566
  misc_feature 1..111: note = chr1:116382387-116382498
  misc_feature 1..111: note = Hyper
  source 1..111: mol_type = genomic DNA

SEQ ID NO: 102974 - DNA, 61 bp, Homo sapiens; identical to SEQ ID NO: 39043
  misc_feature 1..61: note = chr1:116574202-116574263
  misc_feature 1..61: note = Hypo
  source 1..61: mol_type = genomic DNA

SEQ ID NO: 102975 - DNA, 771 bp, Homo sapiens; identical to SEQ ID NO: 67556
  misc_feature 1..771: note = chr1:116710521-116711292
  misc_feature 1..771: note = Hyper
  source 1..771: mol_type = genomic DNA

SEQ ID NO: 102976 - DNA, 30 bp, Homo sapiens; identical to SEQ ID NO: 67558
  misc_feature 1..30: note = chr1:116946453-116946483
  misc_feature 1..30: note = Hypo
  source 1..30: mol_type = genomic DNA

SEQ ID NO: 102977 - DNA, 30 bp, Homo sapiens; identical to SEQ ID NO: 67561
  misc_feature 1..30: note = chr1:117239297-117239327
  misc_feature 1..30: note = Hypo
  source 1..30: mol_type = genomic DNA

SEQ ID NO: 102978 - DNA, 359 bp, Homo sapiens; identical to SEQ ID NO: 67565
  misc_feature 1..359: note = chr1:117452844-117453203
  misc_feature 1..359: note = Hyper
  source 1..359: mol_type = genomic DNA

SEQ ID NO: 102979 - DNA, 34 bp, Homo sapiens; identical to SEQ ID NO: 67568
  misc_feature 1..34: note = chr1:117665071-117665105
  misc_feature 1..34: note = Hyper
  source 1..34: mol_type = genomic DNA

SEQ ID NO: 102980 - DNA, 30 bp, Homo sapiens; identical to SEQ ID NO: 67574
  misc_feature 1..30: note = chr1:118173786-118173816
  misc_feature 1..30: note = Hypo
  source 1..30: mol_type = genomic DNA

SEQ ID NO: 102981 - DNA, 110 bp, Homo sapiens; identical to SEQ ID NO: 67576
  misc_feature 1..110: note = chr1:118277822-118277932
  misc_feature 1..110: note = Hyper
  source 1..110: mol_type = genomic DNA

SEQ ID NO: 102982 - DNA, 30 bp, Homo sapiens; identical to SEQ ID NO: 67579
  misc_feature 1..30: note = chr1:118522258-118522288
  misc_feature 1..30: note = Hypo
  source 1..30: mol_type = genomic DNA

SEQ ID NO: 102983 - DNA, 286 bp, Homo sapiens; identical to SEQ ID NO: 67582
  misc_feature 1..286: note = chr1:118727824-118728110
  misc_feature 1..286: note = Hyper
  source 1..286: mol_type = genomic DNA

SEQ ID NO: 102984 - DNA, 75 bp, Homo sapiens
  misc_feature 1..75: note = chr1:119521963-119522038
  misc_feature 1..75: note = Hyper
  source 1..75: mol_type = genomic DNA
cccagggatcctccacgtcacgatcccacaggatgactttcctttttaacagactagctacgatatatactgacc

SEQ ID NO: 102985 - DNA, 643 bp, Homo sapiens
  misc_feature 1..643: note = chr1:119522297-119522940
  misc_feature 1..643: note = Hyper
  source 1..643: mol_type = genomic DNA
tcaccagggccttcccggttagcccagggtccccacatttctccaggatgtaattagagctaagaacagccgccatccctcagggttccgggtcccgggtttccagggtcccgggtttccaaggccccgcgataaccccgggcgcacgcggcgcgatgcggcgaggcgaggcgaggcggtggggccagcgcggagccccaggcgcgagaacaggaactcgggctggcacaccgaggcctcgcagccaagccgcgcctgacccgttcgccgttccggccccgcggcgcctccaaggccgggccgaggggccgaggggccgagggcgggcagacgcggccacggcctaattctgacttctgaaggtcaccgaaactgcgctgtttttccagagatgggttgaagagaagagatgcaatcccagttccttctgcggcgaaacgggatctgaaattcttggagagggggaagaattggacgttttcatcgtgcgtggaggaaaattgggggaggggaagtgagtggcaagtaagggggttaactgcttcccggaccctatccggagtttaaactacacgctcccagctgtgggatagtaaagagaacgcagcggtgaggggattcggaaaatcggttcatccagttg

SEQ ID NO: 102986 - DNA, 885 bp, Homo sapiens
  misc_feature 1..885: note = chr1:119526767-119527652
  misc_feature 1..885: note = Hyper
  source 1..885: mol_type = genomic DNA
tagcagttgagctgacgggtgcgtgcgagaatgcgagacctgccacgtgtacacgtgtacgcggagtgtcgatctgcctgcgtgtccttggatgtgcctgtctaggtgcccacccgcgcgcgccaccacatccccaggcctctggaacgcagctgctgtgtggcccggcccgaagtttctggaggaggaaatccctccacagaaggtttacattatttcgctccgcgggagacccggcttcggcagcacttagcagaagattttggcgggaaaggcccaagccctagctgaggactccgggtggagcaggggctgaggtccgagcgcagatggcgccgccgagcgcctgaaatatacttgcaaggccgcagcaatatacttgcaaggccgcagccggagcagctgttccagccgatcctagctcgaaagttcctctgttgctctgggagagggcgggggagagcaggctcgagagccaggctcctccgaggctggtcttgaggcacttctctagtagcttctccaaaagactgagagtgccggcgtaggtatgacagtgagggtacctcacagacccttctccaaagtctggcgggccttggggtttttcggggccaccaggctcggtggaatttttgaaacgctttcgaaatacatagtttcctctgtggagtgagtgcctacaacgcgcaggccggactgatcccccgttgctgcaggttggtgccccaagctgcgggtgctcgggcgccaactaaagccagctctgtccagacgcggaaagaaaaatgggctgtgaaaaagcaaaaggcctcgtctttgaatgaaagttaaacattaaaatctgaccctagagttgtctaaagatcgcggaattttgaagct

SEQ ID NO: 102987 - DNA, 310 bp, Homo sapiens; identical to SEQ ID NO: 67595
  misc_feature 1..310: note = chr1:119527868-119528178
  misc_feature 1..310: note = Hyper
  source 1..310: mol_type = genomic DNA

SEQ ID NO: 102988 - DNA, 956 bp, Homo sapiens
  misc_feature 1..956: note = chr1:119528611-119529567
  misc_feature 1..956: note = Hyper
  source 1..956: mol_type = genomic DNA
acataaggccctagacgggctccgtgcgatctggggcctcccaagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaattgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtccgggctggaaagcttctgaaaccgctaaaccaagttgcgagcgttgtatgtgcgcgcgcgcacactcaagattcttccgacaacagctgttcccccgggctgtttttgcacagttgaaatcttggcacttaacacaaaacgttaaagttggcttctcccctcctagggttctgttaaaatacagacatgacatcccccctgctttttacatgttccgtgcacataatata

SEQ ID NO: 102989 - DNA, 1509 bp, Homo sapiens
  misc_feature 1..1509: note = chr1:119529777-119531286
  misc_feature 1..1509: note = Hyper
  source 1..1509: mol_type = genomic DNA
caactggtcattccccgaagactgaggtattggattggagaacgccgcgccagtcctcccgagttctcagaagcgagtcctagatctcggctcccgccgttgccttcggcccgcgcccctcccaatcccagggaccggcagcccttcatccacggacacccagaaagctgcgctctccacccaaaagaaaaagaaatgcaaacaaacaggactccttgcttaggctggcgacgaaaatgcaaggctcagtccagccccaaaaattggttccggtgaatttagggaggctcagggcatttgcgcgaagaaacagaaacctatgttggggcaaggcagggcgtcaatggcagggcctagctcctcacccgcgaccggcgactggcccttcggcgtcccctctccgcccgcctcccgcggtcggctgcgacgcactcacccgggtgaggctccaggccgtgtgccgccgcgtcctccgtgtctccgagtgggcccgcggggctcagcgcctccatagacaggtccagccccttctcctcccagtctcgcagtttccgttttttatttgagccgatcaaggcttcaacggagaaggcatgtgctcgcgagctcagggcgactgcagatcttctcctttcactcattttagccgcccacacccctgcctccgcttgcccccgctaccgagggagcagccggcgccctcaagctctgagcgcccaccgggcccggcccgggagaggcggaggcgcgtcggacgaggctgagactgcggctcgcgggtctctccaccctccccctgcgtcctcctccgccctcctctgccggatccgacctgcgcccctacgctggcccagctgctaggaactagcgccccgagcgccgcccgctcgctgcatgagcgcccgagtcctgcttcccacccaccggggcaggcgctcacagactgtgtccactgaacttcatcttgtttttgttattattattattctctctcctctctctctctctctctctctcccctccctctctttttctctcctccccctctctctctcttcctctctgccttcccgtcctccctgtgatccaaacttctgggaaacttttttttccgctaaattcctcccttcccgaggaacagggggcaggcggtgcgctcctgtccgaggggtgagggagagggagggggaggaagaaaaagactgagggggaaaaaagccagcccccaaccaatagcgaggagggaacaagagaaactccgagagcgcgaaccaatgagaggaagggagagactgaggcccgggccaaagcgcagcgccagtcgtcccctggatgctcctgggccgactttaacccctggcttcccggtttccccatgggttactccaagagggaggtaggacagttgaaagttgaggtctgatctgcgcctttacaaactcctgcaaatcccaaatccatacgtttttcttccagatctgctggtctcatagacgctgcaagtccaga

SEQ ID NO: 102990 - DNA, 492 bp, Homo sapiens
  misc_feature 1..492: note = chr1:119531601-119532093
  misc_feature 1..492: note = Hyper
  source 1..492: mol_type = genomic DNA
agagcaaggggcgggcggcggagcgcggggtttagggcgagctcctcaggcgtattccagctgggccccctcacgccgcaaatactctctttccctacggcccgaacgctgggctgcgcttcgcctgttccgggctcttgttgcagagaacctatggagaggtgacaggcaagaacagctaggaactttaacagaagagaaggagctttttcaaaattccctgcaaatcccgttacctcaagaccatggctttcccggccagctgatctcccccctggccgccccctgccttttgcgatctctaaggactgcattcaacatggatttctaaggaattaaaaaatccaacgctcctggccattcttaattcccacacctcttcccaagttacgccaccggtcgaggacggcaggagacccccgagtgcagagaaagctcaaaccggcagcgaagtcggtcctagccaagctgaaaaaacgtctcggatttcgc

SEQ ID NO: 102991 - DNA, 30 bp, Homo sapiens
  misc_feature 1..30: note = chr1:119532909-119532939
  misc_feature 1..30: note = Hyper
  source 1..30: mol_type = genomic DNA
aatttccttccccagcggctggggcctctc

SEQ ID NO: 102992 - DNA, 71 bp, Homo sapiens; identical to SEQ ID NO: 67604
  misc_feature 1..71: note = chr1:119535278-119535349
  misc_feature 1..71: note = Hyper
  source 1..71: mol_type = genomic DNA

SEQ ID NO: 102993 - DNA, 207 bp, Homo sapiens
  misc_feature 1..207: note = chr1:119535573-119535780
  misc_feature 1..207: note = Hyper
  source 1..207: mol_type = genomic DNA
tcataaatttatctgcgttctatcggcattggggcaagaggagagcgaaaaggggggggaagccccgattttatatttgtgactataaaaaagcgccacccggtttcctcgccttcggccgccgcggtgtggccggcagagccggggccggcgggccgcaaaattgcgcgattgttcgctgacttcggtctgcgcaggagcagggcc

SEQ ID NO: 102994 - DNA, 249 bp, Homo sapiens; identical to SEQ ID NO: 67606
  misc_feature 1..249: note = chr1:119536142-119536391
  misc_feature 1..249: note = Hyper
  source 1..249: mol_type = genomic DNA

SEQ ID NO: 102995 - DNA, 30 bp, Homo sapiens; identical to SEQ ID NO: 26588
  misc_feature 1..30: note = chr1:119536719-119536749
  misc_feature 1..30: note = Hyper
  source 1..30: mol_type = genomic DNA

SEQ ID NO: 102996 - DNA, 30 bp, Homo sapiens
  misc_feature 1..30: note = chr1:119542030-119542060
  misc_feature 1..30: note = Hyper
  source 1..30: mol_type = genomic DNA
tttaattcactttcccggactggagcctca

SEQ ID NO: 102997 - DNA, 382 bp, Homo sapiens
  misc_feature 1..382: note = chr1:119542261-119542643
  misc_feature 1..382: note = Hyper
  source 1..382: mol_type = genomic DNA
gccctcacccagccccggcatggcctagacaaccgctgctcagccctgcgcccgtgaaattacattattttctccccggcccaatcatcgttttacaggaaaaaaaaattaaataaatataaattgctgctttgcaagatcaaagtgccgatttctggtgcatctggaggagtggggagatggggaggaaagagagggggagagtggcgcagccgtggttgcccaacttcaaagggttctcaacagtgcattttgccattgtattttaacatctcttccccaccagtttggcagggtgcgcagcggagaagcgtgtagcttcagagttcagagcttgtggagaaaccttgctttgaccatctctgagcgcccccacgggact

SEQ ID NO: 102998 - DNA, 1562 bp, Homo sapiens
  misc_feature 1..1562: note = chr1:119542991-119544553
  misc_feature 1..1562: note = Hyper
  source 1..1562: mol_type = genomic DNA
acccggccacctgggcgactacgtaggcctggtacaggaggcaggagttgcctctgtccccactgcgctttccttaatcgaagagcgggtagatgccggccaagcaaagtgctcgaaagtgtagctgggacgcccacgccggaagcctggagaggcaagttgcgagttcgcagggcttgggagttttttgcggcggaagaagctgaatctaggggctgagtccccgggaagggatggccgcctcttagctttcgccaggagattatcttggagcccagcggccgagattgagagctctttctgcggaacctgcctccggagtcagatgagcaaggggaccgccacgtcctcaccgagctcccagcggcctttggggcgggtccggggacaagccggaggactaggcttctcccagagcgcggctgtctttcccggaaagacccaagtgcgcgatgtcagcccgcctgcacttcatctgagttgtccttatgtggccatttctgtttcaaatttcagatttttctactaaaaaaggatgggttaaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgagggggcaggggagggggaacagggctgggaaactgccgtcagcgggtcccggccccgcctcccgaacgcaacgtccaggaaacctcagaactttctattgtctgagaagcttcactgaacaaattgtccctaaaactttagagctgcgaagagcggatcagggcaggttctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctggccttgcaaggagaggttgaatttgtcaggattccccactctagaaggtggctcgtggtggtgaagct

SEQ ID NO: 102999 - DNA, 112 bp, Homo sapiens; identical to SEQ ID NO: 67611
  misc_feature 1..112: note = chr1:119545108-119545220
  misc_feature 1..112: note = Hyper
  source 1..112: mol_type = genomic DNA

SEQ ID NO: 103000 - DNA, 340 bp, Homo sapiens; identical to SEQ ID NO: 67612
  misc_feature 1..340: note = chr1:119548577-119548917
  misc_feature 1..340: note = Hyper
  source 1..340: mol_type = genomic DNA

SEQ ID NO: 103001 - DNA, 2204 bp, Homo sapiens
  misc_feature 1..2204: note = chr1:119549129-119551333
  misc_feature 1..2204: note = Hyper
  source 1..2204: mol_type = genomic DNA
agcctcaatcttaaccgcgtatgatcgtttccactgcacctgtgcgggagagacaggcgcatatccccgtggcgtcggatctctaaattatctaatctggcggctgcgtacgactcagggaaagccctggccgcgagctttttcaccaggcttgagctcagcagccgggcccgcagtgttgccgccagtggggaggcagggaggctgtcggcgcgccggagccaggcgggaaagggactacagccgcccgccgttgtagcgcaggaagcgggcggtgccaacacacacctcgcagctctgcacgttcttcgtgtcttggaggagagtagagcctccgtgtgaagctccgtccgcacctgacgaagaggagggcgtcttgcgccactccagcgactctgcgatgttaagacgcagacccgctgctgcgcctgcctttgtcggggcgggcgggcagccgccgctcggagcaaggtggggctgcggggagggagagccgcggggcagatccctggccaaggtcctctagaaagcccgctctgcgcccaaacgcgccgctcggtccgtgggccacttcggacctgacgctgccggtgaattcacgcgctccgggacgcgcggggacctttgacgaggtttttgaactggggatcgtcccctgtaacctggccgcgttacctccccaggtgagccggactcgcgggtgggttcggcagccggcgatgtggcaaaaaggcaacctcgccttatttctaggggcttggagatgaagagcggctgagtgtccccgtctaccccaacccgggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggactgggcccaaggctcccgggaccgggtcgtggttaacgccgaggccaagcccttcgaagaactctgagttctctgcctgacgttttgtccctcaggaagtgtcccttcccgacttttgagggtgtcttgttctttgacggggtggccctgtgggggaggaaggagaagtgttcctccactgctgttctgtggagcgggacctggctttgttcggcctccctgctctcgggagcctgtactccggctcgcacgcctgactgctggccctggccgctgctcgggccccgcgcaggcacacgggacaaggcgaagccccgacgcccagagggcgcttgggcccagcacacccgcgcacagcccaggaaacgggaaaggccactgtctgcttccctttcgcagattctatccgctggcacgcgaaggtcacacgggctctcaatgctaatttggaatgggaagcaccacgaagggttgaggtagcctggtggccctgactgcgcagggtgcggacagtgagcccgtatccagcttcgctgccacgcgcctagcagcccggcggccccggcccggcccaaggaggaggcaggccgcctgggtcggcttccgtggcctgggggtaagctctgattcaccccaaggtgaggtccccggggatgcccagattcgggccgggaaacgcaccgggagagaaccaccaagcgctcttggttatgaaccagagcttataactgtggccgcagctagacctaggggaggcctgagcgccgaagcctccgtttcctcgaccggaattcgtgagctattaaacatgggccctagcggggcccacgccctgtcttcctttgctgacaaggctccgcggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgtcctgcgcattcacatggggtcgcttcctggctggt

SEQ ID NO: 103002 - DNA, 153 bp, Homo sapiens; identical to SEQ ID NO: 67617
  misc_feature 1..153: note = chr1:119683985-119684138
  misc_feature 1..153: note = Hypo
  source 1..153: mol_type = genomic DNA

SEQ ID NO: 103003 - DNA, 304 bp, Homo sapiens; identical to SEQ ID NO: 67618
  misc_feature 1..304: note = chr1:119869950-119870254
  misc_feature 1..304: note = Hyper
  source 1..304: mol_type = genomic DNA

SEQ ID NO: 103004 - DNA, 460 bp, Homo sapiens
  misc_feature 1..460: note = chr1:120190340-120190800
  misc_feature 1..460: note = Hyper
  source 1..460: mol_type = genomic DNA
tgggcttggtttctccgagggtctctgatgcccccttcggtggtcggcgggacggtcctattccctcttgcatcgctgtctcctccctcaagtctcagcctcctcctccccgcccctcgccacatacccctgagggagctcagtcctggctttgggggcgcgagagcaccccataagcccggggccctgcgccccaggggagcggacaacggtccactttacgaggcacaacttcgcccagccgttccgccaccgcactcgaacacacaccccatccccgcagcggtcgggtctggtcccgatcagccccatccccgggaggcggttgagcccagccacagccacgctcctacctgcgaggcggctggcgcggcgaggagctagggcaccgagcgccccggcccgagccccgcaccgcagcgcgtctgcccttgtgcggcggcggcggctgcagcggccg

SEQ ID NO: 103005 - DNA, 147 bp, Homo sapiens; identical to SEQ ID NO: 67621
  misc_feature 1..147: note = chr1:120191165-120191312
  misc_feature 1..147: note = Hyper
  source 1..147: mol_type = genomic DNA

SEQ ID NO: 103006 - DNA, 63 bp, Homo sapiens; identical to SEQ ID NO: 67622
  misc_feature 1..63: note = chr1:120254521-120254584
  misc_feature 1..63: note = Hyper
  source 1..63: mol_type = genomic DNA

SEQ ID NO: 103007 - DNA, 145 bp, Homo sapiens; identical to SEQ ID NO: 67623
  misc_feature 1..145: note = chr1:120321244-120321389
  misc_feature 1..145: note = Hypo
  source 1..145: mol_type = genomic DNA

SEQ ID NO: 103008 - DNA, 101 bp, Homo sapiens
  misc_feature 1..101: note = chr1:147775362-147775463
  misc_feature 1..101: note = Hyper
  source 1..101: mol_type = genomic DNA
tcaggcccagggagtcgcggacccgggcgtttcctgggatgctgggtctgacgcctgcgagggtcaggacggggcgaaggccattccgctgcccttccagc

SEQ ID NO: 103009 - DNA, 100 bp, Homo sapiens; identical to SEQ ID NO: 67685
  misc_feature 1..100: note = chr1:147775523-147775623
  misc_feature 1..100: note = Hyper
  source 1..100: mol_type = genomic DNA

SEQ ID NO: 103010 - DNA, 251 bp, Homo sapiens; identical to SEQ ID NO: 67689
  misc_feature 1..251: note = chr1:150185824-150186075
  misc_feature 1..251: note = Hyper
  source 1..251: mol_type = genomic DNA

SEQ ID NO: 103011 - DNA, 30 bp, Homo sapiens; identical to SEQ ID NO: 67691
  misc_feature 1..30: note = chr1:150504403-150504433
  misc_feature 1..30: note = Hypo
  source 1..30: mol_type = genomic DNA

SEQ ID NO: 103012 - DNA, 30 bp, Homo sapiens; identical to SEQ ID NO: 67692
  misc_feature 1..30: note = chr1:150529962-150529992
  misc_feature 1..30: note = Hypo
  source 1..30: mol_type = genomic DNA

SEQ ID NO: 103013 - DNA, 138 bp, Homo sapiens; identical to SEQ ID NO: 67693
  misc_feature 1..138: note = chr1:150565309-150565447
  misc_feature 1..138: note = Hypo
  source 1..138: mol_type = genomic DNA

SEQ ID NO: 103014 - DNA, 149 bp, Homo sapiens; identical to SEQ ID NO: 67694
  misc_feature 1..149: note = chr1:150602992-150603141
  misc_feature 1..149: note = Hypo
  source 1..149: mol_type = genomic DNA

SEQ ID NO: 103015 - DNA, 30 bp, Homo sapiens; identical to SEQ ID NO: 67695
  misc_feature 1..30: note = chr1:150693359-150693389
  misc_feature 1..30: note = Hypo
  source 1..30: mol_type = genomic DNA

SEQ ID NO: 103016 - DNA, 104 bp, Homo sapiens; identical to SEQ ID NO: 67696
  misc_feature 1..104: note = chr1:150850631-150850735
  misc_feature 1..104: note = Hypo
  source 1..104: mol_type = genomic DNA

SEQ ID NO: 103017 - DNA, 50 bp, Homo sapiens; identical to SEQ ID NO: 67697
  misc_feature 1..50: note = chr1:150940902-150940952
  misc_feature 1..50: note = Hypo
  source 1..50: mol_type = genomic DNA

SEQ ID NO: 103018 - DNA, 58 bp, Homo sapiens; identical to SEQ ID NO: 67698
  misc_feature 1..58: note = chr1:150947697-150947755
  misc_feature 1..58: note = Hyper
  source 1..58: mol_type = genomic DNA

SEQ ID NO: 103019 - DNA, 61 bp, Homo sapiens; identical to SEQ ID NO: 67699
  misc_feature 1..61: note = chr1:151032676-151032737
  misc_feature 1..61: note = Hyper
  source 1..61: mol_type = genomic DNA

SEQ ID NO: 103020 - DNA, 34 bp, Homo sapiens; identical to SEQ ID NO: 67700
  misc_feature 1..34: note = chr1:151080126-151080160
  misc_feature 1..34: note = Hypo
  source 1..34: mol_type = genomic DNA

SEQ ID NO: 103021 - DNA, 37 bp, Homo sapiens; identical to SEQ ID NO: 67701
  misc_feature 1..37: note = chr1:151104646-151104683
  misc_feature 1..37: note = Hypo
  source 1..37: mol_type = genomic DNA

SEQ ID NO: 103022 - DNA, 145 bp, Homo sapiens; identical to SEQ ID NO: 67702
  misc_feature 1..145: note = chr1:151106046-151106191
  misc_feature 1..145: note = Hypo
  source 1..145: mol_type = genomic DNA

SEQ ID NO: 103023 - DNA, 114 bp, Homo sapiens; identical to SEQ ID NO: 67703
  misc_feature 1..114: note = chr1:151118621-151118735
  misc_feature 1..114: note = Hyper
  source 1..114: mol_type = genomic DNA

SEQ ID NO: 103024 - DNA, 120 bp, Homo sapiens; identical to SEQ ID NO: 67704
  misc_feature 1..120: note = chr1:151169648-151169768
  misc_feature 1..120: note = Hypo
  source 1..120: mol_type = genomic DNA

SEQ ID NO: 103025 - DNA, 138 bp, Homo sapiens; identical to SEQ ID NO: 67705
  misc_feature 1..138: note = chr1:151170068-151170206
  misc_feature 1..138: note = Hypo
  source 1..138: mol_type = genomic DNA

SEQ ID NO: 103026 - DNA, 94 bp, Homo sapiens; identical to SEQ ID NO: 67706
  misc_feature 1..94: note = chr1:151252667-151252761
  misc_feature 1..94: note = Hypo
  source 1..94: mol_type = genomic DNA

SEQ ID NO: 103027 - DNA, 84 bp, Homo sapiens; identical to SEQ ID NO: 39049
  misc_feature 1..84: note = chr1:151300852-151300936
  misc_feature 1..84: note = Hypo
  source 1..84: mol_type = genomic DNA

SEQ ID NO: 103028 - DNA, 30 bp, Homo sapiens; identical to SEQ ID NO: 39050
  misc_feature 1..30: note = chr1:151345799-151345829
  misc_feature 1..30: note = Hypo
  source 1..30: mol_type = genomic DNA

SEQ ID NO: 103029 - DNA, 81 bp, Homo sapiens; identical to SEQ ID NO: 67709
  misc_feature 1..81: note = chr1:151347981-151348062
  misc_feature 1..81: note = Hypo
  source 1..81: mol_type = genomic DNA

SEQ ID NO: 103030 - DNA, 60 bp, Homo sapiens; identical to SEQ ID NO: 67710
  misc_feature 1..60: note = chr1:151445917-151445977
  misc_feature 1..60: note = Hyper
  source 1..60: mol_type = genomic DNA

SEQ ID NO: 103031 - DNA, 71 bp, Homo sapiens; identical to SEQ ID NO: 67711
  misc_feature 1..71: note = chr1:151481576-151481647
  misc_feature 1..71: note = Hypo
  source 1..71: mol_type = genomic DNA

SEQ ID NO: 103032 - DNA, 69 bp, Homo sapiens; identical to SEQ ID NO: 67713
  misc_feature 1..69: note = chr1:151513143-151513212
  misc_feature 1..69: note = Hyper
  source 1..69: mol_type = genomic DNA

SEQ ID NO: 103033 - DNA, 54 bp, Homo sapiens; identical to SEQ ID NO: 67714
  misc_feature 1..54: note = chr1:151678593-151678647
  misc_feature 1..54: note = Hypo
  source 1..54: mol_type = genomic DNA

SEQ ID NO: 103034 - DNA, 316 bp, Homo sapiens; identical to SEQ ID NO: 67715
  misc_feature 1..316: note = chr1:151689335-151689651
  misc_feature 1..316: note = Hyper
  source 1..316: mol_type = genomic DNA

SEQ ID NO: 103035 - DNA, 544 bp, Homo sapiens; identical to SEQ ID NO: 67716
  misc_feature 1..544: note = chr1:151693862-151694406
  misc_feature 1..544: note = Hyper
  source 1..544: mol_type = genomic DNA

SEQ ID NO: 103036 - DNA, 77 bp, Homo sapiens; identical to SEQ ID NO: 67717
  misc_feature 1..77: note = chr1:151801573-151801650
  misc_feature 1..77: note = Hyper
  source 1..77: mol_type = genomic DNA

SEQ ID NO: 103037 - DNA, 61 bp, Homo sapiens; identical to SEQ ID NO: 67718
  misc_feature 1..61: note = chr1:152009237-152009298
  misc_feature 1..61: note = Hyper
  source 1..61: mol_type = genomic DNA

SEQ ID NO: 103038 - DNA, 272 bp, Homo sapiens; identical to SEQ ID NO: 67719
  misc_feature 1..272: note = chr1:152080369-152080641
  misc_feature 1..272: note = Hyper
  source 1..272: mol_type = genomic DNA

SEQ ID NO: 103039 - DNA, 105 bp, Homo sapiens; identical to SEQ ID NO: 67720
  misc_feature 1..105: note = chr1:152083260-152083365
  misc_feature 1..105: note = Hyper
  source 1..105: mol_type = genomic DNA

SEQ ID NO: 103040 - DNA, 859 bp, Homo sapiens
  misc_feature 1..859: note = chr1:152083590-152084449
  misc_feature 1..859: note = Hyper
  source 1..859: mol_type = genomic DNA
atgcggctcttaatccgctcccgggcctgttcctgctcctcctcagctagctcctgctcgcgcctctcttcctcatgctcgcgcttcagccgctgctcgagcctctcttcctcctcctcgcgcttcagccgctgctcgcgcctttcctgctgctcgcgccttagttgctgctggcgcctctcctcctgctcctcgctcttcagcagctgctggcgcctctcttcctccggctcctcgcgcttcagccgctgctcgcgcctctcctcctgctcgagtctctccacctcctcgcgcttcagtcgctgctcgagcctctcttcctgctcgcgcttcagccgctgctggcgcctctcctcctcgcgcttcagcagctgatcgcgcctctcctcctgctcgcgcttcagccgctgctctcgcctctcctgctcgagcctcttctcctcctcgcgcttcagcagctgctcgcgcctctcctcctgctcgcgtcttagttgttgctcgctcctcaaccgctgctggagcctctcttcctcctcctggcgcttcagccgctgctcgcgcctctcctcttgctcccgccttagttgctgctcgcgcctctcctgctgctcgcgcctctcctcctcctcgagcttcagccaacgttcgcgcctctcctcctcctggtcgcgcttcagctgctgcttgcgcctctcctgctcgtgcctctccgtctcctcctcgcgcttcagccaatcgcgcctctcctcctgctcgcgcttcagccgctgctcgcgcctctcctgctcgtgcttctgctcgtgcctctcctcctcctgctcgcgcctcagctgctgctcgcgcctcagctgctgctcgc

SEQ ID NO: 103041 - DNA, 859 bp, Homo sapiens; identical to SEQ ID NO: 67723
  misc_feature 1..859: note = chr1:152084689-152085548
  misc_feature 1..859: note = Hyper
  source 1..859: mol_type = genomic DNA

SEQ ID NO: 103042 - DNA, 30 bp, Homo sapiens; identical to SEQ ID NO: 67724
  misc_feature 1..30: note = chr1:152192377-152192407
  misc_feature 1..30: note = Hypo
  source 1..30: mol_type = genomic DNA

SEQ ID NO: 103043 - DNA, 66 bp, Homo sapiens; identical to SEQ ID NO: 67725
  misc_feature 1..66: note = chr1:152276060-152276126
  misc_feature 1..66: note = Hypo
  source 1..66: mol_type = genomic DNA

SEQ ID NO: 103044 - DNA, 30 bp, Homo sapiens; identical to SEQ ID NO: 67726
  misc_feature 1..30: note = chr1:152282667-152282697
  misc_feature 1..30: note = Hypo
  source 1..30: mol_type = genomic DNA

SEQ ID NO: 103045 - DNA, 51 bp, Homo sapiens; identical to SEQ ID NO: 39054
  misc_feature 1..51: note = chr1:152286249-152286300
  misc_feature 1..51: note = Hypo
  source 1..51: mol_type = genomic DNA

SEQ ID NO: 103046 - DNA, 462 bp, Homo sapiens
  misc_feature 1..462: note = chr1:152487789-152488251
  misc_feature 1..462: note = Hyper
  source 1..462: mol_type = genomic DNA
gtggaaagaaaaagccggctcgcctttgaaaggctgcctttcttccaggtttgtcgtgaggagctccgcgatgtcctctcaacagagcgccgtttccgccaaaggcttttccaaggggtcgtcccagggccccgctccgtgtcccgccccggcgcccaccccggcgcccgcctcctcctcctcctgctgcggctccggcaggggctgctgcggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcg

SEQ ID NO: 103047 - DNA, 16 bp, Homo sapiens
  misc_feature 1..16: note = chr1:152696808-152696824
  misc_feature 1..16: note = Hypo
  source 1..16: mol_type = genomic DNA
ggagtcttgctctgtc

SEQ ID NO: 103048 - DNA, 30 bp, Homo sapiens; identical to SEQ ID NO: 67734
  misc_feature 1..30: note = chr1:153395112-153395142
  misc_feature 1..30: note = Hyper
  source 1..30: mol_type = genomic DNA

SEQ ID NO: 103049 - DNA, 79 bp, Homo sapiens; identical to SEQ ID NO: 26613
  misc_feature 1..79: note = chr1:153438376-153438455
  misc_feature 1..79: note = Hyper
  source 1..79: mol_type = genomic DNA

SEQ ID NO: 103050 - DNA, 109 bp, Homo sapiens; identical to SEQ ID NO: 14268
  misc_feature 1..109: note = chr1:153539476-153539585
  misc_feature 1..109: note = Hypo
  source 1..109: mol_type = genomic DNA

SEQ ID NO: 103051 - DNA, 219 bp, Homo sapiens; identical to SEQ ID NO: 39057
  misc_feature 1..219: note = chr1:153540023-153540242
  misc_feature 1..219: note = Hypo
  source 1..219: mol_type = genomic DNA

SEQ ID NO: 103052 - DNA, 150 bp, Homo sapiens; identical to SEQ ID NO: 39058
  misc_feature 1..150: note = chr1:153608334-153608484
  misc_feature 1..150: note = Hypo
  source 1..150: mol_type = genomic DNA

SEQ ID NO: 103053 - DNA, 40 bp, Homo sapiens; identical to SEQ ID NO: 67741
  misc_feature 1..40: note = chr1:153620461-153620501
  misc_feature 1..40: note = Hypo
  source 1..40: mol_type = genomic DNA

SEQ ID NO: 103054 - DNA, 89 bp, Homo sapiens; identical to SEQ ID NO: 67742
  misc_feature 1..89: note = chr1:153644958-153645047
  misc_feature 1..89: note = Hypo
  source 1..89: mol_type = genomic DNA

SEQ ID NO: 103055 - DNA, 87 bp, Homo sapiens; identical to SEQ ID NO: 67743
  misc_feature 1..87: note = chr1:153650936-153651023
  misc_feature 1..87: note = Hyper
  source 1..87: mol_type = genomic DNA

SEQ ID NO: 103056 - DNA, 989 bp, Homo sapiens; identical to SEQ ID NO: 67744
  misc_feature 1..989: note = chr1:153651443-153652432
  misc_feature 1..989: note = Hyper
  source 1..989: mol_type = genomic DNA

SEQ ID NO: 103057 - DNA, 65 bp, Homo sapiens; identical to SEQ ID NO: 67745
  misc_feature 1..65: note = chr1:153662197-153662262
  misc_feature 1..65: note = Hypo
  source 1..65: mol_type = genomic DNA

SEQ ID NO: 103058 - DNA, 102 bp, Homo sapiens; identical to SEQ ID NO: 39060
  misc_feature 1..102: note = chr1:153937070-153937172
  misc_feature 1..102: note = Hypo
  source 1..102: mol_type = genomic DNA

SEQ ID NO: 103059 - DNA, 80 bp, Homo sapiens; identical to SEQ ID NO: 67747
  misc_feature 1..80: note = chr1:154098530-154098610
  misc_feature 1..80: note = Hypo
  source 1..80: mol_type = genomic DNA

SEQ ID NO: 103060 - DNA, 22 bp, Homo sapiens
  misc_feature 1..22: note = chr1:154107501-154107523
  misc_feature 1..22: note = Hypo
  source 1..22: mol_type = genomic DNA
ccacgcccggcctctgtgtacc

SEQ ID NO: 103061 - DNA, 23 bp, Homo sapiens
  misc_feature 1..23: note = chr1:154156755-154156778
  misc_feature 1..23: note = Hypo
  source 1..23: mol_type = genomic DNA
gccggcctcggcctcccaaagtg

SEQ ID NO: 103062 - DNA, 176 bp, Homo sapiens; identical to SEQ ID NO: 67750
  misc_feature 1..176: note = chr1:154238843-154239019
  misc_feature 1..176: note = Hypo
  source 1..176: mol_type = genomic DNA

SEQ ID NO: 103063 - DNA, 30 bp, Homo sapiens; identical to SEQ ID NO: 67751
  misc_feature 1..30: note = chr1:154292635-154292665
  misc_feature 1..30: note = Hypo
  source 1..30: mol_type = genomic DNA

SEQ ID NO: 103064 - DNA, 364 bp, Homo sapiens
  misc_feature 1..364: note = chr1:154298110-154298474
  misc_feature 1..364: note = Hyper
  source 1..364: mol_type = genomic DNA
ccccgccccagcccccggcatgggcagtacggggccgccggggcgggcgccgagcgctgagcgctgaggtgaggcgaggcgaggcgaagcgggggcgcccgggagcgcggggccaggagggcagagggagatgcggccgcagccgcggggctggaggggccggggagcgggtgtagactggggagcaccgggggccaagatttgggagctgcggccagacggggcggggatggcggccgactggagacgaggggctgtcgggttcccggggacggggcagagcgggggtctgcgtacaggatgggaggatggggtgccgaaggggcgcgtggagagcaggagagcggcgcgagtgccaaggaga

SEQ ID NO: 103065 - DNA, 30 bp, Homo sapiens; identical to SEQ ID NO: 67754
  misc_feature 1..30: note = chr1:154302983-154303013
  misc_feature 1..30: note = Hypo
  source 1..30: mol_type = genomic DNA

SEQ ID NO: 103066 - DNA, 30 bp, Homo sapiens; identical to SEQ ID NO: 39064
  misc_feature 1..30: note = chr1:154305492-154305522
  misc_feature 1..30: note = Hypo
  source 1..30: mol_type = genomic DNA

SEQ ID NO: 103067 - DNA, 129 bp, Homo sapiens; identical to SEQ ID NO: 67756
  misc_feature 1..129: note = chr1:154324138-154324267
  misc_feature 1..129: note = Hypo
  source 1..129: mol_type = genomic DNA

SEQ ID NO: 103068 - DNA, 138 bp, Homo sapiens; identical to SEQ ID NO: 67757
  misc_feature 1..138: note = chr1:154325447-154325585
  misc_feature 1..138: note = Hyper
  source 1..138: mol_type = genomic DNA

SEQ ID NO: 103069 - DNA, 995 bp, Homo sapiens
  misc_feature 1..995: note = chr1:154474549-154475544
  misc_feature 1..995: note = Hyper
  source 1..995: mol_type = genomic DNA
tgctccgtgcgcccccggccggccgtcgcccacgcccggcagggtggggttctcacggctcggggcgccgagcgggcgggcgctagcctctgctccggacacggcaggcgacaggcacgacgcgcggggggccccgcccgggctcgtcttcaacgcctgcccggcccgaggacaccgtggctctcggaggcggcgggcgccgggggcttccccctgctctttcctcctgcggtgggagaggccaggcccacggaagccccctgcggcccagcccacgctcccagggaccagagaggaccgagcggaggcggcgggagtatccccggcgcagcgacagacggtggacggacggcgagcggcccatcaactccgcgcgcccctcccctccgcggctggcgcctcccagccccgccacctcctgcccagagctgggggcggcggggtgagcgccatggcagaggcgggtcgggctgcgagctctggagaaaggggcggcggccgcacgtgcggatcggccgcgccccactgagcagagagcccccttctgccgccgacagcccgcgtctgcaccgagccggtctcggccgggcgctgccttcacacgcgcccaggagtgtcacgtgcgccgctcacccccgggaaggaagcccctcgcccacccactccgctctactccactctttctgcagacgttatttttggcggtagggcagaggttgcggcccgaggtccgggcgcagggacaacggtcgccagctcctgcgctagttccgttactcttcggtggcacacggtcctgggcagcgcgaggctcttcccgccgtggccgccggggattggctgccggcaagccccgccccgtgcccccgggctcagagggggcggagcgcggagggagaaggcgcgaaggctgggcgtcgcgatcgcaggtgcacgcgcgtggcccgcgagacgaggtatggcttgtcggccccaggtcccgggatgccaggcga

SEQ ID NO: 103070 - DNA, 54 bp, Homo sapiens; identical to SEQ ID NO: 39065
  misc_feature 1..54: note = chr1:154499777-154499831
  misc_feature 1..54: note = Hypo
  source 1..54: mol_type = genomic DNA

SEQ ID NO: 103071 - DNA, 78 bp, Homo sapiens; identical to SEQ ID NO: 67763
  misc_feature 1..78: note = chr1:154516767-154516845
  misc_feature 1..78: note = Hypo
  source 1..78: mol_type = genomic DNA

SEQ ID NO: 103072 - DNA, 32 bp, Homo sapiens; identical to SEQ ID NO: 67764
  misc_feature 1..32: note = chr1:154533446-154533478
  misc_feature 1..32: note = Hypo
  source 1..32: mol_type = genomic DNA

SEQ ID NO: 103073 - DNA, 37 bp, Homo sapiens; identical to SEQ ID NO: 67765
  misc_feature 1..37: note = chr1:154536500-154536537
  misc_feature 1..37: note = Hypo
  source 1..37: mol_type = genomic DNA

SEQ ID NO: 103074 - DNA, 227 bp, Homo sapiens; identical to SEQ ID NO: 67766
  misc_feature 1..227: note = chr1:154540058-154540285
  misc_feature 1..227: note = Hyper
  source 1..227: mol_type = genomic DNA

SEQ ID NO: 103075 - DNA, 189 bp, Homo sapiens; identical to SEQ ID NO: 67767
  misc_feature 1..189: note = chr1:154682354-154682543
  misc_feature 1..189: note = Hypo
  source 1..189: mol_type = genomic DNA

SEQ ID NO: 103076 - DNA, 30 bp, Homo sapiens; identical to SEQ ID NO: 67768
  misc_feature 1..30: note = chr1:154685747-154685777
  misc_feature 1..30: note = Hypo
  source 1..30: mol_type = genomic DNA

SEQ ID NO: 103077 - DNA, 47 bp, Homo sapiens; identical to SEQ ID NO: 26621
  misc_feature 1..47: note = chr1:154733207-154733254
  misc_feature 1..47: note = Hyper
  source 1..47: mol_type = genomic DNA

SEQ ID NO: 103078 - DNA, 179 bp, Homo sapiens; identical to SEQ ID NO: 67772
  misc_feature 1..179: note = chr1:154808666-154808845
  misc_feature 1..179: note = Hypo
  source 1..179: mol_type = genomic DNA

SEQ ID NO: 103079 - DNA, 30 bp, Homo sapiens; identical to SEQ ID NO: 39069
  misc_feature 1..30: note = chr1:154851806-154851836
  misc_feature 1..30: note = Hypo
  source 1..30: mol_type = genomic DNA

SEQ ID NO: 103080 - DNA, 21 bp, Homo sapiens
  misc_feature 1..21: note = chr1:154954412-154954433
  misc_feature 1..21: note = Hypo
  source 1..21: mol_type = genomic DNA
tcaccgcgcccggcctttttt

SEQ ID NO: 103081 - DNA, 30 bp, Homo sapiens; identical to SEQ ID NO: 67776
  misc_feature 1..30: note = chr1:155019681-155019711
  misc_feature 1..30: note = Hypo
  source 1..30: mol_type = genomic DNA

SEQ ID NO: 103082 - DNA, 309 bp, Homo sapiens; identical to SEQ ID NO: 67777
  misc_feature 1..309: note = chr1:155043397-155043706
  misc_feature 1..309: note = Hyper
  source 1..309: mol_type = genomic DNA

SEQ ID NO: 103083 - DNA, 45 bp, Homo sapiens; identical to SEQ ID NO: 67778
  misc_feature 1..45: note = chr1:155054426-155054471
  misc_feature 1..45: note = Hyper
  source 1..45: mol_type = genomic DNA

SEQ ID NO: 103084 - DNA, 199 bp, Homo sapiens; identical to SEQ ID NO: 67779
  misc_feature 1..199: note = chr1:155055105-155055304
  misc_feature 1..199: note = Hyper
  source 1..199: mol_type = genomic DNA

SEQ ID NO: 103085 - DNA, 30 bp, Homo sapiens; identical to SEQ ID NO: 67780
  misc_feature 1..30: note = chr1:155064834-155064864
  misc_feature 1..30: note = Hypo
  source 1..30: mol_type = genomic DNA

SEQ ID NO: 103086 - DNA, 31 bp, Homo sapiens; identical to SEQ ID NO: 67781
  misc_feature 1..31: note = chr1:155113365-155113396
  misc_feature 1..31: note = Hypo
  source 1..31: mol_type = genomic DNA

SEQ ID NO: 103087 - DNA, 66 bp, Homo sapiens; identical to SEQ ID NO: 67782
  misc_feature 1..66: note = chr1:155146189-155146255
  misc_feature 1..66: note = Hyper
  source 1..66: mol_type = genomic DNA

SEQ ID NO: 103088 - DNA, 44 bp, Homo sapiens
  misc_feature 1..44: note = chr1:155147233-155147277
  misc_feature 1..44: note = Hyper
  source 1..44: mol_type = genomic DNA
cggagaagggggtgccgctgaccgggttgcgctgcgggagaggg

SEQ ID NO: 103089 - DNA, 30 bp, Homo sapiens; identical to SEQ ID NO: 67784
  misc_feature 1..30: note = chr1:155154997-155155027
  misc_feature 1..30: note = Hypo
  source 1..30: mol_type = genomic DNA

SEQ ID NO: 103090 - DNA, 98 bp, Homo sapiens; identical to SEQ ID NO: 14271
  misc_feature 1..98: note = chr1:155160925-155161023
  misc_feature 1..98: note = Hypo
  source 1..98: mol_type = genomic DNA

SEQ ID NO: 103091 - DNA, 32 bp, Homo sapiens
  misc_feature 1..32: note = chr1:155161766-155161798
  misc_feature 1..32: note = Hypo
  source 1..32: mol_type = genomic DNA
cggggctgaggtgacatcgtgggctggcgggg

SEQ ID NO: 103092 - DNA, 30 bp, Homo sapiens; identical to SEQ ID NO: 67786
  misc_feature 1..30: note = chr1:155176630-155176660
  misc_feature 1..30: note = Hypo
  source 1..30: mol_type = genomic DNA

SEQ ID NO: 103093 - DNA, 36 bp, Homo sapiens; identical to SEQ ID NO: 67788
  misc_feature 1..36: note = chr1:155311784-155311820
  misc_feature 1..36: note = Hypo
  source 1..36: mol_type = genomic DNA

SEQ ID NO: 103094 - DNA, 21 bp, Homo sapiens
  misc_feature 1..21: note = chr1:155563460-155563481
  misc_feature 1..21: note = Hypo
  source 1..21: mol_type = genomic DNA
aataaaattgccattcgggcc

SEQ ID NO: 103095 - DNA, 23 bp, Homo sapiens
  misc_feature 1..23: note = chr1:155578174-155578197
  misc_feature 1..23: note = Hypo
  source 1..23: mol_type = genomic DNA
ctaccctcacattctcgaatttc

SEQ ID NO: 103096 - DNA, 120 bp, Homo sapiens; identical to SEQ ID NO: 67791
  misc_feature 1..120: note = chr1:155578917-155579037
  misc_feature 1..120: note = Hypo
  source 1..120: mol_type = genomic DNA

SEQ ID NO: 103097 - DNA, 30 bp, Homo sapiens; identical to SEQ ID NO: 67792
  misc_feature 1..30: note = chr1:155659966-155659996
  misc_feature 1..30: note = Hypo
  source 1..30: mol_type = genomic DNA

SEQ ID NO: 103098 - DNA, 59 bp, Homo sapiens; identical to SEQ ID NO: 39074
  misc_feature 1..59: note = chr1:155668700-155668759
  misc_feature 1..59: note = Hypo
  source 1..59: mol_type = genomic DNA

SEQ ID NO: 103099 - DNA, 30 bp, Homo sapiens; identical to SEQ ID NO: 67794
  misc_feature 1..30: note = chr1:155675909-155675939
  misc_feature 1..30: note = Hypo
  source 1..30: mol_type = genomic DNA

SEQ ID NO: 103100 - DNA, 34 bp, Homo sapiens; identical to SEQ ID NO: 39075
  misc_feature 1..34: note = chr1:155826302-155826336
  misc_feature 1..34: note = Hypo
  source 1..34: mol_type = genomic DNA

SEQ ID NO: 103101 - DNA, 58 bp, Homo sapiens; identical to SEQ ID NO: 67798
  misc_feature 1..58: note = chr1:155830324-155830382
  misc_feature 1..58: note = Hyper
  source 1..58: mol_type = genomic DNA

SEQ ID NO: 103102 - DNA, 30 bp, Homo sapiens; identical to SEQ ID NO: 67799
  misc_feature 1..30: note = chr1:155888002-155888032
  misc_feature 1..30: note = Hypo
  source 1..30: mol_type = genomic DNA

SEQ ID NO: 103103 - DNA, 23 bp, Homo sapiens
  misc_feature 1..23: note = chr1:155892702-155892725
  misc_feature 1..23: note = Hypo
  source 1..23: mol_type = genomic DNA
aaagacagtcctggccgggcgcg

SEQ ID NO: 103104 - DNA, 23 bp, Homo sapiens
  misc_feature 1..23: note = chr1:155892965-155892988
  misc_feature 1..23: note = Hypo
  source 1..23: mol_type = genomic DNA
agcctgggcgacagaaaaaaaaa

SEQ ID NO: 103105 - DNA, 42 bp, Homo sapiens; identical to SEQ ID NO: 67802
  misc_feature 1..42: note = chr1:155893814-155893856
  misc_feature 1..42: note = Hypo
  source 1..42: mol_type = genomic DNA

SEQ ID NO: 103106 - DNA, 29 bp, Homo sapiens
  misc_feature 1..29: note = chr1:155905289-155905318
  misc_feature 1..29: note = Hypo
  source 1..29: mol_type = genomic DNA
ggtaggattacaggcgtgagccaccgcgc

SEQ ID NO: 103107 - DNA, 30 bp, Homo sapiens; identical to SEQ ID NO: 67804
  misc_feature 1..30: note = chr1:155911541-155911571
  misc_feature 1..30: note = Hypo
  source 1..30: mol_type = genomic DNA

SEQ ID NO: 103108 - DNA, 30 bp, Homo sapiens; identical to SEQ ID NO: 39078
  misc_feature 1..30: note = chr1:155911924-155911954
  misc_feature 1..30: note = Hypo
  source 1..30: mol_type = genomic DNA

SEQ ID NO: 103109 - DNA, 220 bp, Homo sapiens; identical to SEQ ID NO: 67806
  misc_feature 1..220: note = chr1:155912424-155912644
  misc_feature 1..220: note = Hypo
  source 1..220: mol_type = genomic DNA

SEQ ID NO: 103110 - DNA, 143 bp, Homo sapiens; identical to SEQ ID NO: 67807
  misc_feature 1..143: note = chr1:155954169-155954312
  misc_feature 1..143: note = Hypo
  source 1..143: mol_type = genomic DNA

SEQ ID NO: 103111 - DNA, 20 bp, Homo sapiens
  misc_feature 1..20: note = chr1:156010528-156010548
  misc_feature 1..20: note = Hypo
  source 1..20: mol_type = genomic DNA
caccgcgcccagccagtcca

SEQ ID NO: 103112 - DNA, 204 bp, Homo sapiens; identical to SEQ ID NO: 67810
  misc_feature 1..204: note = chr1:156030654-156030858
  misc_feature 1..204: note = Hypo
  source 1..204: mol_type = genomic DNA

SEQ ID NO: 103113 - DNA, 105 bp, Homo sapiens; identical to SEQ ID NO: 39082
  misc_feature 1..105: note = chr1:156031479-156031584
  misc_feature 1..105: note = Hypo
  source 1..105: mol_type = genomic DNA

SEQ ID NO: 103114 - DNA, 52 bp, Homo sapiens; identical to SEQ ID NO: 67812
  misc_feature 1..52: note = chr1:156212895-156212947
  misc_feature 1..52: note = Hypo
  source 1..52: mol_type = genomic DNA

SEQ ID NO: 103115 - DNA, 542 bp, Homo sapiens; identical to SEQ ID NO: 67813
  misc_feature 1..542: note = chr1:156215329-156215871
  misc_feature 1..542: note = Hyper
  source 1..542: mol_type = genomic DNA

SEQ ID NO: 103116 - DNA, 30 bp, Homo sapiens; identical to SEQ ID NO: 67814
  misc_feature 1..30: note = chr1:156216765-156216795
  misc_feature 1..30: note = Hypo
  source 1..30: mol_type = genomic DNA

SEQ ID NO: 103117 - DNA, 30 bp, Homo sapiens; identical to SEQ ID NO: 67815
  misc_feature 1..30: note = chr1:156232727-156232757
  misc_feature 1..30: note = Hypo
  source 1..30: mol_type = genomic DNA

SEQ ID NO: 103118 - DNA, 39 bp, Homo sapiens; identical to SEQ ID NO: 67816
  misc_feature 1..39: note = chr1:156233282-156233321
  misc_feature 1..39: note = Hypo
  source 1..39: mol_type = genomic DNA

SEQ ID NO: 103119 - DNA, 206 bp, Homo sapiens; identical to SEQ ID NO: 39083
  misc_feature 1..206: note = chr1:156253833-156254039
  misc_feature 1..206: note = Hypo
  source 1..206: mol_type = genomic DNA

SEQ ID NO: 103120 - DNA, 33 bp, Homo sapiens; identical to SEQ ID NO: 67818
  misc_feature 1..33: note = chr1:156268868-156268901
  misc_feature 1..33: note = Hypo
  source 1..33: mol_type = genomic DNA

SEQ ID NO: 103121 - DNA, 91 bp, Homo sapiens; identical to SEQ ID NO: 67819
  misc_feature 1..91: note = chr1:156271355-156271446
  misc_feature 1..91: note = Hypo
  source 1..91: mol_type = genomic DNA

SEQ ID NO: 103122 - DNA, 116 bp, Homo sapiens; identical to SEQ ID NO: 67821
  misc_feature 1..116: note = chr1:156339144-156339260
  misc_feature 1..116: note = Hyper
  source 1..116: mol_type = genomic DNA

SEQ ID NO: 103123 - DNA, 760 bp, Homo sapiens; identical to SEQ ID NO: 67822
  misc_feature 1..760: note = chr1:156357837-156358597
  misc_feature 1..760: note = Hyper
  source 1..760: mol_type = genomic DNA

SEQ ID NO: 103124 - DNA, 1492 bp, Homo sapiens
  misc_feature 1..1492: note = chr1:156390096-156391588
  misc_feature 1..1492: note = Hyper
  source 1..1492: mol_type = genomic DNA
gaggccggctttccccgggcccctctgcgcagtgtatggggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtgcgatcaggaacgggaaaccgcagccccgaagagggtgggggctcggccggcccctcgtggcggacgcgcgggcacgccggattccgaggcgctcgcccacctcgtgctccacgctggccaggccacttacatcgagcccagggtgcccatccgtgctctcccgcgcggtcctcccggccagttcccgcccctggagcgccagggccctgagttccagatgccggggctcagcgggcgccgggcagaggaggctgccctgctcttagcctccgccgagcctaggcgagcagggtggagcgggtctcacctcctagctccctcctctgcctctgccgcggctctggccccggcgcgctccggctccggactttt

SEQ ID NO: 103125 - DNA, 1246 bp, Homo sapiens
  misc_feature 1..1246: note = chr1:156405367-156406613
  misc_feature 1..1246: note = Hyper
  source 1..1246: mol_type = genomic DNA
cgccggcagggcccccgaggcgcctctgcctgctctctccgttcttgccggcggcagcgattcggactcccgctttcgacaaagtctcagctccgcagcagcacccggcgcggactcgctgggcgcgcggactgagctccgggtggaaccaggaccctcgcgccctcgccctcgccctcgccctcgccctcgcccgagctggaccaccgcgagcaccgccgacgccagccgcagagccgcgggtgcgcggggaagaggaaacgaaagcgcgggctccggagctgaggtgagaagtgagcagaaagtgaaaagagaatccatcggaaacagataaaaaaggaaaaacaaaacccactcgaaaagaaagaaaacgttacaacaaaaaggataaagtaacgctaaatgaaataaaaaggagacatactaaaaacgttaaagttgttaaactaagtgatagaaaaggcgaagaaacaacagggctaggaaagggctccgaggcgcccgcagggaagggggccctagacggggcgatgaggcttttgggagcctccggccgcgggcgcggcggggtccggcgggtgcgcagcggccggggctcctccgcgcgctgcccgccgccggcacccggctcgggcgaagagccggctggacggtcagccagccccacccacagagagtcgcgggagcccgagggccgggagctgcgggactccttcgcccccacctctgccgcccgccgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaagccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcagccgggcctctctggga

SEQ ID NO: 103126 - DNA, 146 bp, Homo sapiens; identical to SEQ ID NO: 67829
  misc_feature 1..146: note = chr1:156432169-156432315
  misc_feature 1..146: note = Hypo
  source 1..146: mol_type = genomic DNA

SEQ ID NO: 103127 - DNA, 47 bp, Homo sapiens; identical to SEQ ID NO: 14276
  misc_feature 1..47: note = chr1:156433495-156433542
  misc_feature 1..47: note = Hypo
  source 1..47: mol_type = genomic DNA

SEQ ID NO: 103128 - DNA, 30 bp, Homo sapiens; identical to SEQ ID NO: 67831
  misc_feature 1..30: note = chr1:156434427-156434457
  misc_feature 1..30: note = Hypo
  source 1..30: mol_type = genomic DNA

SEQ ID NO: 103129 - DNA, 37 bp, Homo sapiens; identical to SEQ ID NO: 67832
  misc_feature 1..37: note = chr1:156441193-156441230
  misc_feature 1..37: note = Hypo
  source 1..37: mol_type = genomic DNA

SEQ ID NO: 103130 - DNA, 333 bp, Homo sapiens; identical to SEQ ID NO: 67833
  misc_feature 1..333: note = chr1:156468600-156468933
  misc_feature 1..333: note = Hyper
  source 1..333: mol_type = genomic DNA

SEQ ID NO: 103131 - DNA, 51 bp, Homo sapiens; identical to SEQ ID NO: 26633
  misc_feature 1..51: note = chr1:156474407-156474458
  misc_feature 1..51: note = Hyper
  source 1..51: mol_type = genomic DNA

SEQ ID NO: 103132 - DNA, 167 bp, Homo sapiens; identical to SEQ ID NO: 67836
  misc_feature 1..167: note = chr1:156594060-156594227
  misc_feature 1..167: note = Hyper
  source 1..167: mol_type = genomic DNA

SEQ ID NO: 103133 - DNA, 836 bp, Homo sapiens
  misc_feature 1..836: note = chr1:156594429-156595265
  misc_feature 1..836: note = Hyper
  source 1..836: mol_type = genomic DNA
gctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtgcgcttcccaatcaccacgccgaggccgcgctgcggggggctcccggatcccggagtgcgcagtttcggcttccccaggccccaacaggcagcctatgggacctactgctacgccgagaattaggcgcccaccgtgtcccctccagcgcgcgcgaagaagcttgggagtcgtggcgggggtctctcgccacccctttccggagagcctcccct

SEQ ID NO: 103134 - DNA, 344 bp, Homo sapiens
  misc_feature 1..344: note = chr1:156611775-156612119
  misc_feature 1..344: note = Hyper
  source 1..344: mol_type = genomic DNA
gaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtaggtgagtgcctccgcagccccgccgcccgccgtggggtcggggacagggagaa

SEQ ID NO: 103135 - DNA, 623 bp, Homo sapiens
  misc_feature 1..623: note = chr1:156626475-156627098
  misc_feature 1..623: note = Hyper
  source 1..623: mol_type = genomic DNA
gatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccctgccatatgctctcactctctctcactcgcctaaccgccttcctcattaacccatgcacttattccttggttttctcaagcgtgcattccctcactcattcgttcactccccttctcattctctctcccttcccaccctacgcttaggcagtggccttcgggaacggagagtggaggtt

SEQ ID NO: 103136 - DNA, 30 bp, Homo sapiens; identical to SEQ ID NO: 67844
  misc_feature 1..30: note = chr1:156636236-156636266
  misc_feature 1..30: note = Hypo
  source 1..30: mol_type = genomic DNA

SEQ ID NO: 103137 - DNA, 263 bp, Homo sapiens
  misc_feature 1..263: note = chr1:156646593-156646856
  misc_feature 1..263: note = Hyper
  source 1..263: mol_type = genomic DNA
cctgcgcgttcaggccgacgcgctcctcctcgtgcgccacgcgtagagcctctagctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctcttcagccaggttgtcgcgcgccacctcggccgcgtgcttctcccgccagcgttggtca

SEQ ID NO: 103138 - DNA, 90 bp, Homo sapiens; identical to SEQ ID NO: 67847
  misc_feature 1..90: note = chr1:156676449-156676539
  misc_feature 1..90: note = Hyper
  source 1..90: mol_type = genomic DNA

SEQ ID NO: 103139 - DNA, 34 bp, Homo sapiens; identical to SEQ ID NO: 39087
  misc_feature 1..34: note = chr1:156690386-156690420
  misc_feature 1..34: note = Hypo
  source 1..34: mol_type = genomic DNA

SEQ ID NO: 103140 - DNA, 30 bp, Homo sapiens; identical to SEQ ID NO: 67852
  misc_feature 1..30: note = chr1:156783716-156783746
  misc_feature 1..30: note = Hyper
  source 1..30: mol_type = genomic DNA

SEQ ID NO: 103141 - DNA, 999 bp, Homo sapiens
  misc_feature 1..999: note = chr1:156814754-156815753
  misc_feature 1..999: note = Hyper
  source 1..999: mol_type = genomic DNA
gaggggcaagcaaagcgaggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggttgcaggcatggatgtcgatccggtattccgtgaagtggcgcaggccgctcagcaccgctcgctcacggggcaccttgtcctcctggatctcgaaatccgagctgttgccccccagccggaggggcccagctgcccggcggtgccgccctgagtccctggggagagcgagtcagagccaaggcccagcccccaaagccacgcccctcagcacctgccctagtcctgctcacctttgggggctcttgttgatggacgtcaccttccaaggggatctggggaggccaggagtagccctatcaggcctgtccggatgcacccctgtgccctctgcagcgcgtaccgcctccaaaagcacccacaacccgggacccgcccacacaagcaaggccccacccacaaaccccacccctcccgcaagacccgcccctcacaggccccactcatcagaccctcccaggccgcgcgcgctcttcgcacatggggatggtgatcgcgttgtgtagaaagttttcaaacttcttctggaacgaggcctcttgcgcctccagcgggggcagaacctgaccaggaggtgggtgctggcaagggcagcagtcggactccatctcggcctcaggatccccgtcttcgccgtcgaagcgcggatcgttgttgctggtgggcagccgcaagcctggcgccgcagcgggaagacactagtaagacaggcggtctacccgcctctgatcccccccacctgccggggccctgcgcctccatctccccttccccacccgccccgcggccggcctgcgcgtcgtccctgcgcaccgcggtggca

SEQ ID NO: 103142 - DNA, 505 bp, Homo sapiens; identical to SEQ ID NO: 67856
  misc_feature 1..505: note = chr1:156818562-156819067
  misc_feature 1..505: note = Hyper
  source 1..505: mol_type = genomic DNA

SEQ ID NO: 103143 - DNA, 56 bp, Homo sapiens; identical to SEQ ID NO: 67857
  misc_feature 1..56: note = chr1:156823879-156823935
  misc_feature 1..56: note = Hypo
  source 1..56: mol_type = genomic DNA

SEQ ID NO: 103144 - DNA, 124 bp, Homo sapiens; identical to SEQ ID NO: 67858
  misc_feature 1..124: note = chr1:156829116-156829240
  misc_feature 1..124: note = Hyper
  source 1..124: mol_type = genomic DNA

SEQ ID NO: 103145 - DNA, 100 bp, Homo sapiens; identical to SEQ ID NO: 67859
  misc_feature 1..100: note = chr1:156829475-156829575
  misc_feature 1..100: note = Hyper
  source 1..100: mol_type = genomic DNA

SEQ ID NO: 103146 - DNA, 153 bp, Homo sapiens
  misc_feature 1..153: note = chr1:156830195-156830348
  misc_feature 1..153: note = Hyper
  source 1..153: mol_type = genomic DNA
tttcttcctagagttcggagaatgttctacctaacttactccaagtgacatgctcactcccctaggcacgcgcgccgcgaggatggagcgctgagcctggggctggctaggatgacctggacagcaacctttcctcaacgcagtcatcttccc

SEQ ID NO: 103147 - DNA, 246 bp, Homo sapiens; identical to SEQ ID NO: 67861
  misc_feature 1..246: note = chr1:156830950-156831196
  misc_feature 1..246: note = Hyper
  source 1..246: mol_type = genomic DNA

SEQ ID NO: 103148 - DNA, 180 bp, Homo sapiens; identical to SEQ ID NO: 67862
  misc_feature 1..180: note = chr1:156838167-156838347
  misc_feature 1..180: note = Hypo
  source 1..180: mol_type = genomic DNA

SEQ ID NO: 103149 - DNA, 389 bp, Homo sapiens; identical to SEQ ID NO: 67863
  misc_feature 1..389: note = chr1:156843312-156843701
  misc_feature 1..389: note = Hypo
  source 1..389: mol_type = genomic DNA

SEQ ID NO: 103150 - DNA, 91 bp, Homo sapiens; identical to SEQ ID NO: 67864
  misc_feature 1..91: note = chr1:156849311-156849402
  misc_feature 1..91: note = Hypo
  source 1..91: mol_type = genomic DNA

SEQ ID NO: 103151 - DNA, 270 bp, Homo sapiens; identical to SEQ ID NO: 67865
  misc_feature 1..270: note = chr1:156849702-156849972
  misc_feature 1..270: note = Hypo
  source 1..270: mol_type = genomic DNA

SEQ ID NO: 103152 - DNA, 733 bp, Homo sapiens
  misc_feature 1..733: note = chr1:156862991-156863724
  misc_feature 1..733: note = Hyper
  source 1..733: mol_type = genomic DNA
cagtgcgattaggggcggcaggaggagaggggggcctcgccctgtcagcctctccgagactagtgggatgcggtgcccgggaggggtcttaataagatcacggttgctgggcagcactggacagtgcccgacgtaggcgatctcattgattccttcccacaaccccactttgcagataggaaagctgaggcacgagagggtaagtaacccaggccgcacaacgaggggaagctagggagggactggggccctgggcccctgcgctgacctcccctcctcatccccttcttatccccctctgctcctggcccaggccgcgcagagtcggcctctgtgatcccacccagaatacagttttccctcccgggcgcctggatctcccctcccccggctcctgtttccttgtcaaaacttcctgccttggcgagggcccgagttcccacccccttcctgccccccgcccctcggcgcccctcccggccctgcgatcagcagcgtcccgcctccccgccgctcccgcagtcaggctggggctcgaagtggggaccctcgccccgtcctcggctgtccagtcctcctcctcgcagaccccggcggttcctaccccaggccgcaggggagacggggccccaaggcaggtgagtgactgcgcgccccctggcaggggaggcccggtggtgcggccccggagaccaccctgccccggggaaagggcttgcggtccctgaggtcc

SEQ ID NO: 103153 - DNA, 96 bp, Homo sapiens; identical to SEQ ID NO: 67868
  misc_feature 1..96: note = chr1:156866303-156866399
  misc_feature 1..96: note = Hypo
  source 1..96: mol_type = genomic DNA

SEQ ID NO: 103154 - DNA, 195 bp, Homo sapiens; identical to SEQ ID NO: 67869
  misc_feature 1..195: note = chr1:156890228-156890423
  misc_feature 1..195: note = Hyper
  source 1..195: mol_type = genomic DNA

SEQ ID NO: 103155 - DNA, 146 bp, Homo sapiens; identical to SEQ ID NO: 67870
  misc_feature 1..146: note = chr1:156890673-156890819
  misc_feature 1..146: note = Hyper
  source 1..146: mol_type = genomic DNA

SEQ ID NO: 103156 - DNA, 788 bp, Homo sapiens
  misc_feature 1..788: note = chr1:156893504-156894292
  misc_feature 1..788: note = Hyper
  source 1..788: mol_type = genomic DNA
cagaagaggggaccccgttgtctaccgtgcacgcacgcccgttagtcccctttctccgagctcttgctttccccgtttcctatcaagtgttttcagcgtccgtacttccaagcgtttgcaagttgaatggctgcaaaaatatccgtctgaggagggcccctccgcccgcgcgggagagcttggggatgcgggggtgggcgtggccccttctctcacgcccctgcctgcccccgcagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttaggtgagtgacagtggagctccccggtgcctgccagggccgcctagtccatcctcagcctcccttcccacgccgggccaaatggagggacgcggggcggtgtgtgtgtgtgagtcggcggtattcgacgaggccggtggggaggtgggggagtctcccgtcttcctttccaacccagcagaggcgcgagtggccggagaggcagagtccgcaggccggcgcctcccctctggcggtgtcctccaatcccacccgggcacccgtgggccggcccggcgtggggccctggaggtggctgttcccctccctcctcacctctgccttccagacgatccgcggctgtcggggtcctgcagcctcaatagcctggagagcaaatacgtgttcttccggcccaccatccag

SEQ ID NO: 103157 - DNA, 30 bp, Homo sapiens; identical to SEQ ID NO: 67874
  misc_feature 1..30: note = chr1:156897401-156897431
  misc_feature 1..30: note = Hyper
  source 1..30: mol_type = genomic DNA

SEQ ID NO: 103158 - DNA, 40 bp, Homo sapiens; identical to SEQ ID NO: 67875
  misc_feature 1..40: note = chr1:156897769-156897809
  misc_feature 1..40: note = Hyper
  source 1..40: mol_type = genomic DNA

SEQ ID NO: 103159 - DNA, 30 bp, Homo sapiens; identical to SEQ ID NO: 67876
  misc_feature 1..30: note = chr1:156915778-156915808
  misc_feature 1..30: note = Hypo
  source 1..30: mol_type = genomic DNA

SEQ ID NO: 103160 - DNA, 30 bp, Homo sapiens; identical to SEQ ID NO: 39092
  misc_feature 1..30: note = chr1:157086435-157086465
  misc_feature 1..30: note = Hypo
  source 1..30: mol_type = genomic DNA

SEQ ID NO: 103161 - DNA, 30 bp, Homo sapiens
  misc_feature 1..30: note = chr1:157164721-157164751
  misc_feature 1..30: note = Hyper
  source 1..30: mol_type = genomic DNA
ctgcacagttgggcacggagggaccccgag

SEQ ID NO: 103162 - DNA, 37 bp, Homo sapiens; identical to SEQ ID NO: 67879
  misc_feature 1..37: note = chr1:157247210-157247247
  misc_feature 1..37: note = Hypo
  source 1..37: mol_type = genomic DNA

SEQ ID NO: 103163 - DNA, 96 bp, Homo sapiens; identical to SEQ ID NO: 67880
  misc_feature 1..96: note = chr1:157247367-157247463
  misc_feature 1..96: note = Hypo
  source 1..96: mol_type = genomic DNA

SEQ ID NO: 103164 - DNA, 48 bp, Homo sapiens; identical to SEQ ID NO: 67881
  misc_feature 1..48: note = chr1:157346340-157346388
  misc_feature 1..48: note = Hypo
  source 1..48: mol_type = genomic DNA

SEQ ID NO: 103165 - DNA, 162 bp, Homo sapiens; identical to SEQ ID NO: 39094
  misc_feature 1..162: note = chr1:157458773-157458935
  misc_feature 1..162: note = Hypo
  source 1..162: mol_type = genomic DNA

SEQ ID NO: 103166 - DNA, 227 bp, Homo sapiens; identical to SEQ ID NO: 67883
  misc_feature 1..227: note = chr1:157490582-157490809
  misc_feature 1..227: note = Hypo
  source 1..227: mol_type = genomic DNA

SEQ ID NO: 103167 - DNA, 191 bp, Homo sapiens; identical to SEQ ID NO: 39096
  misc_feature 1..191: note = chr1:157527405-157527596
  misc_feature 1..191: note = Hypo
  source 1..191: mol_type = genomic DNA

SEQ ID NO: 103168 - DNA, 87 bp, Homo sapiens; identical to SEQ ID NO: 39097
  misc_feature 1..87: note = chr1:157543012-157543099
  misc_feature 1..87: note = Hypo
  source 1..87: mol_type = genomic DNA

SEQ ID NO: 103169 - DNA, 30 bp, Homo sapiens; identical to SEQ ID NO: 67886
  misc_feature 1..30: note = chr1:157543676-157543706
  misc_feature 1..30: note = Hypo
  source 1..30: mol_type = genomic DNA

SEQ ID NO: 103170 - DNA, 38 bp, Homo sapiens; identical to SEQ ID NO: 67887
  misc_feature 1..38: note = chr1:157608817-157608855
  misc_feature 1..38: note = Hypo
  source 1..38: mol_type = genomic DNA

SEQ ID NO: 103171 - DNA, 36 bp, Homo sapiens; identical to SEQ ID NO: 39098
  misc_feature 1..36: note = chr1:157791984-157792020
  misc_feature 1..36: note = Hypo
  source 1..36: mol_type = genomic DNA

SEQ ID NO: 103172 - DNA, 412 bp, Homo sapiens; identical to SEQ ID NO: 67889
  misc_feature 1..412: note = chr1:157895130-157895542
  misc_feature 1..412: note = Hypo
  source 1..412: mol_type = genomic DNA

SEQ ID NO: 103173 - DNA, 22 bp, Homo sapiens
  misc_feature 1..22: note = chr1:157905741-157905763
  misc_feature 1..22: note = Hypo
  source 1..22: mol_type = genomic DNA
aattaagctataggccgggtgc

SEQ ID NO: 103174 - DNA, 228 bp, Homo sapiens
  misc_feature 1..228: note = chr1:157963288-157963516
  misc_feature 1..228: note = Hyper
  source 1..228: mol_type = genomic DNA
ggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactccgggccccagccgcgggcgggcgcacggcgggcggacagcatgctgagcctcctcgtctggatcctcactctctccgatactttctccca

SEQ ID NO: 103175 - DNA, 154 bp, Homo sapiens; identical to SEQ ID NO: 26658
  misc_feature 1..154: note = chr1:157963737-157963891
  misc_feature 1..154: note = Hyper
  source 1..154: mol_type = genomic DNA

SEQ ID NO: 103176 - DNA, 30 bp, Homo sapiens; identical to SEQ ID NO: 67894
  misc_feature 1..30: note = chr1:158064583-158064613
  misc_feature 1..30: note = Hypo
  source 1..30: mol_type = genomic DNA

SEQ ID NO: 103177 - DNA, 55 bp, Homo sapiens; identical to SEQ ID NO: 67895
  misc_feature 1..55: note = chr1:158064823-158064878
  misc_feature 1..55: note = Hypo
  source 1..55: mol_type = genomic DNA

SEQ ID NO: 103178 - DNA, 530 bp, Homo sapiens; identical to SEQ ID NO: 67896
  misc_feature 1..530: note = chr1:158083182-158083712
  misc_feature 1..530: note = Hyper
  source 1..530: mol_type = genomic DNA

SEQ ID NO: 103179 - DNA, 30 bp, Homo sapiens; identical to SEQ ID NO: 67897
  misc_feature 1..30: note = chr1:158120029-158120059
  misc_feature 1..30: note = Hypo
  source 1..30: mol_type = genomic DNA

SEQ ID NO: 103180 - DNA, 40 bp, Homo sapiens; identical to SEQ ID NO: 67898
  misc_feature 1..40: note = chr1:158129286-158129326
  misc_feature 1..40: note = Hypo
  source 1..40: mol_type = genomic DNA

SEQ ID NO: 103181 - DNA, 600 bp, Homo sapiens
  misc_feature 1..600: note = chr1:158150556-158151156
  misc_feature 1..600: note = Hyper
  source 1..600: mol_type = genomic DNA
ataatggttgtaaagcgtcccacacgttgacccaaagtctcctttgaaacaggaaattgagacacgccggttgtgaaacctactgaagtgagcggcggcgccaggattcctgggaccccgacctctttgcagctcgcacagctaagggcgagggcgcccttcggcagaagcagcaaaccgccggcaagcccagcgaggagggctgccggggtctgggcttgggaattggctggcacccagcggaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctc

SEQ ID NO: 103182 - DNA, 30 bp, Homo sapiens; identical to SEQ ID NO: 67902
  misc_feature 1..30: note = chr1:158165497-158165527
  misc_feature 1..30: note = Hypo
  source 1..30: mol_type = genomic DNA

SEQ ID NO: 103183 - DNA, 141 bp, Homo sapiens; identical to SEQ ID NO: 14282
  misc_feature 1..141: note = chr1:158169208-158169349
  misc_feature 1..141: note = Hypo
  source 1..141: mol_type = genomic DNA

SEQ ID NO: 103184 - DNA, 30 bp, Homo sapiens; identical to SEQ ID NO: 67904
  misc_feature 1..30: note = chr1:158232713-158232743
  misc_feature 1..30: note = Hypo
  source 1..30: mol_type = genomic DNA

SEQ ID NO: 103185 - DNA, 60 bp, Homo sapiens; identical to SEQ ID NO: 39101
  misc_feature 1..60: note = chr1:158237112-158237172
  misc_feature 1..60: note = Hypo
  source 1..60: mol_type = genomic DNA

SEQ ID NO: 103186 - DNA, 20 bp, Homo sapiens
  misc_feature 1..20: note = chr1:158366698-158366718
  misc_feature 1..20: note = Hypo
  source 1..20: mol_type = genomic DNA
tattttggccaggggcggtg

SEQ ID NO: 103187 - DNA, 30 bp, Homo sapiens; identical to SEQ ID NO: 39103
  misc_feature 1..30: note = chr1:158578092-158578122
  misc_feature 1..30: note = Hypo
  source 1..30: mol_type = genomic DNA

SEQ ID NO: 103188 - DNA, 16 bp, Homo sapiens
  misc_feature 1..16: note = chr1:158591676-158591692
  misc_feature 1..16: note = Hypo
  source 1..16: mol_type = genomic DNA
ggagtcttgctctgtc

SEQ ID NO: 103189 - DNA, 15 bp, Homo sapiens
  misc_feature 1..15: note = chr1:158591932-158591947
  misc_feature 1..15: note = Hypo
  source 1..15: mol_type = genomic DNA
cgtgagccactgcac

SEQ ID NO: 103190 - DNA, 42 bp, Homo sapiens; identical to SEQ ID NO: 67910
  misc_feature 1..42: note = chr1:158639312-158639354
  misc_feature 1..42: note = Hypo
  source 1..42: mol_type = genomic DNA

SEQ ID NO: 103191 - DNA, 178 bp, Homo sapiens; identical to SEQ ID NO: 39107
  misc_feature 1..178: note = chr1:158669704-158669882
  misc_feature 1..178: note = Hypo
  source 1..178: mol_type = genomic DNA

SEQ ID NO: 103192 - DNA, 300 bp, Homo sapiens; identical to SEQ ID NO: 67912
  misc_feature 1..300: note = chr1:158672332-158672632
  misc_feature 1..300: note = Hypo
  source 1..300: mol_type = genomic DNA

SEQ ID NO: 103193 - DNA, 183 bp, Homo sapiens; identical to SEQ ID NO: 67913
  misc_feature 1..183: note = chr1:158686993-158687176
  misc_feature 1..183: note = Hypo
  source 1..183: mol_type = genomic DNA

SEQ ID NO: 103194 - DNA, 135 bp, Homo sapiens; identical to SEQ ID NO: 67914
  misc_feature 1..135: note = chr1:158687415-158687550
  misc_feature 1..135: note = Hypo
  source 1..135: mol_type = genomic DNA

SEQ ID NO: 103195 - DNA, 30 bp, Homo sapiens; identical to SEQ ID NO: 67915
  misc_feature 1..30: note = chr1:158710956-158710986
  misc_feature 1..30: note = Hypo
  source 1..30: mol_type = genomic DNA

SEQ ID NO: 103196 - DNA, 32 bp, Homo sapiens; identical to SEQ ID NO: 67916
  misc_feature 1..32: note = chr1:158712034-158712066
  misc_feature 1..32: note = Hypo
  source 1..32: mol_type = genomic DNA

SEQ ID NO: 103197 - DNA, 30 bp, Homo sapiens; identical to SEQ ID NO: 67917
  misc_feature 1..30: note = chr1:158712492-158712522
  misc_feature 1..30: note = Hypo
  source 1..30: mol_type = genomic DNA

SEQ ID NO: 103198 - DNA, 107 bp, Homo sapiens; identical to SEQ ID NO: 39109
  misc_feature 1..107: note = chr1:158723718-158723825
  misc_feature 1..107: note = Hypo
  source 1..107: mol_type = genomic DNA

SEQ ID NO: 103199 - DNA, 17 bp, Homo sapiens
  misc_feature 1..17: note = chr1:158730575-158730592
  misc_feature 1..17: note = Hypo
  source 1..17: mol_type = genomic DNA
ctgggtgcagtggctcg

SEQ ID NO: 103200 - DNA, 30 bp, Homo sapiens; identical to SEQ ID NO: 67920
  misc_feature 1..30: note = chr1:158746532-158746562
  misc_feature 1..30: note = Hypo
  source 1..30: mol_type = genomic DNA

SEQ ID NO: 103201 - DNA, 32 bp, Homo sapiens; identical to SEQ ID NO: 67921
  misc_feature 1..32: note = chr1:158760470-158760502
  misc_feature 1..32: note = Hypo
  source 1..32: mol_type = genomic DNA

SEQ ID NO: 103202 - DNA, 42 bp, Homo sapiens; identical to SEQ ID NO: 39112
  misc_feature 1..42: note = chr1:158815297-158815339
  misc_feature 1..42: note = Hypo
  source 1..42: mol_type = genomic DNA

SEQ ID NO: 103203 - DNA, 39 bp, Homo sapiens; identical to SEQ ID NO: 67923
  misc_feature 1..39: note = chr1:158840962-158841001
  misc_feature 1..39: note = Hypo
  source 1..39: mol_type = genomic DNA

SEQ ID NO: 103204 - DNA, 60 bp, Homo sapiens; identical to SEQ ID NO: 67924
  misc_feature 1..60: note = chr1:159088824-159088884
  misc_feature 1..60: note = Hypo
  source 1..60: mol_type = genomic DNA

SEQ ID NO: 103205 - DNA, 376 bp, Homo sapiens
  misc_feature 1..376: note = chr1:159141385-159141761
  misc_feature 1..376: note = Hyper
  source 1..376: mol_type = genomic DNA
ccgcgactgcagcagcgccggctccctcccggtccccacctcggccccgggctccgaagcggctcgggggcgccctttcggtcaacatcgtagtccaccccctccccatccccagcccccggggattcaggctcgccagcgcccagccagggagccggccgggaagcgcgatgggggccccagccgcctcgctcctgctcctgctcctgctgttcgcctgctgctgggcgcccggcggggccaacctctcccaggacggtgagtgagggagggggcggcgcctggggaggtggggagtgacccgaggcgggggctgggatcgggagtctcgcggaaggagcctgttggctttgtttggaaccggggttaaagtcac

SEQ ID NO: 103206 - DNA, 206 bp, Homo sapiens
  misc_feature 1..206: note = chr1:159158305-159158511
  misc_feature 1..206: note = Hyper
  source 1..206: mol_type = genomic DNA
cagctggctctgagtcgcgctgggacgactggcgaagttcacccgggactccaaagcccggacacgtagcagctctgggctctgctcagcagcggatgagctcactgaattttgcgcacttgattggctacttcggggcgctgcggcgggagaccctgaaaagattcgcaaggccggtttctttgtccctccgcctcttcaggttg

SEQ ID NO: 103207 - DNA, 79 bp, Homo sapiens; identical to SEQ ID NO: 67931
  misc_feature 1..79: note = chr1:159187230-159187309
  misc_feature 1..79: note = Hypo
  source 1..79: mol_type = genomic DNA

SEQ ID NO: 103208 - DNA, 33 bp, Homo sapiens; identical to SEQ ID NO: 67932
  misc_feature 1..33: note = chr1:159202103-159202136
  misc_feature 1..33: note = Hypo
  source 1..33: mol_type = genomic DNA

SEQ ID NO: 103209 - DNA, 24 bp, Homo sapiens
  misc_feature 1..24: note = chr1:159448019-159448043
  misc_feature 1..24: note = Hypo
  source 1..24: mol_type = genomic DNA
tttttttttttgagacggagtctg

SEQ ID NO: 103210 - DNA, 51 bp, Homo sapiens; identical to SEQ ID NO: 67936
  misc_feature 1..51: note = chr1:159642793-159642844
  misc_feature 1..51: note = Hypo
  source 1..51: mol_type = genomic DNA

SEQ ID NO: 103211 - DNA, 41 bp, Homo sapiens; identical to SEQ ID NO: 39114
  misc_feature 1..41: note = chr1:159650169-159650210
  misc_feature 1..41: note = Hypo
  source 1..41: mol_type = genomic DNA

SEQ ID NO: 103212 - DNA, 26 bp, Homo sapiens
  misc_feature 1..26: note = chr1:159679196-159679222
  misc_feature 1..26: note = Hypo
  source 1..26: mol_type = genomic DNA
agactccgtctcggaaaaaaaaaaaa

SEQ ID NO: 103213 - DNA, 96 bp, Homo sapiens; identical to SEQ ID NO: 67939
  misc_feature 1..96: note = chr1:159683839-159683935
  misc_feature 1..96: note = Hypo
  source 1..96: mol_type = genomic DNA

SEQ ID NO: 103214 - DNA, 393 bp, Homo sapiens
  misc_feature 1..393: note = chr1:159750379-159750772
  misc_feature 1..393: note = Hyper
  source 1..393: mol_type = genomic DNA
ccccagggcatccagcgtgaaggaggtagaactaggccggcccgcgaggaggcaggggcaggcgccagtgacgcaatgactgcaacatgccgccagggtgcagcagagcccgaccccgggttgttccatccgcagcaaacaattcctaactcgctccaggtcttccttcttagctgagtgggttgaaccccgtggaagtaaccccccgcccattatgatgatccagccaatcaccgcgtgatctgctcggacggggcgggatcgcggcgcttccctcggtcgctcagagactgggttccgcgttccagccccgccccaggttctgggccaatccccgcggctgggcagagcgacccgagggcggcgccctgcagaccacgtggcccgggaggc

SEQ ID NO: 103215 - DNA, 114 bp, Homo sapiens; identical to SEQ ID NO: 26669
  misc_feature 1..114: note = chr1:159751133-159751247
  misc_feature 1..114: note = Hyper
  source 1..114: mol_type = genomic DNA

SEQ ID NO: 103216 - DNA, 79 bp, Homo sapiens; identical to SEQ ID NO: 67943
  misc_feature 1..79: note = chr1:159869607-159869686
  misc_feature 1..79: note = Hypo
  source 1..79: mol_type = genomic DNA

SEQ ID NO: 103217 - DNA, 23 bp, Homo sapiens
  misc_feature 1..23: note = chr1:159876328-159876351
  misc_feature 1..23: note = Hypo
  source 1..23: mol_type = genomic DNA
agaacatttaggagccgggcatg

SEQ ID NO: 103218 - DNA, 169 bp, Homo sapiens; identical to SEQ ID NO: 14290
  misc_feature 1..169: note = chr1:159883486-159883655
  misc_feature 1..169: note = Hypo
  source 1..169: mol_type = genomic DNA

SEQ ID NO: 103219 - DNA, 45 bp, Homo sapiens; identical to SEQ ID NO: 67946
  misc_feature 1..45: note = chr1:159915746-159915791
  misc_feature 1..45: note = Hyper
  source 1..45: mol_type = genomic DNA

SEQ ID NO: 103220 - DNA, 19 bp, Homo sapiens
  misc_feature 1..19: note = chr1:159930262-159930281
  misc_feature 1..19: note = Hypo
  source 1..19: mol_type = genomic DNA
ttttttcctttgagacgga

SEQ ID NO: 103221 - DNA, 91 bp, Homo sapiens; identical to SEQ ID NO: 67948
  misc_feature 1..91: note = chr1:159931588-159931679
  misc_feature 1..91: note = Hypo
  source 1..91: mol_type = genomic DNA

SEQ ID NO: 103222 - DNA, 72 bp, Homo sapiens; identical to SEQ ID NO: 67949
  misc_feature 1..72: note = chr1:159932029-159932101
  misc_feature 1..72: note = Hypo
  source 1..72: mol_type = genomic DNA

SEQ ID NO: 103223 - DNA, 71 bp, Homo sapiens; identical to SEQ ID NO: 39120
  misc_feature 1..71: note = chr1:160025702-160025773
  misc_feature 1..71: note = Hypo
  source 1..71: mol_type = genomic DNA

SEQ ID NO: 103224 - DNA, 257 bp, Homo sapiens; identical to SEQ ID NO: 67951
  misc_feature 1..257: note = chr1:160039671-160039928
  misc_feature 1..257: note = Hyper
  source 1..257: mol_type = genomic DNA

SEQ ID NO: 103225 - DNA, 171 bp, Homo sapiens; identical to SEQ ID NO: 67952
  misc_feature 1..171: note = chr1:160040333-160040504
  misc_feature 1..171: note = Hyper
  source 1..171: mol_type = genomic DNA

SEQ ID NO: 103226 - DNA, 76 bp, Homo sapiens; identical to SEQ ID NO: 67953
  misc_feature 1..76: note = chr1:160135228-160135304
  misc_feature 1..76: note = Hypo
  source 1..76: mol_type = genomic DNA

SEQ ID NO: 103227 - DNA, 173 bp, Homo sapiens; identical to SEQ ID NO: 67954
  misc_feature 1..173: note = chr1:160370097-160370270
  misc_feature 1..173: note = Hyper
  source 1..173: mol_type = genomic DNA

SEQ ID NO: 103228 - DNA, 30 bp, Homo sapiens; identical to SEQ ID NO: 26673
  misc_feature 1..30: note = chr1:160370599-160370629
  misc_feature 1..30: note = Hyper
  source 1..30: mol_type = genomic DNA

SEQ ID NO: 103229 - DNA, 36 bp, Homo sapiens; identical to SEQ ID NO: 39121
  misc_feature 1..36: note = chr1:160451199-160451235
  misc_feature 1..36: note = Hypo
  source 1..36: mol_type = genomic DNA

SEQ ID NO: 103230 - DNA, 30 bp, Homo sapiens; identical to SEQ ID NO: 67958
  misc_feature 1..30: note = chr1:160503724-160503754
  misc_feature 1..30: note = Hypo
  source 1..30: mol_type = genomic DNA

SEQ ID NO: 103231 - DNA, 30 bp, Homo sapiens; identical to SEQ ID NO: 67959
  misc_feature 1..30: note = chr1:160508436-160508466
  misc_feature 1..30: note = Hypo
  source 1..30: mol_type = genomic DNA

SEQ ID NO: 103232 - DNA, 97 bp, Homo sapiens; identical to SEQ ID NO: 67960
  misc_feature 1..97: note = chr1:160523172-160523269
  misc_feature 1..97: note = Hypo
  source 1..97: mol_type = genomic DNA

SEQ ID NO: 103233 - DNA, 17 bp, Homo sapiens
  misc_feature 1..17: note = chr1:160524877-160524894
  misc_feature 1..17: note = Hypo
  source 1..17: mol_type = genomic DNA
tttttttttttgagacg

SEQ ID NO: 103234 - DNA, 30 bp, Homo sapiens; identical to SEQ ID NO: 67964
  misc_feature 1..30: note = chr1:160654992-160655022
  misc_feature 1..30: note = Hypo
  source 1..30: mol_type = genomic DNA

SEQ ID NO: 103235 - DNA, 94 bp, Homo sapiens; identical to SEQ ID NO: 67965
  misc_feature 1..94: note = chr1:160693863-160693957
  misc_feature 1..94: note = Hypo
  source 1..94: mol_type = genomic DNA

SEQ ID NO: 103236 - DNA, 30 bp, Homo sapiens; identical to SEQ ID NO: 67966
  misc_feature 1..30: note = chr1:160698365-160698395
  misc_feature 1..30: note = Hypo
  source 1..30: mol_type = genomic DNA

SEQ ID NO: 103237 - DNA, 25 bp, Homo sapiens
  misc_feature 1..25: note = chr1:160752829-160752854
  misc_feature 1..25: note = Hypo
  source 1..25: mol_type = genomic DNA
gaaaacaaccctgaacgcaggtgac

SEQ ID NO: 103238 - DNA, 197 bp, Homo sapiens; identical to SEQ ID NO: 67968
  misc_feature 1..197: note = chr1:160787406-160787603
  misc_feature 1..197: note = Hypo
  source 1..197: mol_type = genomic DNA

SEQ ID NO: 103239 - DNA, 30 bp, Homo sapiens; identical to SEQ ID NO: 39124
  misc_feature 1..30: note = chr1:160820959-160820989
  misc_feature 1..30: note = Hypo
  source 1..30: mol_type = genomic DNA

SEQ ID NO: 103240 - DNA, 30 bp, Homo sapiens; identical to SEQ ID NO: 14294
  misc_feature 1..30: note = chr1:160853373-160853403
  misc_feature 1..30: note = Hypo
  source 1..30: mol_type = genomic DNA

SEQ ID NO: 103241 - DNA, 101 bp, Homo sapiens; identical to SEQ ID NO: 67971
  misc_feature 1..101: note = chr1:160880601-160880702
  misc_feature 1..101: note = Hypo
  source 1..101: mol_type = genomic DNA

SEQ ID NO: 103242 - DNA, 120 bp, Homo sapiens; identical to SEQ ID NO: 67972
  misc_feature 1..120: note = chr1:160883883-160884003
  misc_feature 1..120: note = Hypo
  source 1..120: mol_type = genomic DNA

SEQ ID NO: 103243 - DNA, 151 bp, Homo sapiens; identical to SEQ ID NO: 67973
  misc_feature 1..151: note = chr1:160953002-160953153
  misc_feature 1..151: note = Hypo
  source 1..151: mol_type = genomic DNA

SEQ ID NO: 103244 - DNA, 27 bp, Homo sapiens
  misc_feature 1..27: note = chr1:160992336-160992363
  misc_feature 1..27: note = Hypo
  source 1..27: mol_type = genomic DNA
cttaatagtcttggccgggtgcgtggc

SEQ ID NO: 103245 - DNA, 57 bp, Homo sapiens; identical to SEQ ID NO: 14297
  misc_feature 1..57: note = chr1:161007705-161007762
  misc_feature 1..57: note = Hypo
  source 1..57: mol_type = genomic DNA

SEQ ID NO: 103246 - DNA, 193 bp, Homo sapiens; identical to SEQ ID NO: 67976
  misc_feature 1..193: note = chr1:161044630-161044823
  misc_feature 1..193: note = Hypo
  source 1..193: mol_type = genomic DNA

SEQ ID NO: 103247 - DNA, 181 bp, Homo sapiens; identical to SEQ ID NO: 39131
  misc_feature 1..181: note = chr1:161056643-161056824
  misc_feature 1..181: note = Hypo
  source 1..181: mol_type = genomic DNA

SEQ ID NO: 103248 - DNA, 30 bp, Homo sapiens; identical to SEQ ID NO: 67978
  misc_feature 1..30: note = chr1:161059519-161059549
  misc_feature 1..30: note = Hypo
  source 1..30: mol_type = genomic DNA

SEQ ID NO: 103249 - DNA, 30 bp, Homo sapiens; identical to SEQ ID NO: 67979
  misc_feature 1..30: note = chr1:161062448-161062478
  misc_feature 1..30: note = Hypo
  source 1..30: mol_type = genomic DNA

SEQ ID NO: 103250 - DNA, 646 bp, Homo sapiens; identical to SEQ ID NO: 67980
  misc_feature 1..646: note = chr1:161067928-161068574
  misc_feature 1..646: note = Hyper
  source 1..646: mol_type = genomic DNA

SEQ ID NO: 103251 - DNA, 78 bp, Homo sapiens; identical to SEQ ID NO: 67981
  misc_feature 1..78: note = chr1:161121163-161121241
  misc_feature 1..78: note = Hypo
  source 1..78: mol_type = genomic DNA

SEQ ID NO: 103252 - DNA, 224 bp, Homo sapiens; identical to SEQ ID NO: 67982
  misc_feature 1..224: note = chr1:161228649-161228873
  misc_feature 1..224: note = Hyper
  source 1..224: mol_type = genomic DNA

SEQ ID NO: 103253 - DNA, 668 bp, Homo sapiens
  misc_feature 1..668: note = chr1:161275455-161276123
  misc_feature 1..668: note = Hyper
  source 1..668: mol_type = genomic DNA
ggggtgggggggtggcgatcacttgtccgagttcaggcccatcatgttcttgagggcgtttttgaggctggttctgctgggggacttgacagcaggccggagctccgggctctgctcatcctttcgtagctccatctcgatgaccatcacctttgggcctttggcggactccacccctaacccccgatcccccgcccggcccgctaaccgctatttcttatccttgcgagactcccccagccccttggccttcttctcactgacagctttggtgcttctgctgtggtccagcattgcatacagcactggcgtctgggggaggggcgcacacatcagtcaccgagcgactggggcttgactgttcccatcccacccctcactgctgcccggcggctcccagggttctccttcccatcttgtctaggccccaagtcccgctaacctgccgcccgcgcttcgacgcgtcctttcctggcttgtgcaatttccccttctccatagcactgcaagaagagagactgctgtacgtttggcctcgccggaaccccttgcaccgcggacacagcttcctcttccccttggccctcccacccactggagtagtctccgcccagatgggggatagtggggagagggggaggggagctaggctccgccccttacctgag

SEQ ID NO: 103254 - DNA, 41 bp, Homo sapiens; identical to SEQ ID NO: 67985
  misc_feature 1..41: note = chr1:161358973-161359014
  misc_feature 1..41: note = Hypo
  source 1..41: mol_type = genomic DNA

SEQ ID NO: 103255 - DNA, 360 bp, Homo sapiens; identical to SEQ ID NO: 67986
  misc_feature 1..360: note = chr1:161367762-161368122
  misc_feature 1..360: note = Hypo
  source 1..360: mol_type = genomic DNA

SEQ ID NO: 103256 - DNA, 140 bp, Homo sapiens; identical to SEQ ID NO: 67987
  misc_feature 1..140: note = chr1:161409851-161409991
  misc_feature 1..140: note = Hyper
  source 1..140: mol_type = genomic DNA

SEQ ID NO: 103257 - DNA, 169 bp, Homo sapiens; identical to SEQ ID NO: 39134
  misc_feature 1..169: note = chr1:161442404-161442573
  misc_feature 1..169: note = Hypo
  source 1..169: mol_type = genomic DNA

SEQ ID NO: 103258 - DNA, 252 bp, Homo sapiens; identical to SEQ ID NO: 67989
  misc_feature 1..252: note = chr1:161450235-161450487
  misc_feature 1..252: note = Hypo
  source 1..252: mol_type = genomic DNA

SEQ ID NO: 103259 - DNA, 29 bp, Homo sapiens
  misc_feature 1..29: note = chr1:161471750-161471779
  misc_feature 1..29: note = Hypo
  source 1..29: mol_type = genomic DNA
ccaccgcacctggccggttctcttgaatc

SEQ ID NO: 103260 - DNA, 215 bp, Homo sapiens; identical to SEQ ID NO: 67991
  misc_feature 1..215: note = chr1:161481646-161481861
  misc_feature 1..215: note = Hypo
  source 1..215: mol_type = genomic DNA

SEQ ID NO: 103261 - DNA, 99 bp, Homo sapiens; identical to SEQ ID NO: 67992
  misc_feature 1..99: note = chr1:161493379-161493478
  misc_feature 1..99: note = Hypo
  source 1..99: mol_type = genomic DNA

SEQ ID NO: 103262 - DNA, 184 bp, Homo sapiens; identical to SEQ ID NO: 67993
  misc_feature 1..184: note = chr1:161494827-161495011
  misc_feature 1..184: note = Hyper
  source 1..184: mol_type = genomic DNA

SEQ ID NO: 103263 - DNA, 283 bp, Homo sapiens; identical to SEQ ID NO: 67994
  misc_feature 1..283: note = chr1:161509756-161510039
  misc_feature 1..283: note = Hyper
  source 1..283: mol_type = genomic DNA

SEQ ID NO: 103264 - DNA, 163 bp, Homo sapiens; identical to SEQ ID NO: 67995
  misc_feature 1..163: note = chr1:161510099-161510262
  misc_feature 1..163: note = Hyper
  source 1..163: mol_type = genomic DNA

SEQ ID NO: 103265 - DNA, 17 bp, Homo sapiens
  misc_feature 1..17: note = chr1:161529750-161529767
  misc_feature 1..17: note = Hypo
  source 1..17: mol_type = genomic DNA
aaagcctcactctgtcg

SEQ ID NO: 103266 - DNA, 34 bp, Homo sapiens; identical to SEQ ID NO: 67997
  misc_feature 1..34: note = chr1:161577201-161577235
  misc_feature 1..34: note = Hypo
  source 1..34: mol_type = genomic DNA

SEQ ID NO: 103267 - DNA, 30 bp, Homo sapiens; identical to SEQ ID NO: 39137
  misc_feature 1..30: note = chr1:161577640-161577670
  misc_feature 1..30: note = Hypo
  source 1..30: mol_type = genomic DNA

SEQ ID NO: 103268 - DNA, 128 bp, Homo sapiens; identical to SEQ ID NO: 26682
  misc_feature 1..128: note = chr1:161581762-161581890
  misc_feature 1..128: note = Hyper
  source 1..128: mol_type = genomic DNA

SEQ ID NO: 103269 - DNA, 413 bp, Homo sapiens; identical to SEQ ID NO: 68000
  misc_feature 1..413: note = chr1:161582234-161582647
  misc_feature 1..413: note = Hyper
  source 1..413: mol_type = genomic DNA

SEQ ID NO: 103270 - DNA, 81 bp, Homo sapiens; identical to SEQ ID NO: 68001
  misc_feature 1..81: note = chr1:161591283-161591364
  misc_feature 1..81: note = Hyper
  source 1..81: mol_type = genomic DNA

SEQ ID NO: 103271 - DNA, 140 bp, Homo sapiens; identical to SEQ ID NO: 68002
  misc_feature 1..140: note = chr1:161591628-161591768
  misc_feature 1..140: note = Hyper
  source 1..140: mol_type = genomic DNA

SEQ ID NO: 103272 - DNA, 231 bp, Homo sapiens; identical to SEQ ID NO: 68003
  misc_feature 1..231: note = chr1:161695622-161695853
  misc_feature 1..231: note = Hyper
  source 1..231: mol_type = genomic DNA

SEQ ID NO: 103273 - DNA, 277 bp, Homo sapiens; identical to SEQ ID NO: 68004
  misc_feature 1..277: note = chr1:161697067-161697344
  misc_feature 1..277: note = Hyper
  source 1..277: mol_type = genomic DNA

SEQ ID NO: 103274 - DNA, 45 bp, Homo sapiens; identical to SEQ ID NO: 39138
  misc_feature 1..45: note = chr1:161879452-161879497
  misc_feature 1..45: note = Hypo
  source 1..45: mol_type = genomic DNA

SEQ ID NO: 103275 - DNA, 54 bp, Homo sapiens; identical to SEQ ID NO: 68006
  misc_feature 1..54: note = chr1:161913485-161913539
  misc_feature 1..54: note = Hypo
  source 1..54: mol_type = genomic DNA

SEQ ID NO: 103276 - DNA, 30 bp, Homo sapiens; identical to SEQ ID NO: 68007
  misc_feature 1..30: note = chr1:162389828-162389858
  misc_feature 1..30: note = Hypo
  source 1..30: mol_type = genomic DNA

SEQ ID NO: 103277 - DNA, 500 bp, Homo sapiens; identical to SEQ ID NO: 68009
  misc_feature 1..500: note = chr1:162792053-162792553
  misc_feature 1..500: note = Hyper
  source 1..500: mol_type = genomic DNA

SEQ ID NO: 103278 - DNA, 30 bp, Homo sapiens; identical to SEQ ID NO: 39140
  misc_feature 1..30: note = chr1:163363352-163363382
  misc_feature 1..30: note = Hypo
  source 1..30: mol_type = genomic DNA

SEQ ID NO: 103279 - DNA, 214 bp, Homo sapiens
  misc_feature 1..214: note = chr1:164290500-164290714
  misc_feature 1..214: note = Hyper
  source 1..214: mol_type = genomic DNA
atgcaaaaaaaactgcgccgtgttcccctctgttgtgtgcgccgcgtccggggagcctgggccgtgcctccctggcgtatgcaggtcgccggcgcagccgccagctccgggggccgcgcttccagccacccgcagccggcggggcccgccgggcagcacgggaatcgcggagcgcggcagctcccctgcgcgccgccgccgccctgctcctggc

SEQ ID NO: 103280 - DNA, 40 bp, Homo sapiens; identical to SEQ ID NO: 68014
  misc_feature 1..40: note = chr1:164637945-164637985
  misc_feature 1..40: note = Hypo
  source 1..40: mol_type = genomic DNA

SEQ ID NO: 103281 - DNA, 30 bp, Homo sapiens; identical to SEQ ID NO: 68015
  misc_feature 1..30: note = chr1:164642633-164642663
  misc_feature 1..30: note = Hypo
  source 1..30: mol_type = genomic DNA

SEQ ID NO: 103282 - DNA, 30 bp, Homo sapiens; identical to SEQ ID NO: 68016
  misc_feature 1..30: note = chr1:164667343-164667373
  misc_feature 1..30: note = Hypo
  source 1..30: mol_type = genomic DNA

SEQ ID NO: 103283 - DNA, 30 bp, Homo sapiens; identical to SEQ ID NO: 68017
  misc_feature 1..30: note = chr1:164708418-164708448
  misc_feature 1..30: note = Hypo
  source 1..30: mol_type = genomic DNA

SEQ ID NO: 103284 - DNA, 67 bp, Homo sapiens; identical to SEQ ID NO: 26690
  misc_feature 1..67: note = chr1:165086960-165087027
  misc_feature 1..67: note = Hyper
  source 1..67: mol_type = genomic DNA

SEQ ID NO: 103285 - DNA, 220 bp, Homo sapiens; identical to SEQ ID NO: 68022
  misc_feature 1..220: note = chr1:165204374-165204594
  misc_feature 1..220: note = Hyper
  source 1..220: mol_type = genomic DNA

SEQ ID NO: 103286 - DNA, 541 bp, Homo sapiens; identical to SEQ ID NO: 68023
  misc_feature 1..541: note = chr1:165204825-165205366
  misc_feature 1..541: note = Hyper
  source 1..541: mol_type = genomic DNA

SEQ ID NO: 103287 - DNA, 276 bp, Homo sapiens
  misc_feature 1..276: note = chr1:165321596-165321872
  misc_feature 1..276: note = Hyper
  source 1..276: mol_type = genomic DNA
cctgaactaggatggcggcacaggttgaaggagagggcttcagttcaggccccaactactgtcctaaaagcccctgcatccgagggttctgcagaaaaccaggaaggcgacagtgaaagggcgaacgggctgtgcgcttagctccgaatggcagcagagccatttccgagcccaaactgtccggactccagcgaacaaacccgagcgggaaacgcgcacagggcacaggggacagaagctgcggggtcaatacagtctcaccgcaaggcacaggcg

SEQ ID NO: 103288 - DNA, 37 bp, Homo sapiens; identical to SEQ ID NO: 68025
  misc_feature 1..37: note = chr1:165322183-165322220
  misc_feature 1..37: note = Hyper
  source 1..37: mol_type = genomic DNA

SEQ ID NO: 103289 - DNA, 30 bp, Homo sapiens; identical to SEQ ID NO: 68026
  misc_feature 1..30: note = chr1:165323443-165323473
  misc_feature 1..30: note = Hyper
  source 1..30: mol_type = genomic DNA

SEQ ID NO: 103290 - DNA, 2815 bp, Homo sapiens
  misc_feature 1..2815: note = chr1:165323676-165326491
  misc_feature 1..2815: note = Hyper
  source 1..2815: mol_type = genomic DNA
ctgtatacataaatccgcacccgctgcccgcccgggtactgcctgctctggcttccgctctcttccgaggctgggcaagtccaaaagttcccgaaaggggggttcaaagaggggcgctcagtgcacgtgatttcgtttcatctagggtgttgggggtggggagattcctcactggatttggtttctccagcagaactgtctcatcctccacattcatgccgctctagcggttccgagtgaaagaggcaagaggtttaaaggacagaaggaaaactccctcctgctaaaaataaataaataaaataaaataaaataaaatacgggcttcccaaacttgaaaagctccaagggcagagtgggtgggggagccgtaaccagaatctctggcttcagctctgcaagacccgtgtgtggacactcttccggggtccttgactcgctgctcctcctctgtcgctgcaaaggagttgtgaggggggacccacaggacccgacatccagctccagttaattaacgcggagcctagggcccagccgcgcggtctaatccccgcgctgcgttgcctactggcccagaaaagtctctctcggccttgcccatggctgaaattggggctggagttggtgggggagagaagcctcctcgaacttgggcgctccaggcctcgggtctcggatgctattgcctctaggccgcgagaagagggcggcatttatgagacgtcgatcagctccgagattaaaaatccagccctgggtatttttaatcacttgccactcagacgcctacgaacaagctcgcccgcccctcgcggctttggggaattcggtgcccagtgcgtgaggcctggggcggcttgttggatttatttgggtagggacgacccacaagcactgacggacagatagtgatggggctcaatttagtgtatgaagaggggcgctagcttccctatcgcggaccaggtcccagagagcggggctccagagctcagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgccccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgcgggacgatggggtttgcaatcccgcgtcccagccgccccgttgcggccctcacctgccccaggtcgagaaggggcactgtaagggacccggagggcgtcccgcccgcttctggactcctggcgctgcgctctgttggggtgcgcgcaggagccggtgtgcggggcgcgcggggaggtcctcccgccagtcggccagtgccgggaatgtctgcagaagcaaaagagtcgcctcggggaggagccccggctggcccggctcactcttggatgcatttcaagtcaactttcagaaacacgcccgcccgagccacagcctaggcacgggcagccttacttacctggtaggcgagctctctcccagtgactggagcagagagaagttgcggagcgctgctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccccgactgggcctttgcggagatgtcggcgcctcctggacagcggtgccgccacgaggattcccccgccgctctccaactgctgctataaaagcgctgcaatccttacccgggccccgggaagcgctgagaagctgtttagcgccagtagatgtgggcccagcagctcctagctcctcaaacccctcatcacccgagggctcatgccagtttccaacttcctttaaggtcgaaccatattcactcatggggcgtacagaggccatgggactcacggcctaagaatcat

SEQ ID NO: 103291 - DNA, 209 bp, Homo sapiens; identical to SEQ ID NO: 26700
  misc_feature 1..209: note = chr1:165345473-165345682
  misc_feature 1..209: note = Hyper
  source 1..209: mol_type = genomic DNA

SEQ ID NO: 103292 - DNA, 331 bp, Homo sapiens
  misc_feature 1..331: note = chr1:165414227-165414558
  misc_feature 1..331: note = Hyper
  source 1..331: mol_type = genomic DNA
aacaagagtggtcatcgcttcctagcagcccggggagcacaggctgggccagccctctgggattagtcaggaatctgcctctagatcggagagtccacatagtgcgtttgagacggctgtggcggcagcagctggtgcctgtcagtaatcacgcataatgctgccgccgccgccgccgccgccgtcaccgctactcttgccaccgccgtcgctgctgcttgagatcctgttgctagtttgattaactcagggttgggctgctgcgtgcgactcttccagctcccggcgcgtccccagaggtccctaccgggtggcacgatctattatctag

SEQ ID NO: 103293 - DNA, 30 bp, Homo sapiens; identical to SEQ ID NO: 68040
  misc_feature 1..30: note = chr1:165550859-165550889
  misc_feature 1..30: note = Hypo
  source 1..30: mol_type = genomic DNA

SEQ ID NO: 103294 - DNA, 30 bp, Homo sapiens; identical to SEQ ID NO: 68041
  misc_feature 1..30: note = chr1:165624524-165624554
  misc_feature 1..30: note = Hypo
  source 1..30: mol_type = genomic DNA

SEQ ID NO: 103295 - DNA, 23 bp, Homo sapiens
  misc_feature 1..23: note = chr1:165664216-165664239
  misc_feature 1..23: note = Hypo
  source 1..23: mol_type = genomic DNA
aaaaaggacgatgagctataaag

SEQ ID NO: 103296 - DNA, 36 bp, Homo sapiens; identical to SEQ ID NO: 39142
  misc_feature 1..36: note = chr1:165809083-165809119
  misc_feature 1..36: note = Hypo
  source 1..36: mol_type = genomic DNA

SEQ ID NO: 103297 - DNA, 30 bp, Homo sapiens; identical to SEQ ID NO: 68044
  misc_feature 1..30: note = chr1:166104124-166104154
  misc_feature 1..30: note = Hypo
  source 1..30: mol_type = genomic DNA

SEQ ID NO: 103298 - DNA, 1420 bp, Homo sapiens
  misc_feature 1..1420: note = chr1:166134166-166135586
  misc_feature 1..1420: note = Hyper
  source 1..1420: mol_type = genomic DNA
ccttttagctattgtcgttgccacctgctcagagtctagttctgaaaggaggcgggtgcggagttatgaaaatttggtaaatataaaagtcccggacgcgaccgcccgtagcctgcggcccctggcggttgaggagccgcggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacggcgccctgaaactcgccaggcactcgccagccatccccacctccgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgc

SEQ ID NO: 103299 - DNA, 19 bp, Homo sapiens
  misc_feature 1..19: note = chr1:166312814-166312833
  misc_feature 1..19: note = Hypo
  source 1..19: mol_type = genomic DNA
agcacgctgtcacctctca

SEQ ID NO: 103300 - DNA, 230 bp, Homo sapiens; identical to SEQ ID NO: 68049
  misc_feature 1..230: note = chr1:166360872-166361102
  misc_feature 1..230: note = Hypo
  source 1..230: mol_type = genomic DNA

SEQ ID NO: 103301 - DNA, 18 bp, Homo sapiens
  misc_feature 1..18: note = chr1:166479382-166479400
  misc_feature 1..18: note = Hypo
  source 1..18: mol_type = genomic DNA
aggcgtgagccaccgcgc

SEQ ID NO: 103302 - DNA, 94 bp, Homo sapiens; identical to SEQ ID NO: 68051
  misc_feature 1..94: note = chr1:166853653-166853747
  misc_feature 1..94: note = Hyper
  source 1..94: mol_type = genomic DNA

SEQ ID NO: 103303 - DNA, 354 bp, Homo sapiens
  misc_feature 1..354: note = chr1:166916746-166917100
  misc_feature 1..354: note = Hyper
  source 1..354: mol_type = genomic DNA
gaacgcaagcctgcacgcctgaatagcggcagctggctttggagaaaaatgggacaactgtctcctgcccggctttcaagagctgccattctttctttccaggggctgagccaatttctcggtgccacccactctcgcgcctgcccccagcccccgtttcctcccccgctcgggccggcgcgggtccacccgactacaatgcagcgcgcggctgacccagctgctccggctcctgcccggggtaaccacggtaaccgcgggccgccaggaatgcgcgctaattgaaggccgagtttcctcccacagtgatgagcaacaagtgaagcaaaaatagtgaggcggaataaaggctgc

SEQ ID NO: 103304 - DNA, 196 bp, Homo sapiens; identical to SEQ ID NO: 26708
  misc_feature 1..196: note = chr1:166945272-166945468
  misc_feature 1..196: note = Hyper
  source 1..196: mol_type = genomic DNA

SEQ ID NO: 103305 - DNA, 30 bp, Homo sapiens; identical to SEQ ID NO: 68056
  misc_feature 1..30: note = chr1:166958831-166958861
  misc_feature 1..30: note = Hypo
  source 1..30: mol_type = genomic DNA

SEQ ID NO: 103306 - DNA, 30 bp, Homo sapiens; identical to SEQ ID NO: 68058
  misc_feature 1..30: note = chr1:167274768-167274798
  misc_feature 1..30: note = Hypo
  source 1..30: mol_type = genomic DNA

SEQ ID NO: 103307 - DNA, 30 bp, Homo sapiens; identical to SEQ ID NO: 68059
  misc_feature 1..30: note = chr1:167340601-167340631
  misc_feature 1..30: note = Hypo
  source 1..30: mol_type = genomic DNA

SEQ ID NO: 103308 - DNA, 30 bp, Homo sapiens; identical to SEQ ID NO: 68061
  misc_feature 1..30: note = chr1:167393583-167393613
  misc_feature 1..30: note = Hypo
  source 1..30: mol_type = genomic DNA

SEQ ID NO: 103309 - DNA, 77 bp, Homo sapiens; identical to SEQ ID NO: 68062
  misc_feature 1..77: note = chr1:167505794-167505871
  misc_feature 1..77: note = Hypo
  source 1..77: mol_type = genomic DNA

SEQ ID NO: 103310 - DNA, 30 bp, Homo sapiens; identical to SEQ ID NO: 68063
  misc_feature 1..30: note = chr1:167525159-167525189
  misc_feature 1..30: note = Hypo
  source 1..30: mol_type = genomic DNA

SEQ ID NO: 103311 - DNA, 769 bp, Homo sapiens; identical to SEQ ID NO: 68064
  misc_feature 1..769: note = chr1:167599108-167599877
  misc_feature 1..769: note = Hyper
  source 1..769: mol_type = genomic DNA

SEQ ID NO: 103312 - DNA, 30 bp, Homo sapiens; identical to SEQ ID NO: 68065
  misc_feature 1..30: note = chr1:167608107-167608137
  misc_feature 1..30: note = Hypo
  source 1..30: mol_type = genomic DNA

SEQ ID NO: 103313 - DNA, 38 bp, Homo sapiens; identical to SEQ ID NO: 39144
  misc_feature 1..38: note = chr1:167789113-167789151
  misc_feature 1..38: note = Hypo
  source 1..38: mol_type = genomic DNA

SEQ ID NO: 103314 - DNA, 98 bp, Homo sapiens; identical to SEQ ID NO: 68067
  misc_feature 1..98: note = chr1:167823344-167823442
  misc_feature 1..98: note = Hypo
  source 1..98: mol_type = genomic DNA

SEQ ID NO: 103315 - DNA, 16 bp, Homo sapiens
  misc_feature 1..16: note = chr1:168004664-168004680
  misc_feature 1..16: note = Hypo
  source 1..16: mol_type = genomic DNA
acggagtgagactctg

SEQ ID NO: 103316 - DNA, 30 bp, Homo sapiens; identical to SEQ ID NO: 39146
  misc_feature 1..30: note = chr1:168058977-168059007
  misc_feature 1..30: note = Hypo
  source 1..30: mol_type = genomic DNA

SEQ ID NO: 103317 - DNA, 34 bp, Homo sapiens; identical to SEQ ID NO: 68070
  misc_feature 1..34: note = chr1:168116121-168116155
  misc_feature 1..34: note = Hypo
  source 1..34: mol_type = genomic DNA

SEQ ID NO: 103318 - DNA, 77 bp, Homo sapiens; identical to SEQ ID NO: 68071
  misc_feature 1..77: note = chr1:168150740-168150817
  misc_feature 1..77: note = Hypo
  source 1..77: mol_type = genomic DNA

SEQ ID NO: 103319 - DNA, 43 bp, Homo sapiens; identical to SEQ ID NO: 68072
  misc_feature 1..43: note = chr1:168151281-168151324
  misc_feature 1..43: note = Hypo
  source 1..43: mol_type = genomic DNA

SEQ ID NO: 103320 - DNA, 637 bp, Homo sapiens
  misc_feature 1..637: note = chr1:169396286-169396923
  misc_feature 1..637: note = Hyper
  source 1..637: mol_type = genomic DNA
taagctactctcagacgagtatccttcatacatagtgaagaaaggtgttaccagacttccccaccagtgccagactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctccgcggcagccaggaccacactgccatggcaacagcgtgcctctgcgtcctccatccgggcctctctaactacgagagcgacaaaaatctgcgcaggcgcatgcaatatcctcagaccaccgacccctcccggcacccatcccggtgcttgcgaagggccagtgaagctgaggtttctaaggggacgactaaggaatccacgcatcactaacgttatagagactcgcgaagtgccgctgtgttggttgtgaaatttccctcttgtagctgtctctcgtcagatttagaat

SEQ ID NO: 103321 - DNA, 26 bp, Homo sapiens
  misc_feature 1..26: note = chr1:169457163-169457189
  misc_feature 1..26: note = Hypo
  source 1..26: mol_type = genomic DNA
agagcgagactcgcgagtactcgtct

SEQ ID NO: 103322 - DNA, 39 bp, Homo sapiens; identical to SEQ ID NO: 68080
  misc_feature 1..39: note = chr1:170629373-170629412
  misc_feature 1..39: note = Hyper
  source 1..39: mol_type = genomic DNA

SEQ ID NO: 103323 - DNA, 63 bp, Homo sapiens
  misc_feature 1..63: note = chr1:170629999-170630062
  misc_feature 1..63: note = Hyper
  source 1..63: mol_type = genomic DNA
tggttgatattaacacgaatgacaagtgggtgattttcaagaagcgcccggtccctctagaga

SEQ ID NO: 103324 - DNA, 1304 bp, Homo sapiens
  misc_feature 1..1304: note = chr1:170630336-170631640
  misc_feature 1..1304: note = Hyper
  source 1..1304: mol_type = genomic DNA
acagcaacgttaaaacgcaactgtgtaaatgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatcccgacggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccgagaggaggggggagtgggtggactaatgatgaaaaagtctcctccatcccagttccttaattaaatgcatggaaagaaccgaggcgagcacatctggtttcaatctacagccctttgatggcatcaaatgttcttttcccagatcagggctggaagttctgggctaactatggccgtttggagcccagaaaccatttacacacactcgtacccttctttctctccagtcgagcctcttgactataggacgaaaaaaaaaaaaagtctagcaatcaagggagtgcgggagtacggatgcgtgtgtgtgtgtgtgagtgcgcgtttaaagaacataaaacgccacaaataagcacttaatattttactgagtcgtcatacagtaactcatttctaatgagactgttaaagctgttaccaaattccaacaggtcatgaaaaaactgctcagcacctctctgtcttctgtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaaagattataatatatatttggagtcctttcttccagtttaataaacacgtacttttctcatt

SEQ ID NO: 103325 - DNA, 33 bp, Homo sapiens; identical to SEQ ID NO: 26717
  misc_feature 1..33: note = chr1:170633073-170633106
  misc_feature 1..33: note = Hyper
  source 1..33: mol_type = genomic DNA

SEQ ID NO: 103326 - DNA, 256 bp, Homo sapiens; identical to SEQ ID NO: 68084
  misc_feature 1..256: note = chr1:170633381-170633637
  misc_feature 1..256: note = Hyper
  source 1..256: mol_type = genomic DNA

SEQ ID NO: 103327 - DNA, 391 bp, Homo sapiens; identical to SEQ ID NO: 68085
  misc_feature 1..391: note = chr1:170633892-170634283
  misc_feature 1..391: note = Hyper
  source 1..391: mol_type = genomic DNA

SEQ ID NO: 103328 - DNA, 168 bp, Homo sapiens; identical to SEQ ID NO: 68086
  misc_feature 1..168: note = chr1:170637642-170637810
  misc_feature 1..168: note = Hyper
  source 1..168: mol_type = genomic DNA

SEQ ID NO: 103329 - DNA, 586 bp, Homo sapiens
  misc_feature 1..586: note = chr1:170640121-170640707
  misc_feature 1..586: note = Hyper
  source 1..586: mol_type = genomic DNA
agaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaagtgattggaaactttcttaacgggcagagagagaatacacggaaactcggatgcagtaataaagttgacataggagtcggaacagggggctctttttggatctcacctttactggggcttgaggttgtggaatgggtggaagagtaattaactgaatgaagaattttaacgttgaaaacagagcccacagtatttttggttatagtggtgtggtctctgcctcggcaaagaaacaaacacccccaccccatcttcgcagttctcctctctgctgtagcgacgccaggcgctgctttccgccgggtaaattagcggcgagcctcgccagacgctttcctccttgccttctttcgccgaaagggggcgcgctcctcccaggctgcgctggtacctatcc

SEQ ID NO: 103330 - DNA, 120 bp, Homo sapiens; identical to SEQ ID NO: 68089
  misc_feature 1..120: note = chr1:171452989-171453109
  misc_feature 1..120: note = Hypo
  source 1..120: mol_type = genomic DNA

SEQ ID NO: 103331 - DNA, 56 bp, Homo sapiens; identical to SEQ ID NO: 68090
  misc_feature 1..56: note = chr1:171555005-171555061
  misc_feature 1..56: note = Hypo
  source 1..56: mol_type = genomic DNA

SEQ ID NO: 103332 - DNA, 37 bp, Homo sapiens; identical to SEQ ID NO: 68091
  misc_feature 1..37: note = chr1:171625525-171625562
  misc_feature 1..37: note = Hypo
  source 1..37: mol_type = genomic DNA

SEQ ID NO: 103333 - DNA, 30 bp, Homo sapiens; identical to SEQ ID NO: 68092
  misc_feature 1..30: note = chr1:171707361-171707391
  misc_feature 1..30: note = Hypo
  source 1..30: mol_type = genomic DNA

SEQ ID NO: 103334 - DNA, 111 bp, Homo sapiens; identical to SEQ ID NO: 68093
  misc_feature 1..111: note = chr1:171731284-171731395
  misc_feature 1..111: note = Hypo
  source 1..111: mol_type = genomic DNA

SEQ ID NO: 103335 - DNA, 1443 bp, Homo sapiens
  misc_feature 1..1443: note = chr1:171810200-171811643
  misc_feature 1..1443: note = Hyper
  source 1..1443: mol_type = genomic DNA
cctgggaggagtcatcgcggattctggagaagggcgtgacagaggagatttcctttcgggaagtgtagtctggcagcggtgccccggtggtggcggcggcggtgctgctgttgctggtgatcgtgtggtggtgttagcggcgatagtgctttccactgggctttggcttggtagccgctgaaagagaacaacgctgccgctgctgctgatttcatgccatttcctgacccggcgctgtaacttggcctctgagccttggccacagaacgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtgcgcgccagccccgggcagcctccctgcgtagcgcgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtgaagctttatccagagacgcttccccaccattctcctcccggagagtcgaagaataaaaggtggtgtgtttgcgtgtgcacctattc

SEQ ID NO: 103336 - DNA, 30 bp, Homo sapiens; identical to SEQ ID NO: 68097
  misc_feature 1..30: note = chr1:172815503-172815533
  misc_feature 1..30: note = Hypo
  source 1..30: mol_type = genomic DNA

SEQ ID NO: 103337 - DNA, 17 bp, Homo sapiens
  misc_feature 1..17: note = chr1:172902655-172902672
  misc_feature 1..17: note = Hypo
  source 1..17: mol_type = genomic DNA
atagcagacttgggccg

SEQ ID NO: 103338 - DNA, 16 bp, Homo sapiens
  misc_feature 1..16: note = chr1:172943420-172943436
  misc_feature 1..16: note = Hypo
  source 1..16: mol_type = genomic DNA
ccgtctcaaaaaacta

SEQ ID NO: 103339 - DNA, 30 bp, Homo sapiens; identical to SEQ ID NO: 39153
  misc_feature 1..30: note = chr1:173090762-173090792
  misc_feature 1..30: note = Hypo
  source 1..30: mol_type = genomic DNA

SEQ ID NO: 103340 - DNA, 61 bp, Homo sapiens; identical to SEQ ID NO: 39154
  misc_feature 1..61: note = chr1:173477004-173477065
  misc_feature 1..61: note = Hypo
  source 1..61: mol_type = genomic DNA

SEQ ID NO: 103341 - DNA, 411 bp, Homo sapiens; identical to SEQ ID NO: 26726
  misc_feature 1..411: note = chr1:173638647-173639058
  misc_feature 1..411: note = Hyper
  source 1..411: mol_type = genomic DNA

SEQ ID NO: 103342 - DNA, 146 bp, Homo sapiens; identical to SEQ ID NO: 68103
  misc_feature 1..146: note = chr1:173794930-173795076
  misc_feature 1..146: note = Hypo
  source 1..146: mol_type = genomic DNA

SEQ ID NO: 103343 - DNA, 82 bp, Homo sapiens; identical to SEQ ID NO: 68104
  misc_feature 1..82: note = chr1:173897008-173897090
  misc_feature 1..82: note = Hypo
  source 1..82: mol_type = genomic DNA

SEQ ID NO: 103344 - DNA, 21 bp, Homo sapiens
  misc_feature 1..21: note = chr1:173897630-173897651
  misc_feature 1..21: note = Hypo
  source 1..21: mol_type = genomic DNA
aagctccgtctcgaggaaaaa

SEQ ID NO: 103345 - DNA, 84 bp, Homo sapiens; identical to SEQ ID NO: 68106
  misc_feature 1..84: note = chr1:173993036-173993120
  misc_feature 1..84: note = Hypo
  source 1..84: mol_type = genomic DNA

SEQ ID NO: 103346 - DNA, 30 bp, Homo sapiens; identical to SEQ ID NO: 39158
  misc_feature 1..30: note = chr1:174421982-174422012
  misc_feature 1..30: note = Hypo
  source 1..30: mol_type = genomic DNA

SEQ ID NO: 103347 - DNA, 38 bp, Homo sapiens; identical to SEQ ID NO: 68111
  misc_feature 1..38: note = chr1:174956311-174956349
  misc_feature 1..38: note = Hypo
  source 1..38: mol_type = genomic DNA

SEQ ID NO: 103348 - DNA, 47 bp, Homo sapiens; identical to SEQ ID NO: 68113
  misc_feature 1..47: note = chr1:175048461-175048508
  misc_feature 1..47: note = Hypo
  source 1..47: mol_type = genomic DNA

SEQ ID NO: 103349 - DNA, 89 bp, Homo sapiens; identical to SEQ ID NO: 68114
  misc_feature 1..89: note = chr1:175346485-175346574
  misc_feature 1..89: note = Hypo
  source 1..89: mol_type = genomic DNA

SEQ ID NO: 103350 - DNA, 504 bp, Homo sapiens; identical to SEQ ID NO: 68115
  misc_feature 1..504: note = chr1:175354872-175355376
  misc_feature 1..504: note = Hypo
  source 1..504: mol_type = genomic DNA

SEQ ID NO: 103351 - DNA, 347 bp, Homo sapiens; identical to SEQ ID NO: 68116
  misc_feature 1..347: note = chr1:175365589-175365936
  misc_feature 1..347: note = Hypo
  source 1..347: mol_type = genomic DNA

SEQ ID NO: 103352 - DNA, 78 bp, Homo sapiens; identical to SEQ ID NO: 14308
  misc_feature 1..78: note = chr1:175372494-175372572
  misc_feature 1..78: note = Hypo
  source 1..78: mol_type = genomic DNA

SEQ ID NO: 103353 - DNA, 246 bp, Homo sapiens; identical to SEQ ID NO: 68118
  misc_feature 1..246: note = chr1:175375200-175375446
  misc_feature 1..246: note = Hypo
  source 1..246: mol_type = genomic DNA

SEQ ID NO: 103354 - DNA, 18 bp, Homo sapiens
  misc_feature 1..18: note = chr1:175388664-175388682
  misc_feature 1..18: note = Hypo
  source 1..18: mol_type = genomic DNA
aattcctctgtggcacga

SEQ ID NO: 103355 - DNA, 30 bp, Homo sapiens; identical to SEQ ID NO: 68120
  misc_feature 1..30: note = chr1:175415084-175415114
  misc_feature 1..30: note = Hypo
  source 1..30: mol_type = genomic DNA

SEQ ID NO: 103356 - DNA, 30 bp, Homo sapiens; identical to SEQ ID NO: 68121
  misc_feature 1..30: note = chr1:175421411-175421441
  misc_feature 1..30: note = Hypo
  source 1..30: mol_type = genomic DNA

SEQ ID NO: 103357 - DNA, 30 bp, Homo sapiens; identical to SEQ ID NO: 68122
  misc_feature 1..30: note = chr1:175463981-175464011
  misc_feature 1..30: note = Hypo
  source 1..30: mol_type = genomic DNA

SEQ ID NO: 103358 - DNA, 152 bp, Homo sapiens; identical to SEQ ID NO: 68123
  misc_feature 1..152: note = chr1:175472199-175472351
  misc_feature 1..152: note = Hypo
  source 1..152: mol_type = genomic DNA

SEQ ID NO: 103359 - DNA, 35 bp, Homo sapiens; identical to SEQ ID NO: 68124
  misc_feature 1..35: note = chr1:175861012-175861047
  misc_feature 1..35: note = Hypo
  source 1..35: mol_type = genomic DNA

SEQ ID NO: 103360 - DNA, 20 bp, Homo sapiens
  misc_feature 1..20: note = chr1:176318951-176318971
  misc_feature 1..20: note = Hypo
  source 1..20: mol_type = genomic DNA
cagcacgctgtcacctctca

SEQ ID NO: 103361 - DNA, 104 bp, Homo sapiens; identical to SEQ ID NO: 68126
  misc_feature 1..104: note = chr1:176694805-176694909
  misc_feature 1..104: note = Hypo
  source 1..104: mol_type = genomic DNA

SEQ ID NO: 103362 - DNA, 718 bp, Homo sapiens
  misc_feature 1..718: note = chr1:177133445-177134163
  misc_feature 1..718: note = Hyper
  source 1..718: mol_type = genomic DNA
agtgggtgtgtagagcgagctggagtggggggtgggggcgccggtccagcgcctccggccgcctcgacctcccccgggactcacccagcacgaagtagggcagctccgtgttctccaggtcgtccaccacgaccatttctcccgggaagtcgttgcgcaccgagaagaggagcttgggctccgaggccgaggggctgtgcatgatgctcaggtcgttctcgcgcaggaagggcagtgccgacaccgtgatgcttttgagcttgcactccagctccttggatggatccacgtcgccggcggccgtggccagcaccgccgccggcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggagaggagaaaaagggaaggaaggacgtcgaaaggaaagaggaagggagctgaggattctagggaatcaggtcagcccccagctggctgccggtgctcctgcctc

SEQ ID NO: 103363 - DNA, 589 bp, Homo sapiens
  misc_feature 1..589: note = chr1:177140105-177140694
  misc_feature 1..589: note = Hyper
  source 1..589: mol_type = genomic DNA
gacactgcttaggtacggagcgcggagtcggagcggggacgcgccgggctgcagctctgggatgcaatccgcctgcctcgcaagctgctcgccgctgcgctggcagcgcttacgctgagctcggaggatcccattaggacttgcccggggatgtgcacctgccgtgcgctccgaggtcagtggcaggtctgcaggcagccgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacacgctgagggggaggc

SEQ ID NO: 103364 - DNA, 481 bp, Homo sapiens; identical to SEQ ID NO: 26732
  misc_feature 1..481: note = chr1:177150773-177151254
  misc_feature 1..481: note = Hyper
  source 1..481: mol_type = genomic DNA

SEQ ID NO: 103365 - DNA, 46 bp, Homo sapiens; identical to SEQ ID NO: 68138
  misc_feature 1..46: note = chr1:178006897-178006943
  misc_feature 1..46: note = Hyper
  source 1..46: mol_type = genomic DNA

SEQ ID NO: 103366 - DNA, 108 bp, Homo sapiens; identical to SEQ ID NO: 68139
  misc_feature 1..108: note = chr1:178063625-178063733
  misc_feature 1..108: note = Hyper
  source 1..108: mol_type = genomic DNA

SEQ ID NO: 103367 - DNA, 45 bp, Homo sapiens; identical to SEQ ID NO: 68140
  misc_feature 1..45: note = chr1:178531753-178531798
  misc_feature 1..45: note = Hypo
  source 1..45: mol_type = genomic DNA

SEQ ID NO: 103368 - DNA, 30 bp, Homo sapiens; identical to SEQ ID NO: 68141
  misc_feature 1..30: note = chr1:178617443-178617473
  misc_feature 1..30: note = Hypo
  source 1..30: mol_type = genomic DNA

SEQ ID NO: 103369 - DNA, 16 bp, Homo sapiens
  misc_feature 1..16: note = chr1:178665797-178665813
  misc_feature 1..16: note = Hypo
  source 1..16: mol_type = genomic DNA
gcgacagagccagact

SEQ ID NO: 103370 - DNA, 30 bp, Homo sapiens; identical to SEQ ID NO: 39167
  misc_feature 1..30: note = chr1:178857986-178858016
  misc_feature 1..30: note = Hypo
  source 1..30: mol_type = genomic DNA

SEQ ID NO: 103371 - DNA, 280 bp, Homo sapiens; identical to SEQ ID NO: 68145
  misc_feature 1..280: note = chr1:178994064-178994344
  misc_feature 1..280: note = Hypo
  source 1..280: mol_type = genomic DNA

SEQ ID NO: 103372 - DNA, 30 bp, Homo sapiens; identical to SEQ ID NO: 68146
  misc_feature 1..30: note = chr1:179050657-179050687
  misc_feature 1..30: note = Hyper
  source 1..30: mol_type = genomic DNA

SEQ ID NO: 103373 - DNA, 36 bp, Homo sapiens; identical to SEQ ID NO: 68147
  misc_feature 1..36: note = chr1:179262288-179262324
  misc_feature 1..36: note = Hypo
  source 1..36: mol_type = genomic DNA

SEQ ID NO: 103374 - DNA, 26 bp, Homo sapiens
  misc_feature 1..26: note = chr1:179333328-179333354
  misc_feature 1..26: note = Hypo
  source 1..26: mol_type = genomic DNA
tcatgcctgtaatcccggcactttgg

SEQ ID NO: 103375 - DNA, 588 bp, Homo sapiens
  misc_feature 1..588: note = chr1:179544716-179545304
  misc_feature 1..588: note = Hyper
  source 1..588: mol_type = genomic DNA
aatccgtaccttcctcgggccgctcgctctccaacagcgccaccacctcggtgccctcctcgccggagcctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggcgtgcccgggggaccctaaagaccgtcgggtgggggctgagggcgaggggcgggacaccggggccgcgggcggggcgcacccggaaccccgacagctgtgtcttggtggagctgtggactgcgcccgccgactcccacggccggggcggcgctgaagcagagagaggcctgggtgggagagccggccccgggcagggtgcgggcgttgaaaagt

SEQ ID NO: 103376 - DNA, 29 bp, Homo sapiens
  misc_feature 1..29: note = chr1:179704902-179704931
  misc_feature 1..29: note = Hypo
  source 1..29: mol_type = genomic DNA
gctgggataacaggcgtgagccaccgccc

SEQ ID NO: 103377 - DNA, 1568 bp, Homo sapiens
  misc_feature 1..1568: note = chr1:179711932-179713500
  misc_feature 1..1568: note = Hyper
  source 1..1568: mol_type = genomic DNA
tgactgatctgatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaagtcccctgtactgaggcgttcccagggcgcccgcctcccgcgtttacatttcttaggcaaaaaggcagcggagctaagcaggggtgtttggaaggcgcccgttgcgctgtttgactgcgtggcttcacttggcccgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcggtaacgggtcggggcctcatcgtgcaggggagcgagcggaggggcggggcggggcgcgggcgggctgaggagccgccgggctcgggctccgcgcggggatgtgtctggccaccgcgtactttcgagggcgcctcaacacccgggtaagcgcgccccggctgcctccctctgcccaccgcgccgccttcagcgtagcagttccccactgggtctgggtctgcgccctggctctccctctccgcgccaggggcctctcgctccgaggggcgcggcgactcgggggcatctccggcctcgtggccagaccgcgggtggcggtgctcgcgcctcggggccggacttgccgggtccctgcccccgggccgtgccgaaggcgctctactcagcgtgtctgcagcgacccgcttctctgcgctttcagccgggccggacctcacgcggacgccgctgctgctgctgcgcctcgcgcccgccgccacccggggagcatgaggccggggcaggggacccgggtagggtgggggccgaccggcggggtctgctgggccaatgcgccgccgtcggtcagtgagtccggattcgtgccggcaactgtgggcagccttgagaccggggctcggtttgctggtgatttttccgaagttttacaaaataaagagggcgaagtgccttcgcggcgcggcgtgggcatgcaggcggcagggcctgtgggagccggcgtctcggccagcgagtctggggccaggacagcgggggtaggacggagaagccggacgtgcccgtggggccgcggtgtccttgctcccgaggccccagagcgggcgaccgcactccgattccagagggccctgcgcgctcaaggcgccggccacacggaagcctccgccccgcggcccagaggggggcctggccaagcagagagcagagcgggcaagcagaagg

SEQ ID NO: 103378 - DNA, 209 bp, Homo sapiens; identical to SEQ ID NO: 68157
  misc_feature 1..209: note = chr1:179743860-179744069
  misc_feature 1..209: note = Hypo
  source 1..209: mol_type = genomic DNA

SEQ ID NO: 103379 - DNA, 188 bp, Homo sapiens; identical to SEQ ID NO: 68158
  misc_feature 1..188: note = chr1:179781711-179781899
  misc_feature 1..188: note = Hypo
  source 1..188: mol_type = genomic DNA

SEQ ID NO: 103380 - DNA, 30 bp, Homo sapiens; identical to SEQ ID NO: 14309
  misc_feature 1..30: note = chr1:179849955-179849985
  misc_feature 1..30: note = Hypo
  source 1..30: mol_type = genomic DNA

SEQ ID NO: 103381 - DNA, 30 bp, Homo sapiens; identical to SEQ ID NO: 39172
  misc_feature 1..30: note = chr1:180096076-180096106
  misc_feature 1..30: note = Hypo
  source 1..30: mol_type = genomic DNA

SEQ ID NO: 103382 - DNA, 30 bp, Homo sapiens; identical to SEQ ID NO: 39173
  misc_feature 1..30: note = chr1:180137119-180137149
  misc_feature 1..30: note = Hypo
  source 1..30: mol_type = genomic DNA

SEQ ID NO: 103383 - DNA, 616 bp, Homo sapiens; identical to SEQ ID NO: 68162
  misc_feature 1..616: note = chr1:180198061-180198677
  misc_feature 1..616: note = Hyper
  source 1..616: mol_type = genomic DNA

SEQ ID NO: 103384 - DNA, 44 bp, Homo sapiens; identical to SEQ ID NO: 68163
  misc_feature 1..44: note = chr1:180201524-180201568
  misc_feature 1..44: note = Hyper
  source 1..44: mol_type = genomic DNA

SEQ ID NO: 103385 - DNA, 1057 bp, Homo sapiens
  misc_feature 1..1057: note = chr1:180202237-180203294
  misc_feature 1..1057: note = Hyper
  source 1..1057: mol_type = genomic DNA
aaatccagcttatttcggcggcagctggactattcctttgcttatttggggatgggtgaggggcataccctttaggaaaacgtttccaaatgatgtaataatttctctctcatctctggtcttgctccagacttggcctcttcctcgccactctgtcccggcctcccgcccccgcaggctcccgtgcggacttagcagttcgcgccgtagccctcctggttttttaccgcgccttggtcgcgcggcccccggtgcgggcctcgtcgctccgacagccctacagctgtccctacggcccgcaccgacagctcgtccccgccacctccctccgggctgtagggacgtcgagatccgaatcctcacagcgcctgacccggggccgtgttgggtacgggtacggcgagagccttccgagccgcctccaaaactctccccgcggacctcagcagtccctccacgcgtcggggccctgctggccggccatgccctctgaggagacgcggaaaagagcgaggcatataggaaggtggggcgttttatccgcctcggttttgacccatctgccatgtagtctccccaggcaccgagggaaaggacgacggaagcccgccgcccggatcgctggcgggagagagggcagcccgcacgggagaaggaggagccccgcggggtctccgctgggggtggtaattggaatgcaggcctgggggtctctgtccccctccttgtctcctaaaatgcttccggcaagctctggcgaaccccgaagctgtaggaaaaaggtattttattttgtgtttggtagggtcggggtaaaggttttccctgggacttcctctcctggggctcctccggggtgcgtggggtaatgtcccagcgcaggtcgagttgcagatccgagtccccggggttgttgactgtccttcttgcaggacatttcttaagggggtgagatggattcactgtccaagacaggagttcactcaaacgctggtgctgttcgctcttctttccattcctgccttgtctcctagtgcgagaaacagacacacacaac

SEQ ID NO: 103386 - DNA, 2017 bp, Homo sapiens
  misc_feature 1..2017: note = chr1:180203354-180205371
  misc_feature 1..2017: note = Hyper
  source 1..2017: mol_type = genomic DNA
taatagattgagattctatcatattccgaacattccgatatagcagctgtaggcaccatagacctccctccctgcgtcgcgagaatatattctcaggcaggagacaatttttacagatgaggtcagctgtccccgccggccgattcgggcctgatgggttgggggttccgatgtcctaactgctaggatcccgttccagcccctggccagagctgtgtaccacaaagaagggagtttggagaaacccgggtaagcgcggcagcgccccgcttgggacagcggatggctgaggactcccaaggggcgagagggctccggcctcctcctttccagggccttgttatctgagagggccgttagcacggagggaagcttggaaagccgctgtcccagtgcgctccgcatgcggaattaactgttaaagccggacacggagcacgcaggtgcagcaggtgaggggcaaaggtctgcattgagcagtccgcagtgtcccgggaagtcgtaaagtcgggactgagaagaagcaggacctaactcaagtttatttcctctcttggccgaggtccgggctcgtggaaaaccagagctaggcggggctacgcagggctgagcaggagtggcgtcctagggtctgggagcgcgacccacatgacctcgctacgaccggggcagggctcctccgccccgcgggcagatgccggcctgggtggcccggggaacagacgatgaattctttaaatgagcgtttgctgcgcacccatgggcggctcacgatcctgggcactcgcccgggaatcccgggcgtgctctgggttttgggggactcgccggtggaggtagatgtggacagggcggccggcccttcgcgggtagccggctttgcgcttactgcgtcccgcagcggtgggtaaaggtcgtagcccagaaggggacaagggagggaccgcctctctctccccggtgcgctgcaatagaggttcctgcgccttggcccttgcagtccatccgcccagaggttcgcgcccgttttcggagcttattatctcaggtagcccagaggtccgactgagctggaattagccaggcctgggacccctttgctgccctttagagtggtggcagggacttttccagcaaggataggcgcggcaggcgcgagtgcggacggcgcgcccattaggaggaggccgggtgaaaacctctcttcctctccagacccatttcgttccaagcatttggaatgacaaaattaaaccccaaccctggcggctcgagtctaatgtgactgtttaaccctgggaaagcgatgctcccattttcgaaggggctcctcctcttcggagcggggaggccgccggcgggtgtgcccggcccgcgcgttctgcgggtgttcgagcctcggctccccactcggttccgcagcttagtggaccttgacgagcgctggaaacgtgtcaggctccagagagacagagtctctacctaggcggctgaggatgtcaattaaaatcgaccagggaagggagttggcggcactgtgcgccgccggggaaggcgaggtggcgcgggccaccgggtgcactcaccgcacgagaggccgcggctggactgggaccgagcgcatccctgtgtctcagggggtttgctttgtgcaggatgggaccttattatttttagacagtggggcaaacgtgtcttttaaagagatccgaagggtgaaactaatgaaaaaggaaatgaattactagaaaagccgtgaagggataaaaccgggagcagcaggaagttgaaggaaggacgaccgaagctaggtgtatctgcacctgcctcttgacacgccaaaaacaaaggggggttaaggcaagaatgtagactaaatgctgtgaggattagggtaacgcgagccctcaagacgtctcggagaccgcctacagggctgcaaataccagggtccatttttaaaaatcgagtgctcctagaggtggggtgggggtgggagagccgggaaaccagcaaa

SEQ ID NO: 103387 - DNA, 60 bp, Homo sapiens; identical to SEQ ID NO: 26748
  misc_feature 1..60: note = chr1:180206312-180206372
  misc_feature 1..60: note = Hyper
  source 1..60: mol_type = genomic DNA

SEQ ID NO: 103388 - DNA, 264 bp, Homo sapiens; identical to SEQ ID NO: 68171
  misc_feature 1..264: note = chr1:180235531-180235795
  misc_feature 1..264: note = Hypo
  source 1..264: mol_type = genomic DNA

SEQ ID NO: 103389 - DNA, 239 bp, Homo sapiens; identical to SEQ ID NO: 68173
  misc_feature 1..239: note = chr1:180881341-180881580
  misc_feature 1..239: note = Hyper
  source 1..239: mol_type = genomic DNA

SEQ ID NO: 103390 - DNA, 428 bp, Homo sapiens; identical to SEQ ID NO: 26750
  misc_feature 1..428: note = chr1:180882004-180882432
  misc_feature 1..428: note = Hyper
  source 1..428: mol_type = genomic DNA

SEQ ID NO: 103391 - DNA, 30 bp, Homo sapiens; identical to SEQ ID NO: 68175
  misc_feature 1..30: note = chr1:180885601-180885631
  misc_feature 1..30: note = Hypo
  source 1..30: mol_type = genomic DNA

SEQ ID NO: 103392 - DNA, 32 bp, Homo sapiens; identical to SEQ ID NO: 68176
  misc_feature 1..32: note = chr1:180891177-180891209
  misc_feature 1..32: note = Hypo
  source 1..32: mol_type = genomic DNA

SEQ ID NO: 103393 - DNA, 30 bp, Homo sapiens; identical to SEQ ID NO: 68177
  misc_feature 1..30: note = chr1:180896448-180896478
  misc_feature 1..30: note = Hypo
  source 1..30: mol_type = genomic DNA

SEQ ID NO: 103394 - DNA, 30 bp, Homo sapiens; identical to SEQ ID NO: 39175
  misc_feature 1..30: note = chr1:180910386-180910416
  misc_feature 1..30: note = Hypo
  source 1..30: mol_type = genomic DNA

SEQ ID NO: 103395 - DNA, 99 bp, Homo sapiens; identical to SEQ ID NO: 39176
  misc_feature 1..99: note = chr1:180925089-180925188
  misc_feature 1..99: note = Hypo
  source 1..99: mol_type = genomic DNA

SEQ ID NO: 103396 - DNA, 30 bp, Homo sapiens; identical to SEQ ID NO: 68180
  misc_feature 1..30: note = chr1:180925404-180925434
  misc_feature 1..30: note = Hypo
  source 1..30: mol_type = genomic DNA

SEQ ID NO: 103397 - DNA, 22 bp, Homo sapiens
  misc_feature 1..22: note = chr1:181013386-181013408
  misc_feature 1..22: note = Hypo
  source 1..22: mol_type = genomic DNA
ctgcgcccggcctgatcttttt

SEQ ID NO: 103398 - DNA, 47 bp, Homo sapiens; identical to SEQ ID NO: 68182
  misc_feature 1..47: note = chr1:181286584-181286631
  misc_feature 1..47: note = Hyper
  source 1..47: mol_type = genomic DNA

SEQ ID NO: 103399 - DNA, 149 bp, Homo sapiens; identical to SEQ ID NO: 68183
  misc_feature 1..149: note = chr1:181286935-181287084
  misc_feature 1..149: note = Hyper
  source 1..149: mol_type = genomic DNA

SEQ ID NO: 103400 - DNA, 897 bp, Homo sapiens; identical to SEQ ID NO: 68184
  misc_feature 1..897: note = chr1:181287305-181288202
  misc_feature 1..897: note = Hyper
  source 1..897: mol_type = genomic DNA

SEQ ID NO: 103401 - DNA, 179 bp, Homo sapiens; identical to SEQ ID NO: 68185
  misc_feature 1..179: note = chr1:181381915-181382094
  misc_feature 1..179: note = Hypo
  source 1..179: mol_type = genomic DNA

SEQ ID NO: 103402 - DNA, 1063 bp, Homo sapiens; identical to SEQ ID NO: 68186
  misc_feature 1..1063: note = chr1:181451296-181452359
  misc_feature 1..1063: note = Hyper
  source 1..1063: mol_type = genomic DNA

SEQ ID NO: 103403 - DNA, 419 bp, Homo sapiens
  misc_feature 1..419: note = chr1:181452691-181453110
  misc_feature 1..419: note = Hyper
  source 1..419: mol_type = genomic DNA
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacat

SEQ ID NO: 103404 - DNA, 736 bp, Homo sapiens; identical to SEQ ID NO: 68189
  misc_feature 1..736: note = chr1:181454613-181455349
  misc_feature 1..736: note = Hyper
  source 1..736: mol_type = genomic DNA

SEQ ID NO: 103405 - DNA, 312 bp, Homo sapiens; identical to SEQ ID NO: 68191
  misc_feature 1..312: note = chr1:181701511-181701823
  misc_feature 1..312: note = Hypo
  source 1..312: mol_type = genomic DNA

SEQ ID NO: 103406 - DNA, 44 bp, Homo sapiens; identical to SEQ ID NO: 68192
  misc_feature 1..44: note = chr1:181727256-181727300
  misc_feature 1..44: note = Hypo
  source 1..44: mol_type = genomic DNA

SEQ ID NO: 103407 - DNA, 49 bp, Homo sapiens; identical to SEQ ID NO: 68193
  misc_feature 1..49: note = chr1:181767758-181767807
  misc_feature 1..49: note = Hypo
  source 1..49: mol_type = genomic DNA

SEQ ID NO: 103408 - DNA, 101 bp, Homo sapiens; identical to SEQ ID NO: 68194
  misc_feature 1..101: note = chr1:181922685-181922786
  misc_feature 1..101: note = Hypo
  source 1..101: mol_type = genomic DNA

SEQ ID NO: 103409 - DNA, 238 bp, Homo sapiens; identical to SEQ ID NO: 68195
  misc_feature 1..238: note = chr1:182026109-182026347
  misc_feature 1..238: note = Hyper
  source 1..238: mol_type = genomic DNA

SEQ ID NO: 103410 - DNA, 30 bp, Homo sapiens; identical to SEQ ID NO: 68196
  misc_feature 1..30: note = chr1:182270970-182271000
  misc_feature 1..30: note = Hypo
  source 1..30: mol_type = genomic DNA

SEQ ID NO: 103411 - DNA, 382 bp, Homo sapiens
  misc_feature 1..382: note = chr1:182584162-182584544
  misc_feature 1..382: note = Hyper
  source 1..382: mol_type = genomic DNA
agagcagcaaatatccgcggctcgccgccccgggctctgtggcaccatcagcagcttgcgcaggacacagacgtcggctcacgcgccgcagccctcggccccggaagagccgcggccgcggagcagcgaacgcgtgcctgccagggaaaagcagtcaccaggaacgcggcgttttggtcggctgcccatcgccagccctgtccgcgcgagatgccctgctccgaagctcttgtgagctccgcggcctgcggctccggaaggcgaagctcttccaggaagcagcggcggccccactggccctctcaggctgcggagaaagggcgggaggccgcggggctctccaggactcagtggtttcggagaaactcgacttcccaggctc

SEQ ID NO: 103412 - DNA, 30 bp, Homo sapiens; identical to SEQ ID NO: 68199
  misc_feature 1..30: note = chr1:182650639-182650669
  misc_feature 1..30: note = Hypo
  source 1..30: mol_type = genomic DNA

SEQ ID NO: 103413 - DNA, 63 bp, Homo sapiens; identical to SEQ ID NO: 68200
  misc_feature 1..63: note = chr1:182758405-182758468
  misc_feature 1..63: note = Hyper
  source 1..63: mol_type = genomic DNA

SEQ ID NO: 103414 - DNA, 29 bp, Homo sapiens
  misc_feature 1..29: note = chr1:182807578-182807607
  misc_feature 1..29: note = Hypo
  source 1..29: mol_type = genomic DNA
gccaggcagaatgcccgccttcactgagc

SEQ ID NO: 103415 - DNA, 21 bp, Homo sapiens
  misc_feature 1..21: note = chr1:182815386-182815407
  misc_feature 1..21: note = Hypo
  source 1..21: mol_type = genomic DNA
tttgagatggagtttcgcttt

SEQ ID NO: 103416 - DNA, 30 bp, Homo sapiens; identical to SEQ ID NO: 68203
  misc_feature 1..30: note = chr1:182911546-182911576
  misc_feature 1..30: note = Hyper
  source 1..30: mol_type = genomic DNA

SEQ ID NO: 103417 - DNA, 68 bp, Homo sapiens
  misc_feature 1..68: note = chr1:182922085-182922153
  misc_feature 1..68: note = Hyper
  source 1..68: mol_type = genomic DNA
cgctttccccttcaccgggcgaggggaggccaccaccgaccgcactgggatcgcggtgcccttcaggg

SEQ ID NO: 103418 - DNA, 234 bp, Homo sapiens; identical to SEQ ID NO: 68205
  misc_feature 1..234: note = chr1:183058613-183058847
  misc_feature 1..234: note = Hypo
  source 1..234: mol_type = genomic DNA

SEQ ID NO: 103419 - DNA, 158 bp, Homo sapiens; identical to SEQ ID NO: 39180
  misc_feature 1..158: note = chr1:183129382-183129540
  misc_feature 1..158: note = Hypo
  source 1..158: mol_type = genomic DNA

SEQ ID NO: 103420 - DNA, 30 bp, Homo sapiens; identical to SEQ ID NO: 68207
  misc_feature 1..30: note = chr1:183204607-183204637
  misc_feature 1..30: note = Hypo
  source 1..30: mol_type = genomic DNA

SEQ ID NO: 103421 - DNA, 1797 bp, Homo sapiens
  misc_feature 1..1797: note = chr1:183385871-183387668
  misc_feature 1..1797: note = Hyper
  source 1..1797: mol_type = genomic DNA
gaggtttttaacaagcgagcccagttcagcgcaccttttaagtttaaagatgaatatttttagcctaagccacctcgccctgtctttaccgctgtggtgtggttttcactaaacctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaagccgcgtggcttcccaccggtggcgcgagacctccaataggcatctatcgatcacctttcccctaccgctgctggaccccgaaccagccagccggatgcccccgctcgctctctctgactccacgccccaaagcttctaagaaacaaacgcgcgataagtcccctccccccaacacgcacacgcatatactcacacacagtcattcgcacattcgtacacacactagacgcctcaagccttccgagtgccatcgccaccctgggcagagcctcagccaacttgggccccgatccttcggctccggctcgcgcagggcctcccgcagcctccgcccggccccctccccgtcctaggcagcgggtccctgaggccgaacctaggcggaaaagggccccctccctattcactcagcatccacctcgcgcgggcaatacacggcccacaattcccaaacactggtccctgggccgcccagaatcaccagccaaatccgaaattaatcttgaagccccagcccctgtcaccggtgtgtcgggcgcgagtgtgtttgcgaatcccaggcacatacatgatttaactccttcgagctttcggcccatcctaaacaaacagcacgttatctccagccccttcctcccctactcggcgccccaacctctgcccccatcccggtcttcgccagcctggtagccgaaccaccgcaccgccacactccagttctggtatctcgaacccctgcccagccccaaatgatactcatctctagtcccctcccatcccccacctttggccccctgcgagccgggtctggccccggcaagtgacgcctcggaaacgcagtctgcgtaccctcccctgagtccaaaatgaaggggccgacctccaccagctggatgagccggcccacccctccgaaggggcacacgccttcccgttcgatcgccctggaaaacacaggtgcctgggaaaggagaggagcggaagcggcttccagaggtgggcgggaggactcaccaaacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgtattgctctgctctcttctctcctcggtcgctctcttttcgttctggcttccttcgcatctctcgcctg

SEQ ID NO: 103422 - DNA, 41 bp, Homo sapiens; identical to SEQ ID NO: 68212
  misc_feature 1..41: note = chr1:183462983-183463024
  misc_feature 1..41: note = Hypo
  source 1..41: mol_type = genomic DNA

SEQ ID NO: 103423 - DNA, 331 bp, Homo sapiens; identical to SEQ ID NO: 26763
  misc_feature 1..331: note = chr1:183774098-183774429
  misc_feature 1..331: note = Hyper
  source 1..331: mol_type = genomic DNA

SEQ ID NO: 103424 - DNA, 30 bp, Homo sapiens; identical to SEQ ID NO: 68215
  misc_feature 1..30: note = chr1:183907120-183907150
  misc_feature 1..30: note = Hypo
  source 1..30: mol_type = genomic DNA

SEQ ID NO: 103425 - DNA, 1392 bp, Homo sapiens; identical to SEQ ID NO: 68216
  misc_feature 1..1392: note = chr1:184005438-184006830
  misc_feature 1..1392: note = Hyper
  source 1..1392: mol_type = genomic DNA

SEQ ID NO: 103426 - DNA, 30 bp, Homo sapiens; identical to SEQ ID NO: 68224
  misc_feature 1..30: note = chr1:184442660-184442690
  misc_feature 1..30: note = Hypo
  source 1..30: mol_type = genomic DNA

SEQ ID NO: 103427 - DNA, 25 bp, Homo sapiens
  misc_feature 1..25: note = chr1:184608977-184609002
  misc_feature 1..25: note = Hypo
  source 1..25: mol_type = genomic DNA
acaaaggggcttggccgggcgcagt

SEQ ID NO: 103428 - DNA, 62 bp, Homo sapiens; identical to SEQ ID NO: 68227
  misc_feature 1..62: note = chr1:184633288-184633350
  misc_feature 1..62: note = Hyper
  source 1..62: mol_type = genomic DNA

SEQ ID NO: 103429 - DNA, 23 bp, Homo sapiens
  misc_feature 1..23: note = chr1:184721182-184721205
  misc_feature 1..23: note = Hypo
  source 1..23: mol_type = genomic DNA
ggccaagtcggctttttctaaag

SEQ ID NO: 103430 - DNA, 100 bp, Homo sapiens; identical to SEQ ID NO: 68229
  misc_feature 1..100: note = chr1:184725924-184726024
  misc_feature 1..100: note = Hypo
  source 1..100: mol_type = genomic DNA

SEQ ID NO: 103431 - DNA, 122 bp, Homo sapiens; identical to SEQ ID NO: 68230
  misc_feature 1..122: note = chr1:184764179-184764301
  misc_feature 1..122: note = Hypo
  source 1..122: mol_type = genomic DNA

SEQ ID NO: 103432 - DNA, 120 bp, Homo sapiens; identical to SEQ ID NO: 68231
  misc_feature 1..120: note = chr1:185073818-185073938
  misc_feature 1..120: note = Hypo
  source 1..120: mol_type = genomic DNA

SEQ ID NO: 103433 - DNA, 102 bp, Homo sapiens; identical to SEQ ID NO: 68236
  misc_feature 1..102: note = chr1:186649596-186649698
  misc_feature 1..102: note = Hyper
  source 1..102: mol_type = genomic DNA

SEQ ID NO: 103434 - DNA, 77 bp, Homo sapiens; identical to SEQ ID NO: 68237
  misc_feature 1..77: note = chr1:186649956-186650033
  misc_feature 1..77: note = Hyper
  source 1..77: mol_type = genomic DNA

SEQ ID NO: 103435 - DNA, 40 bp, Homo sapiens; identical to SEQ ID NO: 68238
  misc_feature 1..40: note = chr1:186797074-186797114
  misc_feature 1..40: note = Hypo
  source 1..40: mol_type = genomic DNA

SEQ ID NO: 103436 - DNA, 30 bp, Homo sapiens; identical to SEQ ID NO: 68240
  misc_feature 1..30: note = chr1:187043706-187043736
  misc_feature 1..30: note = Hypo
  source 1..30: mol_type = genomic DNA

SEQ ID NO: 103437 - DNA, 22 bp, Homo sapiens
  misc_feature 1..22: note = chr1:187755700-187755722
  misc_feature 1..22: note = Hypo
  source 1..22: mol_type = genomic DNA
ccgctcccggccatcaataatt

SEQ ID NO: 103438 - DNA, 561 bp, Homo sapiens; identical to SEQ ID NO: 68272
  misc_feature 1..561: note = chr1:190444251-190444812
  misc_feature 1..561: note = Hyper
  source 1..561: mol_type = genomic DNA

SEQ ID NO: 103439 - DNA, 516 bp, Homo sapiens
  misc_feature 1..516: note = chr1:190445138-190445654
  misc_feature 1..516: note = Hyper
  source 1..516: mol_type = genomic DNA
ctagtgacctagtgacgggtgaggggcgccaagtggtgcggaccacagtctcaacccccgttccctctcggtgggagtcaagggggaaaagcccttgaatcccgagacggggggatggggcgacgctgcagctggagtacttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtga

SEQ ID NO: 103440 - DNA, 641 bp, Homo sapiens
  misc_feature 1..641: note = chr1:190447121-190447762
  misc_feature 1..641: note = Hyper
  source 1..641: mol_type = genomic DNA
tttaagagttacctgcgttgggaccattatcattaggattaatagtattccatcagtgcatttcactagtatttcccttgaacattttcacttgcagcaactgagggaggcgtagtaaggaagcccaacacaaccaattcccccactccccaaataaaccactacgaccggtcacattacgatgaccaaatcatcagcgatttgcacgaggcggtggggggtggggggtgcgggcggtgatcgaagggctgaagatgcggaggaggccgagtcgctaggcgctttcgggggcgctgtgccggtgaggcttaggcaaggggacggggaaccgtggttagatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcgg

SEQ ID NO: 103441 - DNA, 30 bp, Homo sapiens; identical to SEQ ID NO: 68278
  misc_feature 1..30: note = chr1:190448036-190448066
  misc_feature 1..30: note = Hyper
  source 1..30: mol_type = genomic DNA

SEQ ID NO: 103442 - DNA, 34 bp, Homo sapiens; identical to SEQ ID NO: 68283
  misc_feature 1..34: note = chr1:191390212-191390246
  misc_feature 1..34: note = Hypo
  source 1..34: mol_type = genomic DNA

SEQ ID NO: 103443 - DNA, 30 bp, Homo sapiens; identical to SEQ ID NO: 39183
  misc_feature 1..30: note = chr1:191565747-191565777
  misc_feature 1..30: note = Hypo
  source 1..30: mol_type = genomic DNA

SEQ ID NO: 103444 - DNA, 155 bp, Homo sapiens; identical to SEQ ID NO: 68288
  misc_feature 1..155: note = chr1:191763145-191763300
  misc_feature 1..155: note = Hypo
  source 1..155: mol_type = genomic DNA

SEQ ID NO: 103445 - DNA, 38 bp, Homo sapiens; identical to SEQ ID NO: 68291
  misc_feature 1..38: note = chr1:192175514-192175552
  misc_feature 1..38: note = Hypo
  source 1..38: mol_type = genomic DNA

SEQ ID NO: 103446 - DNA, 188 bp, Homo sapiens; identical to SEQ ID NO: 68295
  misc_feature 1..188: note = chr1:193668360-193668548
  misc_feature 1..188: note = Hypo
  source 1..188: mol_type = genomic DNA

SEQ ID NO: 103447 - DNA, 126 bp, Homo sapiens; identical to SEQ ID NO: 68296
  misc_feature 1..126: note = chr1:194532864-194532990
  misc_feature 1..126: note = Hypo
  source 1..126: mol_type = genomic DNA

SEQ ID NO: 103448 - DNA, 37 bp, Homo sapiens; identical to SEQ ID NO: 68297
  misc_feature 1..37: note = chr1:194626743-194626780
  misc_feature 1..37: note = Hypo
  source 1..37: mol_type = genomic DNA

SEQ ID NO: 103449 - DNA, 84 bp, Homo sapiens; identical to SEQ ID NO: 68298
  misc_feature 1..84: note = chr1:194827966-194828050
  misc_feature 1..84: note = Hypo
  source 1..84: mol_type = genomic DNA

SEQ ID NO: 103450 - DNA, 217 bp, Homo sapiens; identical to SEQ ID NO: 39185
  misc_feature 1..217: note = chr1:195732322-195732539
  misc_feature 1..217: note = Hypo
  source 1..217: mol_type = genomic DNA

SEQ ID NO: 103451 - DNA, 64 bp, Homo sapiens; identical to SEQ ID NO: 26773
  misc_feature 1..64: note = chr1:196577371-196577435
  misc_feature 1..64: note = Hyper
  source 1..64: mol_type = genomic DNA

SEQ ID NO: 103452 - DNA, 680 bp, Homo sapiens; identical to SEQ ID NO: 68305
  misc_feature 1..680: note = chr1:196577707-196578387
  misc_feature 1..680: note = Hyper
  source 1..680: mol_type = genomic DNA

SEQ ID NO: 103453 - DNA, 30 bp, Homo sapiens; identical to SEQ ID NO: 68308
  misc_feature 1..30: note = chr1:197091622-197091652
  misc_feature 1..30: note = Hypo
  source 1..30: mol_type = genomic DNA

SEQ ID NO: 103454 - DNA, 30 bp, Homo sapiens; identical to SEQ ID NO: 39186
  misc_feature 1..30: note = chr1:197771436-197771466
  misc_feature 1..30: note = Hypo
  source 1..30: mol_type = genomic DNA

SEQ ID NO: 103455 - DNA, 146 bp, Homo sapiens; identical to SEQ ID NO: 68312
  misc_feature 1..146: note = chr1:197879400-197879546
  misc_feature 1..146: note = Hyper
  source 1..146: mol_type = genomic DNA

SEQ ID NO: 103456 - DNA, 1465 bp, Homo sapiens
  misc_feature 1..1465: note = chr1:197879606-197881071
  misc_feature 1..1465: note = Hyper
  source 1..1465: mol_type = genomic DNA
atgcatgtcgttaccaaatacctagaacggtattggaccgcaaagaggttaaacccggttgctttcgacaggaatgagttgaaagcacccaagcgttttcgggtgggtatcgccgtccatccattcgatggcctcgctgatgagcatagaagatgaacccgggaggactgtcccttcctggctgcgaaacctgaccgatataggggagattctagaagaaagagctaaggaggccagggcggaaagaggaaagtcaggtgtaggggagattaaaaggtaaactggtgggactgaccgggctggtgggactagttagcgaagccaagtgtttgggtagaaacagagatcttgtaggaggtgctccgagctacatttcgggatttgggatgaaaagagaaagccagggggttcgccgctcctggtttgttccttaccgaccctaaactgtatggcggagcttgtgggtcaggcgtggaggcggcatccactcccacgtgccccacatgcagcagcaatcccacgcggttttcgcaagcggctgggaggcaagcgggcgtccccccacaccccccccccactgcgccctggacccacgccacgcaccgccaaggagtagctatggtggcacgtggaggaggggcgggtaggcagggcggcaccatcaccgggaccagcatcttggaacggtcaatctcactgctcatactctcctccctaccggcgcgggagccttgctgtaatcccctgccaccccatctccgactgtgaggggcgcaccgggtgggggaatgggtaaataactggcccaaggcccagcttccaggtcctccctccactttcccgcggcctgactgcgccccgggcaacacagccccttgggaacctgcgaccaggtaatgtggcctccgccccgtcccgggtctggctgcatcccctctaacccctgcctgcccgggtccaagtgagggttttctcccggaaggttaatcaccacccccatcccctagccgggtcccgggaggaagagatgccccggctctctcgttgacccggcctcgaacgccgacctcgagcgcagaatactcccgagtgctgggttcctgatacccagcccgggagcgaggggagtgaaggagggaccgggacaggaaggcggggacgcggtgggtgaacaatcaatggcttagcctagtttccccgcaggagctaccgcccattcaccgtctatgcaagcaccagctggcggcagcatcttttaggtacaagctgcagggaggcaaaagctggctggggggccgggagcccagggcacgccgcgggactccagtccccctgctgcgccccagcctcaagacgctctgggctttatgaggttcagttaccgccgagtcctccattaacacctcctctgattattgagaggctggaagggctgaacgcaacctcagagcgtttctctgggcac

SEQ ID NO: 103457 - DNA, 192 bp, Homo sapiens; identical to SEQ ID NO: 26777
  misc_feature 1..192: note = chr1:197881412-197881604
  misc_feature 1..192: note = Hyper
  source 1..192: mol_type = genomic DNA

SEQ ID NO: 103458 - DNA, 156 bp, Homo sapiens; identical to SEQ ID NO: 68316
  misc_feature 1..156: note = chr1:197882052-197882208
  misc_feature 1..156: note = Hyper
  source 1..156: mol_type = genomic DNA

SEQ ID NO: 103459 - DNA, 67 bp, Homo sapiens; identical to SEQ ID NO: 68317
  misc_feature 1..67: note = chr1:197882427-197882494
  misc_feature 1..67: note = Hyper
  source 1..67: mol_type = genomic DNA

SEQ ID NO: 103460 - DNA, 279 bp, Homo sapiens; identical to SEQ ID NO: 68318
  misc_feature 1..279: note = chr1:197885015-197885294
  misc_feature 1..279: note = Hyper
  source 1..279: mol_type = genomic DNA

SEQ ID NO: 103461 - DNA, 30 bp, Homo sapiens; identical to SEQ ID NO: 68319
  misc_feature 1..30: note = chr1:197885683-197885713
  misc_feature 1..30: note = Hyper
  source 1..30: mol_type = genomic DNA

SEQ ID NO: 103462 - DNA, 21 bp, Homo sapiens
  misc_feature 1..21: note = chr1:197886252-197886273
  misc_feature 1..21: note = Hyper
  source 1..21: mol_type = genomic DNA
cgcgcgcgtgtgtgtgttttg

SEQ ID NO: 103463 - DNA, 2805 bp, Homo sapiens
  misc_feature 1..2805: note = chr1:197886851-197889656
  misc_feature 1..2805: note = Hyper
  source 1..2805: mol_type = genomic DNA
ctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggagcgcagatccaagactgaggcccgtctggccaaaggcgcccagctcaacggccgcgacgcggtaaggaagggctccgccgcggcggtagccgggcacccctgcgccctctgttaaaccaagccgactccctggccggtggagaaccggagcggcgggtcgtagagacgtccgcttgagggtggcgggtgagttttctcccgtccacctatgcctacagggctaagaaacggtcgtttttctgaatcgaaatgtctgcagctggctatcctccgtcgcagctgattccgaaagagcagggagaggaactgggaggaggtgggatggggggtggtggcattctcttctacagacctcaaggttcccttgattccggggcaggcgtctccccggcgaggatccgcagctccgagggcaagctgggcataagcaataggaggacggcgcgctgccgaggcgtccgagccaagcaggagcccaggtggccttagtctctgggcctgatgaccggacctgtggagtagattccgacgcgactgggtcatttccagttctctagacgctcggggcttgggacccctaaccgagagaatctcagggtttctggcatcccgactcagtccctctaaggagacagcactacgtttagcgccaggacccggcgggtgtcatgtgtagggggaaatcaaataaaacatacggaggagcgcggcacccagtcgaaacgcatgaactttataaccaacccttaaacaagctaatcaaccaccactgtttctactatccataataataaagtcatgtcctcttaataaagaaaactaattacttatctaagcgcttccctttccagattactaacggggggggggggggactacagaagtctccggaaattatttcggccaaacatagctgtgtagatcctttggtaccacagtaggacttgtagcccaaactaatcaggagactgctctagcccttatcagctgggttttgggtccggccaagtagcccaactggtgaacgtgtctatatttgtaacactcattcagtgccggggcccctggtcggagtaaagggctaaactttactttttcaggcccgctgaagtttcgtggggaagatcaacccatttctgctagtcgtgagggaaatgtccggaggttaactccttttccctttttctggtcatcacttttaaaaacaaatagtagcaacccaaacccaaattttgcagcggggctgggctcctcaaggtggggccactggggcatcccgagtcgggtcagtgggacccagagggaagcataacttgggcactaaacagattttcaagacaaaggtctcagtacgcctgttgatgctagggaaagaggggactgtatacagcgggctggacagcggaccctctttgggaacagccactttacacatttattgggaacggcaccaatagccctgaaaattagggaacagcaggggctgccaaatatatctcaatcaaaacaaagtcgaccaaattatgagcagaggtccaataatctcccctttgcttttgatttcaatgctgcttataagaatttagagaaatcgaactgtaatattttttgtttaaaaataacctgtgctcgttgaaatttccttttcactcccttatcatttccgttgttttattttgtgtgcgtcgaaaaccacaatttttagcttgtaattatttgaattcggaaacgatcaccaaactgtagtcaatattttcctagtcctttttaagcgaggctccggatggctgggatgtctttaggttagtagtcccgggaggacgcgaacgccggttcaggcagacacggaagaaagcaagcgggccgcaaagagagaaatcacaaatgtttcccctgacttttgcctttgtgcagtggaccctggcccctgccgctctccctgcacaccctgggcttggtctgcctgggggagaaccccgcgtcgtgcggctacaccgcgcgccctcctcagccttgcggtgtgctttctttgcagggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattgggtgtttgttttccgcttgctacgaatt

SEQ ID NO: 103464 - DNA, 288 bp, Homo sapiens; identical to SEQ ID NO: 68327
  misc_feature 1..288: note = chr1:197890549-197890837
  misc_feature 1..288: note = Hyper
  source 1..288: mol_type = genomic DNA

SEQ ID NO: 103465 - DNA, 205 bp, Homo sapiens; identical to SEQ ID NO: 68328
  misc_feature 1..205: note = chr1:198097470-198097675
  misc_feature 1..205: note = Hypo
  source 1..205: mol_type = genomic DNA

SEQ ID NO: 103466 - DNA, 150 bp, Homo sapiens; identical to SEQ ID NO: 68329
  misc_feature 1..150: note = chr1:198124631-198124781
  misc_feature 1..150: note = Hypo
  source 1..150: mol_type = genomic DNA

SEQ ID NO: 103467 - DNA, 222 bp, Homo sapiens; identical to SEQ ID NO: 68330
  misc_feature 1..222: note = chr1:198181340-198181562
  misc_feature 1..222: note = Hypo
  source 1..222: mol_type = genomic DNA

SEQ ID NO: 103468 - DNA, 16 bp, Homo sapiens
  misc_feature 1..16: note = chr1:198918249-198918265
  misc_feature 1..16: note = Hypo
  source 1..16: mol_type = genomic DNA
ggcctgggcggaggcc

SEQ ID NO: 103469 - DNA, 17 bp, Homo sapiens
  misc_feature 1..17: note = chr1:198918546-198918563
  misc_feature 1..17: note = Hypo
  source 1..17: mol_type = genomic DNA
tgcgcagaggctactgg

SEQ ID NO: 103470 - DNA, 205 bp, Homo sapiens; identical to SEQ ID NO: 68335
  misc_feature 1..205: note = chr1:199249992-199250197
  misc_feature 1..205: note = Hypo
  source 1..205: mol_type = genomic DNA

SEQ ID NO: 103471 - DNA, 30 bp, Homo sapiens; identical to SEQ ID NO: 68336
  misc_feature 1..30: note = chr1:199360890-199360920
  misc_feature 1..30: note = Hypo
  source 1..30: mol_type = genomic DNA

SEQ ID NO: 103472 - DNA, 36 bp, Homo sapiens; identical to SEQ ID NO: 68337
  misc_feature 1..36: note = chr1:199842536-199842572
  misc_feature 1..36: note = Hypo
  source 1..36: mol_type = genomic DNA

SEQ ID NO: 103473 - DNA, 240 bp, Homo sapiens; identical to SEQ ID NO: 26787
  misc_feature 1..240: note = chr1:199998199-199998439
  misc_feature 1..240: note = Hyper
  source 1..240: mol_type = genomic DNA

SEQ ID NO: 103474 - DNA, 56 bp, Homo sapiens; identical to SEQ ID NO: 68339
  misc_feature 1..56: note = chr1:199998732-199998788
  misc_feature 1..56: note = Hyper
  source 1..56: mol_type = genomic DNA

SEQ ID NO: 103475 - DNA, 176 bp, Homo sapiens; identical to SEQ ID NO: 68340
  misc_feature 1..176: note = chr1:200008515-200008691
  misc_feature 1..176: note = Hyper
  source 1..176: mol_type = genomic DNA

SEQ ID NO: 103476 - DNA, 38 bp, Homo sapiens; identical to SEQ ID NO: 68341
  misc_feature 1..38: note = chr1:200009412-200009450
  misc_feature 1..38: note = Hyper
  source 1..38: mol_type = genomic DNA

SEQ ID NO: 103477 - DNA, 427 bp, Homo sapiens; identical to SEQ ID NO: 68342
  misc_feature 1..427: note = chr1:200009750-200010177
  misc_feature 1..427: note = Hyper
  source 1..427: mol_type = genomic DNA

SEQ ID NO: 103478 - DNA, 847 bp, Homo sapiens
  misc_feature 1..847: note = chr1:200011257-200012104
  misc_feature 1..847: note = Hyper
  source 1..847: mol_type = genomic DNA
ccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaacgccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgaggtgtttatatt

SEQ ID NO: 103479 - DNA, 30 bp, Homo sapiens; identical to SEQ ID NO: 68345
  misc_feature 1..30: note = chr1:200183084-200183114
  misc_feature 1..30: note = Hypo
  source 1..30: mol_type = genomic DNA

SEQ ID NO: 103480 - DNA, 160 bp, Homo sapiens; identical to SEQ ID NO: 39187
  misc_feature 1..160: note = chr1:200505065-200505225
  misc_feature 1..160: note = Hypo
  source 1..160: mol_type = genomic DNA

SEQ ID NO: 103481 - DNA, 33 bp, Homo sapiens; identical to SEQ ID NO: 68347
  misc_feature 1..33: note = chr1:200519383-200519416
  misc_feature 1..33: note = Hypo
  source 1..33: mol_type = genomic DNA

SEQ ID NO: 103482 - DNA, 18 bp, Homo sapiens
  misc_feature 1..18: note = chr1:200588770-200588788
  misc_feature 1..18: note = Hypo
  source 1..18: mol_type = genomic DNA
gtccggcccatgtatgtt

SEQ ID NO: 103483 - DNA, 335 bp, Homo sapiens; identical to SEQ ID NO: 68349
  misc_feature 1..335: note = chr1:200860242-200860577
  misc_feature 1..335: note = Hyper
  source 1..335: mol_type = genomic DNA

SEQ ID NO: 103484 - DNA, 77 bp, Homo sapiens; identical to SEQ ID NO: 68350
  misc_feature 1..77: note = chr1:200864028-200864105
  misc_feature 1..77: note = Hypo
  source 1..77: mol_type = genomic DNA

SEQ ID NO: 103485 - DNA, 33 bp, Homo sapiens; identical to SEQ ID NO: 68351
  misc_feature 1..33: note = chr1:200870109-200870142
  misc_feature 1..33: note = Hypo
  source 1..33: mol_type = genomic DNA

SEQ ID NO: 103486 - DNA, 49 bp, Homo sapiens; identical to SEQ ID NO: 39190
  misc_feature 1..49: note = chr1:200941620-200941669
  misc_feature 1..49: note = Hypo
  source 1..49: mol_type = genomic DNA

SEQ ID NO: 103487 - DNA, 30 bp, Homo sapiens
  misc_feature 1..30: note = chr1:201084201-201084231
  misc_feature 1..30: note = Hyper
  source 1..30: mol_type = genomic DNA
ttgacgcacttgactcgctgcctctcgcgc

SEQ ID NO: 103488 - DNA, 184 bp, Homo sapiens; identical to SEQ ID NO: 68354
  misc_feature 1..184: note = chr1:201244242-201244426
  misc_feature 1..184: note = Hypo
  source 1..184: mol_type = genomic DNA

SEQ ID NO: 103489 - DNA, 322 bp, Homo sapiens; identical to SEQ ID NO: 68355
  misc_feature 1..322: note = chr1:201252494-201252816
  misc_feature 1..322: note = Hyper
  source 1..322: mol_type = genomic DNA

SEQ ID NO: 103490 - DNA, 46 bp, Homo sapiens; identical to SEQ ID NO: 68358
  misc_feature 1..46: note = chr1:201368848-201368894
  misc_feature 1..46: note = Hyper
  source 1..46: mol_type = genomic DNA

SEQ ID NO: 103491 - DNA, 55 bp, Homo sapiens; identical to SEQ ID NO: 68359
  misc_feature 1..55: note = chr1:201383691-201383746
  misc_feature 1..55: note = Hypo
  source 1..55: mol_type = genomic DNA

SEQ ID NO: 103492 - DNA, 192 bp, Homo sapiens
  misc_feature 1..192: note = chr1:201437613-201437805
  misc_feature 1..192: note = Hyper
  source 1..192: mol_type = genomic DNA
ctagggtgatctgggcgttccagccgggatcttccagggggcagcggaagtcgatctcgccgcccccttcggtcaccagcgtgaagtagatgtggcgcccggtgctctccacgcactccacggccttgatgcgggcgaagctgagctccttgggccggccgcccgtgcccttggcctcgaagagctgcagcc

SEQ ID NO: 103493 - DNA, 73 bp, Homo sapiens; identical to SEQ ID NO: 26796
  misc_feature 1..73: note = chr1:201438552-201438625
  misc_feature 1..73: note = Hyper
  source 1..73: mol_type = genomic DNA

SEQ ID NO: 103494 - DNA, 206 bp, Homo sapiens; identical to SEQ ID NO: 68364
  misc_feature 1..206: note = chr1:201445697-201445903
  misc_feature 1..206: note = Hypo
  source 1..206: mol_type = genomic DNA

SEQ ID NO: 103495 - DNA, 91 bp, Homo sapiens; identical to SEQ ID NO: 68365
  misc_feature 1..91: note = chr1:201508375-201508466
  misc_feature 1..91: note = Hyper
  source 1..91: mol_type = genomic DNA

SEQ ID NO: 103496 - DNA, 292 bp, Homo sapiens; identical to SEQ ID NO: 68366
  misc_feature 1..292: note = chr1:201508694-201508986
  misc_feature 1..292: note = Hyper
  source 1..292: mol_type = genomic DNA

SEQ ID NO: 103497 - DNA, 30 bp, Homo sapiens; identical to SEQ ID NO: 68367
  misc_feature 1..30: note = chr1:201583245-201583275
  misc_feature 1..30: note = Hyper
  source 1..30: mol_type = genomic DNA

SEQ ID NO: 103498 - DNA, 94 bp, Homo sapiens; identical to SEQ ID NO: 68368
  misc_feature 1..94: note = chr1:201797447-201797541
  misc_feature 1..94: note = Hypo
  source 1..94: mol_type = genomic DNA

SEQ ID NO: 103499 - DNA, 30 bp, Homo sapiens; identical to SEQ ID NO: 39194
  misc_feature 1..30: note = chr1:201851118-201851148
  misc_feature 1..30: note = Hypo
  source 1..30: mol_type = genomic DNA

SEQ ID NO: 103500 - DNA, 76 bp, Homo sapiens; identical to SEQ ID NO: 68370
  misc_feature 1..76: note = chr1:201915663-201915739
  misc_feature 1..76: note = Hyper
  source 1..76: mol_type = genomic DNA

SEQ ID NO: 103501 - DNA, 394 bp, Homo sapiens; identical to SEQ ID NO: 68371
  misc_feature 1..394: note = chr1:201977576-201977970
  misc_feature 1..394: note = Hypo
  source 1..394: mol_type = genomic DNA

SEQ ID NO: 103502 - DNA, 85 bp, Homo sapiens; identical to SEQ ID NO: 68372
  misc_feature 1..85: note = chr1:201981114-201981199
  misc_feature 1..85: note = Hypo
  source 1..85: mol_type = genomic DNA

SEQ ID NO: 103503 - DNA, 204 bp, Homo sapiens; identical to SEQ ID NO: 68373
  misc_feature 1..204: note = chr1:201982388-201982592
  misc_feature 1..204: note = Hypo
  source 1..204: mol_type = genomic DNA

SEQ ID NO: 103504 - DNA, 118 bp, Homo sapiens; identical to SEQ ID NO: 68374
  misc_feature 1..118: note = chr1:201983113-201983231
  misc_feature 1..118: note = Hypo
  source 1..118: mol_type = genomic DNA

SEQ ID NO: 103505 - DNA, 98 bp, Homo sapiens; identical to SEQ ID NO: 39199
  misc_feature 1..98: note = chr1:201984047-201984145
  misc_feature 1..98: note = Hypo
  source 1..98: mol_type = genomic DNA

SEQ ID NO: 103506 - DNA, 164 bp, Homo sapiens; identical to SEQ ID NO: 68376
  misc_feature 1..164: note = chr1:201986490-201986654
  misc_feature 1..164: note = Hypo
  source 1..164: mol_type = genomic DNA

SEQ ID NO: 103507 - DNA, 22 bp, Homo sapiens
  misc_feature 1..22: note = chr1:202025754-202025776
  misc_feature 1..22: note = Hypo
  source 1..22: mol_type = genomic DNA
ttacaggcgtgagccaccacgc

SEQ ID NO: 103508 - DNA, 123 bp, Homo sapiens; identical to SEQ ID NO: 68378
  misc_feature 1..123: note = chr1:202042364-202042487
  misc_feature 1..123: note = Hypo
  source 1..123: mol_type = genomic DNA

SEQ ID NO: 103509 - DNA, 15 bp, Homo sapiens
  misc_feature 1..15: note = chr1:202081789-202081804
  misc_feature 1..15: note = Hypo
  source 1..15: mol_type = genomic DNA
cgtctcaaaaaaaaa

SEQ ID NO: 103510 - DNA, 88 bp, Homo sapiens; identical to SEQ ID NO: 68381
  misc_feature 1..88: note = chr1:202101759-202101847
  misc_feature 1..88: note = Hypo
  source 1..88: mol_type = genomic DNA

SEQ ID NO: 103511 - DNA, 248 bp, Homo sapiens; identical to SEQ ID NO: 68382
  misc_feature 1..248: note = chr1:202183428-202183676
  misc_feature 1..248: note = Hyper
  source 1..248: mol_type = genomic DNA

SEQ ID NO: 103512 - DNA, 30 bp, Homo sapiens; identical to SEQ ID NO: 68383
  misc_feature 1..30: note = chr1:202208039-202208069
  misc_feature 1..30: note = Hypo
  source 1..30: mol_type = genomic DNA

SEQ ID NO: 103513 - DNA, 139 bp, Homo sapiens; identical to SEQ ID NO: 39203
  misc_feature 1..139: note = chr1:202311995-202312134
  misc_feature 1..139: note = Hypo
  source 1..139: mol_type = genomic DNA

SEQ ID NO: 103514 - DNA, 278 bp, Homo sapiens; identical to SEQ ID NO: 68386
  misc_feature 1..278: note = chr1:202611761-202612039
  misc_feature 1..278: note = Hyper
  source 1..278: mol_type = genomic DNA

SEQ ID NO: 103515 - DNA, 127 bp, Homo sapiens; identical to SEQ ID NO: 26799
  misc_feature 1..127: note = chr1:202613418-202613545
  misc_feature 1..127: note = Hyper
  source 1..127: mol_type = genomic DNA

SEQ ID NO: 103516 - DNA, 1043 bp, Homo sapiens
  misc_feature 1..1043: note = chr1:202678665-202679708
  misc_feature 1..1043: note = Hyper
  source 1..1043: mol_type = genomic DNA
cgggctgtcagcacccgccaggctgcgagcctagcccttggggacagagctgaagcagggacggggcgtcctaggtcgtgctgagtcatgagatttggagagaggggaggggcgcctccagccccttcttgggcccctgccccagctcctcgtgcccgttgcttccagatggcccctgcagtctgtctccccaacctctccctgacccagggtctccggctcccagcgcccagaccccaccccccgccccacttcccacgacggcggtgccaggggtccccgaagcttgagactggggcaaaagaaccttccttggagaccgctagggctggcgggggctgggctagacgcgagtgggttcgtcccagggaaaggagagagggacgggggcgcagagccggccggtgcaggggacgcgtggcccgcccctctctgcagcaacccgcgggaggaaatctgcccccagcccagccccagtccctcagaggagccggctcctcgcccctcgggtccgactccccgagacgaaccttccatccggacgcttccaaactcccccaaaggacggggcagactcccggcccccttggcctcaaacttccccaaccctactcacctctcgggacccagaccaccccgtggcccctcgactcagtagcaggaaaggagaaactttggagagggaggtccgtgcccccaccggcgggggtatggacttaccggagagcgacccgaaggaggcgggagagatccggggtctccaatgtgagggggcgtcggacggcaaggacgcgtggctggcgacggtttcgcaggggcgcccgttcccctgggggcgcgaagtccccgctccaccgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 103517 - DNA, 16 bp, Homo sapiens
  misc_feature 1..16: note = chr1:202829801-202829817
  misc_feature 1..16: note = Hypo
  source 1..16: mol_type = genomic DNA
gcgcctggccagtcaa

SEQ ID NO: 103518 - DNA, 76 bp, Homo sapiens; identical to SEQ ID NO: 68391
  misc_feature 1..76: note = chr1:202840809-202840885
  misc_feature 1..76: note = Hypo
  source 1..76: mol_type = genomic DNA

SEQ ID NO: 103519 - DNA, 30 bp, Homo sapiens; identical to SEQ ID NO: 39204
  misc_feature 1..30: note = chr1:202856302-202856332
  misc_feature 1..30: note = Hypo
  source 1..30: mol_type = genomic DNA

SEQ ID NO: 103520 - DNA, 97 bp, Homo sapiens; identical to SEQ ID NO: 68393
  misc_feature 1..97: note = chr1:202856952-202857049
  misc_feature 1..97: note = Hypo
  source 1..97: mol_type = genomic DNA

SEQ ID NO: 103521 - DNA, 30 bp, Homo sapiens; identical to SEQ ID NO: 68394
  misc_feature 1..30: note = chr1:202861824-202861854
  misc_feature 1..30: note = Hypo
  source 1..30: mol_type = genomic DNA

SEQ ID NO: 103522 - DNA, 30 bp, Homo sapiens; identical to SEQ ID NO: 68395
  misc_feature 1..30: note = chr1:202897655-202897685
  misc_feature 1..30: note = Hypo
  source 1..30: mol_type = genomic DNA

SEQ ID NO: 103523 - DNA, 83 bp, Homo sapiens; identical to SEQ ID NO: 68396
  misc_feature 1..83: note = chr1:202898246-202898329
  misc_feature 1..83: note = Hypo
  source 1..83: mol_type = genomic DNA

SEQ ID NO: 103524 - DNA, 155 bp, Homo sapiens; identical to SEQ ID NO: 68397
  misc_feature 1..155: note = chr1:202933730-202933885
  misc_feature 1..155: note = Hypo
  source 1..155: mol_type = genomic DNA

SEQ ID NO: 103525 - DNA, 30 bp, Homo sapiens; identical to SEQ ID NO: 68398
  misc_feature 1..30: note = chr1:202934371-202934401
  misc_feature 1..30: note = Hypo
  source 1..30: mol_type = genomic DNA

SEQ ID NO: 103526 - DNA, 149 bp, Homo sapiens; identical to SEQ ID NO: 68399
  misc_feature 1..149: note = chr1:202936921-202937070
  misc_feature 1..149: note = Hyper
  source 1..149: mol_type = genomic DNA

SEQ ID NO: 103527 - DNA, 79 bp, Homo sapiens; identical to SEQ ID NO: 39207
  misc_feature 1..79: note = chr1:202995301-202995380
  misc_feature 1..79: note = Hypo
  source 1..79: mol_type = genomic DNA

SEQ ID NO: 103528 - DNA, 482 bp, Homo sapiens
  misc_feature 1..482: note = chr1:202995837-202996319
  misc_feature 1..482: note = Hyper
  source 1..482: mol_type = genomic DNA
tcgtctatcgcacctcgggaaacagccctttttgactccgtatgtgctacctccggcaggcgtcggtactgcttaccctgccgcccctcgccctcctttgcggtgccctgtgcccttgggggtgaggataggggcgatgcctgatctgcggggagggcgtggagtgcgccctctgctccatcggcttcaggggagggggccgagttggcgagtctcccggtgggaacggagcagactgcgcccccatttcccctccaggagagtcagaaaaagcgcctctcggctccggggccaaccccactcctttggggacgcgattctgatgggctgaggtcttcgctcttcgcgggggtcttaatctttcccgagttgctcatagcacccctgttcctgtcgctagctctccattcctcgaactgccagcctcagtctgtgccagagatgcccccatctccgcagtgccagggcggtggggtggaagg

SEQ ID NO: 103529 - DNA, 30 bp, Homo sapiens
  misc_feature 1..30: note = chr1:203044840-203044870
  misc_feature 1..30: note = Hyper
  source 1..30: mol_type = genomic DNA
ccctgcagcccccaccggccccgccaaaga

SEQ ID NO: 103530 - DNA, 262 bp, Homo sapiens; identical to SEQ ID NO: 68403
  misc_feature 1..262: note = chr1:203086936-203087198
  misc_feature 1..262: note = Hyper
  source 1..262: mol_type = genomic DNA

SEQ ID NO: 103531 - DNA, 659 bp, Homo sapiens; identical to SEQ ID NO: 68404
  misc_feature 1..659: note = chr1:203096850-203097509
  misc_feature 1..659: note = Hyper
  source 1..659: mol_type = genomic DNA

SEQ ID NO: 103532 - DNA, 40 bp, Homo sapiens; identical to SEQ ID NO: 68405
  misc_feature 1..40: note = chr1:203236950-203236990
  misc_feature 1..40: note = Hyper
  source 1..40: mol_type = genomic DNA

SEQ ID NO: 103533 - DNA, 30 bp, Homo sapiens; identical to SEQ ID NO: 39208
  misc_feature 1..30: note = chr1:203257678-203257708
  misc_feature 1..30: note = Hypo
  source 1..30: mol_type = genomic DNA

SEQ ID NO: 103534 - DNA, 267 bp, Homo sapiens; identical to SEQ ID NO: 68407
  misc_feature 1..267: note = chr1:203298174-203298441
  misc_feature 1..267: note = Hypo
  source 1..267: mol_type = genomic DNA

SEQ ID NO: 103535 - DNA, 85 bp, Homo sapiens; identical to SEQ ID NO: 39210
  misc_feature 1..85: note = chr1:203429564-203429649
  misc_feature 1..85: note = Hypo
  source 1..85: mol_type = genomic DNA

SEQ ID NO: 103536 - DNA, 20 bp, Homo sapiens
  misc_feature 1..20: note = chr1:203764131-203764151
  misc_feature 1..20: note = Hypo
  source 1..20: mol_type = genomic DNA
gccaccgcaccggccacgtg

SEQ ID NO: 103537 - DNA, 18 bp, Homo sapiens
  misc_feature 1..18: note = chr1:203832761-203832779
  misc_feature 1..18: note = Hypo
  source 1..18: mol_type = genomic DNA
taacgtttccacttttat

SEQ ID NO: 103538 - DNA, 38 bp, Homo sapiens; identical to SEQ ID NO: 68411
  misc_feature 1..38: note = chr1:203911836-203911874
  misc_feature 1..38: note = Hypo
  source 1..38: mol_type = genomic DNA

SEQ ID NO: 103539 - DNA, 68 bp, Homo sapiens; identical to SEQ ID NO: 68412
  misc_feature 1..68: note = chr1:204042624-204042692
  misc_feature 1..68: note = Hyper
  source 1..68: mol_type = genomic DNA

SEQ ID NO: 103540 - DNA, 30 bp, Homo sapiens; identical to SEQ ID NO: 68413
  misc_feature 1..30: note = chr1:204042936-204042966
  misc_feature 1..30: note = Hyper
  source 1..30: mol_type = genomic DNA

SEQ ID NO: 103541 - DNA, 40 bp, Homo sapiens; identical to SEQ ID NO: 68414
  misc_feature 1..40: note = chr1:204044387-204044427
  misc_feature 1..40: note = Hyper
  source 1..40: mol_type = genomic DNA

SEQ ID NO: 103542 - DNA, 407 bp, Homo sapiens; identical to SEQ ID NO: 68415
  misc_feature 1..407: note = chr1:204120648-204121055
  misc_feature 1..407: note = Hyper
  source 1..407: mol_type = genomic DNA

SEQ ID NO: 103543 - DNA, 81 bp, Homo sapiens; identical to SEQ ID NO: 68416
  misc_feature 1..81: note = chr1:204159610-204159691
  misc_feature 1..81: note = Hyper
  source 1..81: mol_type = genomic DNA

SEQ ID NO: 103544 - DNA, 38 bp, Homo sapiens; identical to SEQ ID NO: 68418
  misc_feature 1..38: note = chr1:204333521-204333559
  misc_feature 1..38: note = Hypo
  source 1..38: mol_type = genomic DNA

SEQ ID NO: 103545 - DNA, 30 bp, Homo sapiens; identical to SEQ ID NO: 68419
  misc_feature 1..30: note = chr1:204333856-204333886
  misc_feature 1..30: note = Hypo
  source 1..30: mol_type = genomic DNA

SEQ ID NO: 103546 - DNA, 30 bp, Homo sapiens; identical to SEQ ID NO: 39213
  misc_feature 1..30: note = chr1:204535867-204535897
  misc_feature 1..30: note = Hypo
  source 1..30: mol_type = genomic DNA

SEQ ID NO: 103547 - DNA, 30 bp, Homo sapiens; identical to SEQ ID NO: 39214
  misc_feature 1..30: note = chr1:204536295-204536325
  misc_feature 1..30: note = Hypo
  source 1..30: mol_type = genomic DNA

SEQ ID NO: 103548 - DNA, 162 bp, Homo sapiens; identical to SEQ ID NO: 68422
  misc_feature 1..162: note = chr1:204586294-204586456
  misc_feature 1..162: note = Hypo
  source 1..162: mol_type = genomic DNA

SEQ ID NO: 103549 - DNA, 153 bp, Homo sapiens; identical to SEQ ID NO: 68423
  misc_feature 1..153: note = chr1:204587558-204587711
  misc_feature 1..153: note = Hypo
  source 1..153: mol_type = genomic DNA

SEQ ID NO: 103550 - DNA, 30 bp, Homo sapiens; identical to SEQ ID NO: 68424
  misc_feature 1..30: note = chr1:204588003-204588033
  misc_feature 1..30: note = Hypo
  source 1..30: mol_type = genomic DNA

SEQ ID NO: 103551 - DNA, 112 bp, Homo sapiens; identical to SEQ ID NO: 39216
  misc_feature 1..112: note = chr1:204588271-204588383
  misc_feature 1..112: note = Hypo
  source 1..112: mol_type = genomic DNA

SEQ ID NO: 103552 - DNA, 30 bp, Homo sapiens; identical to SEQ ID NO: 68426
  misc_feature 1..30: note = chr1:204589092-204589122
  misc_feature 1..30: note = Hypo
  source 1..30: mol_type = genomic DNA

SEQ ID NO: 103553 - DNA, 30 bp, Homo sapiens; identical to SEQ ID NO: 68427
  misc_feature 1..30: note = chr1:204643879-204643909
  misc_feature 1..30: note = Hypo
  source 1..30: mol_type = genomic DNA

SEQ ID NO: 103554 - DNA, 752 bp, Homo sapiens
  misc_feature 1..752: note = chr1:204653466-204654218
  misc_feature 1..752: note = Hyper
  source 1..752: mol_type = genomic DNA
aacagatgggagctgcggcagcctgaggaacagagcacaaagcccagctgacattttccttcctgttcgtttgggtgggggaggaagggtagggagcacagtgctacccccggggcccctccccaggttccgggtctcctgcacctctttagcttctccgctcggccccagatggagctcagttccctcaccccgcggctcctcgccggctgggcagccagagcctgcgccaccctttgccagcaggacagacggcccacctgtggctggccagcccatcctgtctcctgggtcctgcggtgggctcagagccacccttccgtttccgcttccccctgaccgagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgccagtccgcccgtgtcacgccctccctaacctcactgccacctctcggctcctccacatctccagggccccactctacccagcaacagtttgggggaggttctggcctctccaggcgaaggcccaggcgccctctccctggccgcttctgggcattctccagccctccgtccctctgcccctcggccgcctccctctccca

SEQ ID NO: 103555 - DNA, 194 bp, Homo sapiens; identical to SEQ ID NO: 68430
  misc_feature 1..194: note = chr1:204654575-204654769
  misc_feature 1..194: note = Hyper
  source 1..194: mol_type = genomic DNA

SEQ ID NO: 103556 - DNA, 74 bp, Homo sapiens; identical to SEQ ID NO: 68431
  misc_feature 1..74: note = chr1:204721208-204721282
  misc_feature 1..74: note = Hypo
  source 1..74: mol_type = genomic DNA

SEQ ID NO: 103557 - DNA, 564 bp, Homo sapiens; identical to SEQ ID NO: 68432
  misc_feature 1..564: note = chr1:204797757-204798321
  misc_feature 1..564: note = Hyper
  source 1..564: mol_type = genomic DNA

SEQ ID NO: 103558 - DNA, 46 bp, Homo sapiens; identical to SEQ ID NO: 68435
  misc_feature 1..46: note = chr1:205043046-205043092
  misc_feature 1..46: note = Hypo
  source 1..46: mol_type = genomic DNA

SEQ ID NO: 103559 - DNA, 145 bp, Homo sapiens; identical to SEQ ID NO: 39218
  misc_feature 1..145: note = chr1:205310661-205310806
  misc_feature 1..145: note = Hypo
  source 1..145: mol_type = genomic DNA

SEQ ID NO: 103560 - DNA, 24 bp, Homo sapiens
  misc_feature 1..24: note = chr1:205311046-205311070
  misc_feature 1..24: note = Hypo
  source 1..24: mol_type = genomic DNA
gattacaggcgtgagccaccgcgc

SEQ ID NO: 103561 - DNA, 528 bp, Homo sapiens
  misc_feature 1..528: note = chr1:205312478-205313006
  misc_feature 1..528: note = Hyper
  source 1..528: mol_type = genomic DNA
ccaatcaccatgatccgcttccccagggcggtgacggccacccccgcccgggctgtgggcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtccacgcctggccctgcggggggaacgcggtgaatcaagggcagctggggccacgcgccctccggcgggcagcggatgggctccgcagcccctggtca

SEQ ID NO: 103562 - DNA, 482 bp, Homo sapiens; identical to SEQ ID NO: 68443
  misc_feature 1..482: note = chr1:205399652-205400134
  misc_feature 1..482: note = Hyper
  source 1..482: mol_type = genomic DNA

SEQ ID NO: 103563 - DNA, 1182 bp, Homo sapiens; identical to SEQ ID NO: 68444
  misc_feature 1..1182: note = chr1:205424654-205425836
  misc_feature 1..1182: note = Hyper
  source 1..1182: mol_type = genomic DNA

SEQ ID NO: 103564 - DNA, 101 bp, Homo sapiens; identical to SEQ ID NO: 68445
  misc_feature 1..101: note = chr1:205425896-205425997
  misc_feature 1..101: note = Hyper
  source 1..101: mol_type = genomic DNA

SEQ ID NO: 103565 - DNA, 299 bp, Homo sapiens
  misc_feature 1..299: note = chr1:205537592-205537891
  misc_feature 1..299: note = Hyper
  source 1..299: mol_type = genomic DNA
aatgaaagccatgcacgaatactctcccaaggagaaacatatgtacaacaagattttgccttctgttctgggggaaaggggggtgccgttagaccctcgaagtccatctgtgaagcgcctaggtttaaaggggtccgggtttcctccactgccacagcccgggtgcggggagagggcccctagccttatccggagatacaggatgtctcgggctctccatctgccgggctctaaaatgggcgctcggtccctgggggctgcatccggaggctggggggactggtcgagggagagcgggc

SEQ ID NO: 103566 - DNA, 30 bp, Homo sapiens; identical to SEQ ID NO: 39220
  misc_feature 1..30: note = chr1:205548923-205548953
  misc_feature 1..30: note = Hypo
  source 1..30: mol_type = genomic DNA

SEQ ID NO: 103567 - DNA, 361 bp, Homo sapiens; identical to SEQ ID NO: 68453
  misc_feature 1..361: note = chr1:207200818-207201179
  misc_feature 1..361: note = Hypo
  source 1..361: mol_type = genomic DNA

SEQ ID NO: 103568 - DNA, 216 bp, Homo sapiens; identical to SEQ ID NO: 68454
  misc_feature 1..216: note = chr1:207224789-207225005
  misc_feature 1..216: note = Hypo
  source 1..216: mol_type = genomic DNA

SEQ ID NO: 103569 - DNA, 39 bp, Homo sapiens; identical to SEQ ID NO: 68455
  misc_feature 1..39: note = chr1:207225631-207225670
  misc_feature 1..39: note = Hypo
  source 1..39: mol_type = genomic DNA

SEQ ID NO: 103570 - DNA, 77 bp, Homo sapiens; identical to SEQ ID NO: 68456
  misc_feature 1..77: note = chr1:207227177-207227254
  misc_feature 1..77: note = Hypo
  source 1..77: mol_type = genomic DNA

SEQ ID NO: 103571 - DNA, 44 bp, Homo sapiens; identical to SEQ ID NO: 68457
  misc_feature 1..44: note = chr1:207477842-207477886
  misc_feature 1..44: note = Hypo
  source 1..44: mol_type = genomic DNA

SEQ ID NO: 103572 - DNA, 87 bp, Homo sapiens; identical to SEQ ID NO: 68458
  misc_feature 1..87: note = chr1:207567724-207567811
  misc_feature 1..87: note = Hypo
  source 1..87: mol_type = genomic DNA

SEQ ID NO: 103573 - DNA, 29 bp, Homo sapiens
  misc_feature 1..29: note = chr1:207590078-207590107
  misc_feature 1..29: note = Hypo
  source 1..29: mol_type = genomic DNA
gaggcaggcggatcacgaggtcaggagtt

SEQ ID NO: 103574 - DNA, 25 bp, Homo sapiens
  misc_feature 1..25: note = chr1:207598909-207598934
  misc_feature 1..25: note = Hypo
  source 1..25: mol_type = genomic DNA
ccaaactcaccgagtcatgcaggct

SEQ ID NO: 103575 - DNA, 603 bp, Homo sapiens; identical to SEQ ID NO: 68461
  misc_feature 1..603: note = chr1:207627530-207628133
  misc_feature 1..603: note = Hyper
  source 1..603: mol_type = genomic DNA

SEQ ID NO: 103576 - DNA, 32 bp, Homo sapiens; identical to SEQ ID NO: 68462
  misc_feature 1..32: note = chr1:207648482-207648514
  misc_feature 1..32: note = Hypo
  source 1..32: mol_type = genomic DNA

SEQ ID NO: 103577 - DNA, 30 bp, Homo sapiens; identical to SEQ ID NO: 14325
  misc_feature 1..30: note = chr1:207656486-207656516
  misc_feature 1..30: note = Hypo
  source 1..30: mol_type = genomic DNA

SEQ ID NO: 103578 - DNA, 858 bp, Homo sapiens
  misc_feature 1..858: note = chr1:207669258-207670116
  misc_feature 1..858: note = Hyper
  source 1..858: mol_type = genomic DNA
cagggtgtttggaggcgagctgccatcatccaccgcctttgtctggaagcgcagggcctcacacgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccccgcagagaactcgcgtgcagcgctgagctgcgctgctctgcgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagtt

SEQ ID NO: 103579 - DNA, 30 bp, Homo sapiens; identical to SEQ ID NO: 68467
  misc_feature 1..30: note = chr1:207760894-207760924
  misc_feature 1..30: note = Hypo
  source 1..30: mol_type = genomic DNA

SEQ ID NO: 103580 - DNA, 29 bp, Homo sapiens
  misc_feature 1..29: note = chr1:207786426-207786455
  misc_feature 1..29: note = Hypo
  source 1..29: mol_type = genomic DNA
gcttctttgtacctgcgtttggtgggtcc

SEQ ID NO: 103581 - DNA, 137 bp, Homo sapiens; identical to SEQ ID NO: 39225
  misc_feature 1..137: note = chr1:207787630-207787767
  misc_feature 1..137: note = Hypo
  source 1..137: mol_type = genomic DNA

SEQ ID NO: 103582 - DNA, 71 bp, Homo sapiens; identical to SEQ ID NO: 68470
  misc_feature 1..71: note = chr1:207818268-207818339
  misc_feature 1..71: note = Hyper
  source 1..71: mol_type = genomic DNA

SEQ ID NO: 103583 - DNA, 24 bp, Homo sapiens
  misc_feature 1..24: note = chr1:207829567-207829591
  misc_feature 1..24: note = Hypo
  source 1..24: mol_type = genomic DNA
gcgagattccgtctcaaaatcaat

SEQ ID NO: 103584 - DNA, 30 bp, Homo sapiens; identical to SEQ ID NO: 39226
  misc_feature 1..30: note = chr1:207857205-207857235
  misc_feature 1..30: note = Hypo
  source 1..30: mol_type = genomic DNA

SEQ ID NO: 103585 - DNA, 171 bp, Homo sapiens; identical to SEQ ID NO: 68473
  misc_feature 1..171: note = chr1:207911135-207911306
  misc_feature 1..171: note = Hypo
  source 1..171: mol_type = genomic DNA

SEQ ID NO: 103586 - DNA, 38 bp, Homo sapiens; identical to SEQ ID NO: 68474
  misc_feature 1..38: note = chr1:207921798-207921836
  misc_feature 1..38: note = Hypo
  source 1..38: mol_type = genomic DNA

SEQ ID NO: 103587 - DNA, 99 bp, Homo sapiens; identical to SEQ ID NO: 68475
  misc_feature 1..99: note = chr1:207991495-207991594
  misc_feature 1..99: note = Hypo
  source 1..99: mol_type = genomic DNA

SEQ ID NO: 103588 - DNA, 99 bp, Homo sapiens; identical to SEQ ID NO: 68476
  misc_feature 1..99: note = chr1:207991654-207991753
  misc_feature 1..99: note = Hypo
  source 1..99: mol_type = genomic DNA

SEQ ID NO: 103589 - DNA, 30 bp, Homo sapiens; identical to SEQ ID NO: 39229
  misc_feature 1..30: note = chr1:207992298-207992328
  misc_feature 1..30: note = Hypo
  source 1..30: mol_type = genomic DNA

SEQ ID NO: 103590 - DNA, 694 bp, Homo sapiens
  misc_feature 1..694: note = chr1:208083989-208084683
  misc_feature 1..694: note = Hyper
  source 1..694: mol_type = genomic DNA
tcctccccagtctcccggttctggctgcaacttcgcactccgcgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccctgcgcgcgcgcccctgcggaccagcatccttcccgcgcggctcctagagagacgcaccgagtggaagacactactcggcttggccaggacgcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 103591 - DNA, 54 bp, Homo sapiens; identical to SEQ ID NO: 68483
  misc_feature 1..54: note = chr1:208136458-208136512
  misc_feature 1..54: note = Hyper
  source 1..54: mol_type = genomic DNA

SEQ ID NO: 103592 - DNA, 30 bp, Homo sapiens; identical to SEQ ID NO: 68484
  misc_feature 1..30: note = chr1:208281203-208281233
  misc_feature 1..30: note = Hypo
  source 1..30: mol_type = genomic DNA

SEQ ID NO: 103593 - DNA, 35 bp, Homo sapiens; identical to SEQ ID NO: 68485
  misc_feature 1..35: note = chr1:208523515-208523550
  misc_feature 1..35: note = Hypo
  source 1..35: mol_type = genomic DNA

SEQ ID NO: 103594 - DNA, 30 bp, Homo sapiens; identical to SEQ ID NO: 68486
  misc_feature 1..30: note = chr1:208677386-208677416
  misc_feature 1..30: note = Hypo
  source 1..30: mol_type = genomic DNA

SEQ ID NO: 103595 - DNA, 18 bp, Homo sapiens
  misc_feature 1..18: note = chr1:208852030-208852048
  misc_feature 1..18: note = Hypo
  source 1..18: mol_type = genomic DNA
aagggggaagctggccgg

SEQ ID NO: 103596 - DNA, 115 bp, Homo sapiens; identical to SEQ ID NO: 39230
  misc_feature 1..115: note = chr1:208951412-208951527
  misc_feature 1..115: note = Hypo
  source 1..115: mol_type = genomic DNA

SEQ ID NO: 103597 - DNA, 88 bp, Homo sapiens; identical to SEQ ID NO: 68496
  misc_feature 1..88: note = chr1:209306269-209306357
  misc_feature 1..88: note = Hypo
  source 1..88: mol_type = genomic DNA

SEQ ID NO: 103598 - DNA, 30 bp, Homo sapiens; identical to SEQ ID NO: 68497
  misc_feature 1..30: note = chr1:209364033-209364063
  misc_feature 1..30: note = Hyper
  source 1..30: mol_type = genomic DNA

SEQ ID NO: 103599 - DNA, 544 bp, Homo sapiens; identical to SEQ ID NO: 68498
  misc_feature 1..544: note = chr1:209381087-209381631
  misc_feature 1..544: note = Hyper
  source 1..544: mol_type = genomic DNA

SEQ ID NO: 103600 - DNA, 185 bp, Homo sapiens; identical to SEQ ID NO: 39232
  misc_feature 1..185: note = chr1:209601396-209601581
  misc_feature 1..185: note = Hypo
  source 1..185: mol_type = genomic DNA

SEQ ID NO: 103601 - DNA, 237 bp, Homo sapiens; identical to SEQ ID NO: 68500
  misc_feature 1..237: note = chr1:209999727-209999964
  misc_feature 1..237: note = Hypo
  source 1..237: mol_type = genomic DNA

SEQ ID NO: 103602 - DNA, 30 bp, Homo sapiens; identical to SEQ ID NO: 68501
  misc_feature 1..30: note = chr1:210070804-210070834
  misc_feature 1..30: note = Hypo
  source 1..30: mol_type = genomic DNA

SEQ ID NO: 103603 - DNA, 1187 bp, Homo sapiens
  misc_feature 1..1187: note = chr1:210110982-210112169
  misc_feature 1..1187: note = Hyper
  source 1..1187: mol_type = genomic DNA
gctgtttctccacagcggagatctgagacgagtatgtggctgattcgggcaaaacaaaacaaaataaaaccaaacgaaaccaaaacagacttactattaccaaatctgagagtcagtgggtgggaatccttttcaaccaaggagacctgtccatggtcctgaccacatcatttgccactcgcctccttcatggacaccgtttgctccaagtaccggacgggagggcgcccggcgccaggaagcttgggcttgggcccccacacgagctcggcgcgcttcgggcgggtctcgggcgcgggcccgtggctctccgggccgggcacctgtttcgaatcgaggcgcgaggcgcggtggggcggtggggtggggtggggtaggttggggtgggggcggggtggcgtcacgtgccagcggcggccccgggaaggttccatttcttccgcggcccgcactcgcggcgctcggggcccctccctcgccccgcccgcggcgcccctcgcggccgcacagccgggcgactccgggccgggccccgcccctctcgctggcggactcagcgcgtcctccgccagccctcgcgtctgctgcccccgccatccagttggtgcggtccatggcgagcgcatcatggcgattgaaggtaagtggaggctgacagcggggagcgaggaccgggaccacccagctggcggggggctcggaggtgcgccggcaggccgaggcgctgacggggccgcctcctgtggtctggagccggctgaagacgcgcgggggtcctggccgcgtctcgggaggcgggtgggcggagcggcgccgctgggacgccgggcccgactggctcgctcgccccggccttcgtggttttgccggcctcccggcggccgcacgcggggcaaagcgggctggcgggcaggtacagcgtccgggccgccgcctcctgccggccgcgcggagtggaggtcggggtgaggccctgcagaccccacgggacgggctgggaggagcgaggggccacggggggctcaggctgccctttcttttctttccccggccgcggcaaaccatccttccgcaatacccaccttcctgccaaactgagagtccagttttttgtcccattcctaacccttccctgtgcccgctcgggctgatgctgggttacactctctgcccgttccccttctgtt

SEQ ID NO: 103604 - DNA, 58 bp, Homo sapiens; identical to SEQ ID NO: 68509
  misc_feature 1..58: note = chr1:210405727-210405785
  misc_feature 1..58: note = Hyper
  source 1..58: mol_type = genomic DNA

SEQ ID NO: 103605 - DNA, 53 bp, Homo sapiens; identical to SEQ ID NO: 68510
  misc_feature 1..53: note = chr1:210406136-210406189
  misc_feature 1..53: note = Hyper
  source 1..53: mol_type = genomic DNA

SEQ ID NO: 103606 - DNA, 49 bp, Homo sapiens; identical to SEQ ID NO: 68511
  misc_feature 1..49: note = chr1:210406479-210406528
  misc_feature 1..49: note = Hyper
  source 1..49: mol_type = genomic DNA

SEQ ID NO: 103607 - DNA, 69 bp, Homo sapiens; identical to SEQ ID NO: 68515
  misc_feature 1..69: note = chr1:210465943-210466012
  misc_feature 1..69: note = Hyper
  source 1..69: mol_type = genomic DNA

SEQ ID NO: 103608 - DNA, 235 bp, Homo sapiens; identical to SEQ ID NO: 68517
  misc_feature 1..235: note = chr1:211306663-211306898
  misc_feature 1..235: note = Hyper
  source 1..235: mol_type = genomic DNA

SEQ ID NO: 103609 - DNA, 420 bp, Homo sapiens; identical to SEQ ID NO: 68518
  misc_feature 1..420: note = chr1:211307119-211307539
  misc_feature 1..420: note = Hyper
  source 1..420: mol_type = genomic DNA

SEQ ID NO: 103610 - DNA, 33 bp, Homo sapiens; identical to SEQ ID NO: 39234
  misc_feature 1..33: note = chr1:211430421-211430454
  misc_feature 1..33: note = Hypo
  source 1..33: mol_type = genomic DNA

SEQ ID NO: 103611 - DNA, 30 bp, Homo sapiens; identical to SEQ ID NO: 68520
  misc_feature 1..30: note = chr1:211504088-211504118
  misc_feature 1..30: note = Hypo
  source 1..30: mol_type = genomic DNA

SEQ ID NO: 103612 - DNA, 30 bp, Homo sapiens; identical to SEQ ID NO: 68521
  misc_feature 1..30: note = chr1:211847757-211847787
  misc_feature 1..30: note = Hypo
  source 1..30: mol_type = genomic DNA

SEQ ID NO: 103613 - DNA, 32 bp, Homo sapiens; identical to SEQ ID NO: 68522
  misc_feature 1..32: note = chr1:211871944-211871976
  misc_feature 1..32: note = Hyper
  source 1..32: mol_type = genomic DNA

SEQ ID NO: 103614 - DNA, 29 bp, Homo sapiens
  misc_feature 1..29: note = chr1:212004453-212004482
  misc_feature 1..29: note = Hyper
  source 1..29: mol_type = genomic DNA
acctgtctccttgacggctaaatgtccac

SEQ ID NO: 103615 - DNA, 17 bp, Homo sapiens
  misc_feature 1..17: note = chr1:212614848-212614865
  misc_feature 1..17: note = Hypo
  source 1..17: mol_type = genomic DNA
gggcatggtggctcacg

SEQ ID NO: 103616 - DNA, 292 bp, Homo sapiens; identical to SEQ ID NO: 68525
  misc_feature 1..292: note = chr1:212873974-212874266
  misc_feature 1..292: note = Hyper
  source 1..292: mol_type = genomic DNA

SEQ ID NO: 103617 - DNA, 96 bp, Homo sapiens; identical to SEQ ID NO: 68526
  misc_feature 1..96: note = chr1:212963883-212963979
  misc_feature 1..96: note = Hypo
  source 1..96: mol_type = genomic DNA

SEQ ID NO: 103618 - DNA, 1459 bp, Homo sapiens
  misc_feature 1..1459: note = chr1:213123589-213125048
  misc_feature 1..1459: note = Hyper
  source 1..1459: mol_type = genomic DNA
cgcggggtcacttctcgggtggttttgtttctcctctgcttccacagttgcaaaccctcgaagtgccacgacccctggggaaactcgatcttaagtcccatggccaaacgctccagcccgcggggctctcaggacaccacagcgatcggatttcgcgtggccgccaggctccccctactcctgtcccctcccgccagagaacccctggagccaatcagagcgtcgcggagcccggggttgtagagtcccgagcccgggacccgcccctctttgttgcggtggccaatagacgcattcggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggtaggatcttggagctgccgcgcgcccttcctgcgcgccgcccgcctgcagccagtccctcccggtgataggcgctggaactcggggaaaagggggcggatggagctctttccactagatccccgccggggtccgggagggcttcctggaagaaagcgggccgccttgcaagccaaggctgctgcagcgccctcgcgccagctctgggcgctcacatgccagcacgttcgtggctcccctcctctcttggccacatctgaggacccaggaatgtgtggagccttgcgggaacctcctgttccttcatgctacacaagctgtctttcttctccccacatcttgcgctccgcatcccccaagctccttgtgcccctccatccccaaccccccgggtttaggtgtgtgtgaagcttcgtggcacattttgagctgcctttctaggtaatcgcagggctggaagcccgtcatcgattctcagggaggctgtcagcgtgcaggggggagcggggagtgtcgtggagacactccgggacccctcactcggttccgctgtgcgtccacttagctgtggtgtcagctgtgtctccgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcgg

SEQ ID NO: 103619 - DNA, 180 bp, Homo sapiens; identical to SEQ ID NO: 39236
  misc_feature 1..180: note = chr1:213189664-213189844
  misc_feature 1..180: note = Hypo
  source 1..180: mol_type = genomic DNA

SEQ ID NO: 103620 - DNA, 101 bp, Homo sapiens; identical to SEQ ID NO: 39237
  misc_feature 1..101: note = chr1:213190144-213190245
  misc_feature 1..101: note = Hypo
  source 1..101: mol_type = genomic DNA

SEQ ID NO: 103621 - DNA, 80 bp, Homo sapiens; identical to SEQ ID NO: 68534
  misc_feature 1..80: note = chr1:214019656-214019736
  misc_feature 1..80: note = Hypo
  source 1..80: mol_type = genomic DNA

SEQ ID NO: 103622 - DNA, 1209 bp, Homo sapiens
  misc_feature 1..1209: note = chr1:214155741-214156950
  misc_feature 1..1209: note = Hyper
  source 1..1209: mol_type = genomic DNA
cttctcttttcgctgcgtcaggcaggcacctacttatttctagcccactcctcaccctgaataaaagcttctggtaagatggacaatatggaaaacttcagtcctatcaccaaagcccctgaaaatggagcacccccgaattcacatccttgacgtgaaagaccaaagagagggaagctgggagtaacggccaaacatccttagagtaattgacaaaagaaagggggtgggcagaaagggagatttccatcccttcaaacgtgcacgcccctcccgcggtcccgggagggagtcccccctcccaggtcgagcgcgtccaccggctgtccccacagcaacaggcgggcggcgggggaggagaggccgcgggggcagcgcaggcctggcggcggccgaaatcccccggccaccacgacgttccccggctctgcggcgcgccgggagcaggtggttgccctctgcgtccagggcgtgtactgagcccaggctagctgagcgaggctgcagcccctgcgatggcccgggaagaggcaagtgccgcggggccagagcgaggagggaccagcagggcggcctggacccccacttggccgcgcaggcaggaggggcgcgccctctgcggagcgcggcgccgcggcagccgcagcatctggcgctcgctctctctggccggagaggccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggaggtacacaggcacaccaggagggacagggcctcttgggaggcggctgagggcgtgaaggcagcaggcggccacacatccgaaagggactccctgcgagcgggatcgagcgcttaaaaccctgccacagcttggaagtgtagcggtgcccagaggctttgcgtaactttgcccactgcgcccccgcgtgcaaaggtgtccccttcacactcacaccctcaccccatctcactccccttgagttgcggcccgagactgcctttgtacttaagcgacagcaaaagata

SEQ ID NO: 103623 - DNA, 437 bp, Homo sapiens
  misc_feature 1..437: note = chr1:214158780-214159217
  misc_feature 1..437: note = Hyper
  source 1..437: mol_type = genomic DNA
cacggagctgggctgcgaaccgatctcgctcgcctagcgtggcgcgcgctcctatttcaagtcgccgctcctgcgccctaatgcgggctgcgaaccgccgcggcagagcgtcgcgagccgggagcctctgccgccgaggctgggggtgggagagcttccttgttcggcaagcgggttaccccgacttcgactcaggcctgcttttgcccacggcgtgacacaggacttactggggttctcagggaacttttcccgccgccagttcccgggcgtggtgtgtgcaaaacgtgcattcaagcgctatgtgcaattgacacaaacttgtgggctaaagtgcaagccatttttttcgcgtttgaatctttttctctgtccctgactcctttcttccccctactcccccctcctccttctctgctctccgcccttttaaatgt

SEQ ID NO: 103624 - DNA, 135 bp, Homo sapiens; identical to SEQ ID NO: 68541
  misc_feature 1..135: note = chr1:214159562-214159697
  misc_feature 1..135: note = Hyper
  source 1..135: mol_type = genomic DNA

SEQ ID NO: 103625 - DNA, 319 bp, Homo sapiens; identical to SEQ ID NO: 68543
  misc_feature 1..319: note = chr1:214160107-214160426
  misc_feature 1..319: note = Hyper
  source 1..319: mol_type = genomic DNA

SEQ ID NO: 103626 - DNA, 30 bp, Homo sapiens; identical to SEQ ID NO: 68544
  misc_feature 1..30: note = chr1:214162192-214162222
  misc_feature 1..30: note = Hyper
  source 1..30: mol_type = genomic DNA

SEQ ID NO: 103627 - DNA, 393 bp, Homo sapiens; identical to SEQ ID NO: 68545
  misc_feature 1..393: note = chr1:214162457-214162850
  misc_feature 1..393: note = Hyper
  source 1..393: mol_type = genomic DNA

SEQ ID NO: 103628 - DNA, 44 bp, Homo sapiens; identical to SEQ ID NO: 68546
  misc_feature 1..44: note = chr1:214193286-214193330
  misc_feature 1..44: note = Hypo
  source 1..44: mol_type = genomic DNA

SEQ ID NO: 103629 - DNA, 573 bp, Homo sapiens
  misc_feature 1..573: note = chr1:214360467-214361040
  misc_feature 1..573: note = Hyper
  source 1..573: mol_type = genomic DNA
gctgctgtaattctgcgatcccctgacgctggtatttgagaaacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagtggggagctggtgcccgctcgccgcggtcgcctcgcgggtcacagacaagagagcggcttgttttctctctgtcacatcgtcgtcttgaaccgtgtggtctgttgcaggggaaggggccgagctggaggagcgagcgggcgggcggcgcttggcacatcccgaagaacgctgcctcggttgcctgcgaacgctcagggcaggcgccaagggggcttcagggggacaggagcccgtgagaaaacttagctcgccgcgctctgctcagctctacccggctccgctctcaggcgtgtgctcagaacacaccgagatcctttagaaataaatgtaatcgagactaatctggaaatcgtccctgcagccaa

SEQ ID NO: 103630 - DNA, 148 bp, Homo sapiens; identical to SEQ ID NO: 68550
  misc_feature 1..148: note = chr1:214387629-214387777
  misc_feature 1..148: note = Hyper
  source 1..148: mol_type = genomic DNA

SEQ ID NO: 103631 - DNA, 73 bp, Homo sapiens; identical to SEQ ID NO: 68551
  misc_feature 1..73: note = chr1:214638017-214638090
  misc_feature 1..73: note = Hypo
  source 1..73: mol_type = genomic DNA

SEQ ID NO: 103632 - DNA, 39 bp, Homo sapiens; identical to SEQ ID NO: 68552
  misc_feature 1..39: note = chr1:214724448-214724487
  misc_feature 1..39: note = Hyper
  source 1..39: mol_type = genomic DNA

SEQ ID NO: 103633 - DNA, 43 bp, Homo sapiens; identical to SEQ ID NO: 68553
  misc_feature 1..43: note = chr1:214724743-214724786
  misc_feature 1..43: note = Hyper
  source 1..43: mol_type = genomic DNA

SEQ ID NO: 103634 - DNA, 348 bp, Homo sapiens; identical to SEQ ID NO: 68554
  misc_feature 1..348: note = chr1:214725213-214725561
  misc_feature 1..348: note = Hyper
  source 1..348: mol_type = genomic DNA

SEQ ID NO: 103635 - DNA, 1911 bp, Homo sapiens
  misc_feature 1..1911: note = chr1:215255060-215256971
  misc_feature 1..1911: note = Hyper
  source 1..1911: mol_type = genomic DNA
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtagggctaggaggaggtgcggggaagcaagccctggcggtgagacaggagggggaggaggcgaagaggagggagttccgaaaggagggaaacgagccggcaaggggcgacaggagcgagccgggaagggagagcagcggagggctgcagagctgcgggcgcccggaccgtgccacacaccccccgcggggcacggagggcattgcggggggagacacacaaagacatgcgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggccgtttcccatcttcgcttcgcgtccaaagtgttgggtcataatctggatttggaggcaaacccttgccagatcctctccacgccgcttctcccccctc

SEQ ID NO: 103636 - DNA, 17 bp, Homo sapiens
  misc_feature 1..17: note = chr1:215745270-215745287
  misc_feature 1..17: note = Hypo
  source 1..17: mol_type = genomic DNA
gccgagataaactttta

SEQ ID NO: 103637 - DNA, 30 bp, Homo sapiens; identical to SEQ ID NO: 68565
  misc_feature 1..30: note = chr1:216705663-216705693
  misc_feature 1..30: note = Hypo
  source 1..30: mol_type = genomic DNA

SEQ ID NO: 103638 - DNA, 32 bp, Homo sapiens; identical to SEQ ID NO: 68566
  misc_feature 1..32: note = chr1:216774823-216774855
  misc_feature 1..32: note = Hyper
  source 1..32: mol_type = genomic DNA

SEQ ID NO: 103639 - DNA, 113 bp, Homo sapiens; identical to SEQ ID NO: 68568
  misc_feature 1..113: note = chr1:216896454-216896567
  misc_feature 1..113: note = Hyper
  source 1..113: mol_type = genomic DNA

SEQ ID NO: 103640 - DNA, 87 bp, Homo sapiens; identical to SEQ ID NO: 5901
  misc_feature 1..87: note = chr1:216896887-216896974
  misc_feature 1..87: note = Hyper
  source 1..87: mol_type = genomic DNA

SEQ ID NO: 103641 - DNA, 30 bp, Homo sapiens; identical to SEQ ID NO: 68570
  misc_feature 1..30: note = chr1:216897216-216897246
  misc_feature 1..30: note = Hyper
  source 1..30: mol_type = genomic DNA

SEQ ID NO: 103642 - DNA, 373 bp, Homo sapiens; identical to SEQ ID NO: 68572
  misc_feature 1..373: note = chr1:217262983-217263356
  misc_feature 1..373: note = Hyper
  source 1..373: mol_type = genomic DNA

SEQ ID NO: 103643 - DNA, 30 bp, Homo sapiens; identical to SEQ ID NO: 68573
  misc_feature 1..30: note = chr1:217307206-217307236
  misc_feature 1..30: note = Hyper
  source 1..30: mol_type = genomic DNA

SEQ ID NO: 103644 - DNA, 1839 bp, Homo sapiens; identical to SEQ ID NO: 68574
  misc_feature 1..1839: note = chr1:217307467-217309306
  misc_feature 1..1839: note = Hyper
  source 1..1839: mol_type = genomic DNA

SEQ ID NO: 103645 - DNA, 590 bp, Homo sapiens; identical to SEQ ID NO: 68575
  misc_feature 1..590: note = chr1:217309653-217310243
  misc_feature 1..590: note = Hyper
  source 1..590: mol_type = genomic DNA

SEQ ID NO: 103646 - DNA, 1217 bp, Homo sapiens; identical to SEQ ID NO: 68576
  misc_feature 1..1217: note = chr1:217310819-217312036
  misc_feature 1..1217: note = Hyper
  source 1..1217: mol_type = genomic DNA

SEQ ID NO: 103647 - DNA, 800 bp, Homo sapiens
  misc_feature 1..800: note = chr1:217312947-217313747
  misc_feature 1..800: note = Hyper
  source 1..800: mol_type = genomic DNA
tgaaaatataaaggacgctaggcaagtgagcttgcggtaattatccctggatagagaaaccaatctggctgggagaggcccctctgcaattgccggcggcggcggcggtgcgcgggcccgcgcagaggccggggacttcgggcgcttgctaggtcaccgcgccgggcgaccgccgctcgccggctatttaatatacatggggtgggaacggagcgaagcggatctccgagcctgcctgtcctgcagaaaaaaaaaatcaatttgctatttatttttgaaatatatagatttagggaatgttttttccagctcgacccccttcaagaatggcggcccacatttaattacgtcttttaatgacttttcccttatttgccatcgctattccacgttaagggcgggggcggggtggagtttctttggggggttttcaattctggtatcttcaaaaagatttgccttatgtgttaattgcatgctgttaagcacatctgggactgtgtgctgaccaactcagaccaacttttaattaacacattgacccggagaagaagcagccgcccagcctccccctctaaatatgtatattagccacgcggaggcggctcggcccgcgccgccagatgcaagcaaggaattgcctgcgtcgaggggcgggagggggtgcaaattgcaacggttctctctctttctgtgagcgttttttctcgcctcacctctaggaaaacaacaaagaaaaagagtaaatgaccggctcctgaatcaggcttcttacatcctttaggcgtgacttgacccca

SEQ ID NO: 103648 - DNA, 197 bp, Homo sapiens; identical to SEQ ID NO: 68580
  misc_feature 1..197: note = chr1:217805039-217805236
  misc_feature 1..197: note = Hypo
  source 1..197: mol_type = genomic DNA

SEQ ID NO: 103649 - DNA, 2012 bp, Homo sapiens; identical to SEQ ID NO: 68582
  misc_feature 1..2012: note = chr1:218337322-218339334
  misc_feature 1..2012: note = Hyper
  source 1..2012: mol_type = genomic DNA

SEQ ID NO: 103650 - DNA, 30 bp, Homo sapiens; identical to SEQ ID NO: 68585
  misc_feature 1..30: note = chr1:218417045-218417075
  misc_feature 1..30: note = Hypo
  source 1..30: mol_type = genomic DNA

SEQ ID NO: 103651 - DNA, 30 bp, Homo sapiens; identical to SEQ ID NO: 68587
  misc_feature 1..30: note = chr1:218519769-218519799
  misc_feature 1..30: note = Hyper
  source 1..30: mol_type = genomic DNA

SEQ ID NO: 103652 - DNA, 543 bp, Homo sapiens
  misc_feature 1..543: note = chr1:218520108-218520651
  misc_feature 1..543: note = Hyper
  source 1..543: mol_type = genomic DNA
tacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcccgggatcgcccttccctctcgcggttcccgttcgctcttttcccgttctcctgtccttcaccccaccacctccttttcagttgtatgcttgaggccatcaggctttaaaatgtttactttctactttattttctccatctttcccttccccctaacaattcggtgctttaaaaggcgttattctcttttt

SEQ ID NO: 103653 - DNA, 30 bp, Homo sapiens; identical to SEQ ID NO: 39240
  misc_feature 1..30: note = chr1:219253291-219253321
  misc_feature 1..30: note = Hypo
  source 1..30: mol_type = genomic DNA

SEQ ID NO: 103654 - DNA, 330 bp, Homo sapiens; identical to SEQ ID NO: 68592
  misc_feature 1..330: note = chr1:219347186-219347516
  misc_feature 1..330: note = Hyper
  source 1..330: mol_type = genomic DNA

SEQ ID NO: 103655 - DNA, 30 bp, Homo sapiens; identical to SEQ ID NO: 68596
  misc_feature 1..30: note = chr1:220012557-220012587
  misc_feature 1..30: note = Hypo
  source 1..30: mol_type = genomic DNA

SEQ ID NO: 103656 - DNA, 1006 bp, Homo sapiens
  misc_feature 1..1006: note = chr1:220101049-220102055
  misc_feature 1..1006: note = Hyper
  source 1..1006: mol_type = genomic DNA
agaagaaaaagagggcgtggggtgagaagaaagggaccgggtgggaggaggaaggaagggccaagcggtccaaaggatgcaaccgaaaggcacctgctacgtttgcgaacacggtcgcccccttctcccgcttcctttccaccgaggtcccccggagggttacggccgagtccgagcctggggctgtcgggtccgccgcgcgccgcgggtcctccgcgccctgaggccccccgaaagcgccggggacacagccctccgccagctgctgccgctgctgcaggcggcgactgcgtccccggaggcagcacgcgaaccaggcggcgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccggcgctcaggcccacgcacagcgagatcaggtcggagagcatgttgaaggagtcggagagcagcgcgatggagttgcccaggtagccggagaccagctccgccacgaagaaggcgacggtgagcaccagcatgaagagcagccggcacgtcttgccagagtagcggcccatctcgccaccagccccgggcgcccggcgccgcccaggggagcgcagcccaccccgcgcgcagccacaggtggggggcgcggcgcggatccgtgaggcccggtacccgcctcccagattgtctcgccggccctgccccaccgctttttataacgcgaggccgagcgccaccagtccccgcacgtccagagtctaaaggagtggcgggggcagtatctgaacagcccgtgcaccgcctcccgcggcccttttcccctccctcgcggcctgggcctg

SEQ ID NO: 103657 - DNA, 277 bp, Homo sapiens
  misc_feature 1..277: note = chr1:220132215-220132492
  misc_feature 1..277: note = Hypo
  source 1..277: mol_type = genomic DNA
caaagtgggaaaggacggcaaaagcatcggaggccaaggagagggagttgccaacgtaagcgatcactagttccatcacaaagaggaggatgctaacgacgcacatgaggattaaacggaagcttcttccggagtatcgccccatggcgtctcggtgccctggcagttcctctccctttcttgggaaggctgagctgctagggaagcagctatagattcagtgattacaactcctgggtaactcttcccttcagccctccggcgcttgtcatatttg

SEQ ID NO: 103658 - DNA, 86 bp, Homo sapiens; identical to SEQ ID NO: 68601
  misc_feature 1..86: note = chr1:220552703-220552789
  misc_feature 1..86: note = Hypo
  source 1..86: mol_type = genomic DNA

SEQ ID NO: 103659 - DNA, 136 bp, Homo sapiens; identical to SEQ ID NO: 68602
  misc_feature 1..136: note = chr1:220636394-220636530
  misc_feature 1..136: note = Hypo
  source 1..136: mol_type = genomic DNA

SEQ ID NO: 103660 - DNA, 137 bp, Homo sapiens; identical to SEQ ID NO: 68603
  misc_feature 1..137: note = chr1:220700814-220700951
  misc_feature 1..137: note = Hyper
  source 1..137: mol_type = genomic DNA

SEQ ID NO: 103661 - DNA, 370 bp, Homo sapiens; identical to SEQ ID NO: 68604
  misc_feature 1..370: note = chr1:220702115-220702485
  misc_feature 1..370: note = Hyper
  source 1..370: mol_type = genomic DNA

SEQ ID NO: 103662 - DNA, 553 bp, Homo sapiens; identical to SEQ ID NO: 68605
  misc_feature 1..553: note = chr1:220863640-220864193
  misc_feature 1..553: note = Hyper
  source 1..553: mol_type = genomic DNA

SEQ ID NO: 103663 - DNA, 494 bp, Homo sapiens; identical to SEQ ID NO: 68607
  misc_feature 1..494: note = chr1:220921566-220922060
  misc_feature 1..494: note = Hyper
  source 1..494: mol_type = genomic DNA

SEQ ID NO: 103664 - DNA, 602 bp, Homo sapiens; identical to SEQ ID NO: 68608
  misc_feature 1..602: note = chr1:220960001-220960603
  misc_feature 1..602: note = Hyper
  source 1..602: mol_type = genomic DNA

SEQ ID NO: 103665 - DNA, 1937 bp, Homo sapiens
  misc_feature 1..1937: note = chr1:221051973-221053910
  misc_feature 1..1937: note = Hyper
  source 1..1937: mol_type = genomic DNA
cgctctcccgggtttcgggaggcagcctgttttgtagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagaggtaggtcttgggcgggaggctgcaggcctctgaccactgacccactccccggaccccgggctggcttggggtgcctttgagtgtttttacaattaaggacaaatcggtaaaacgggaga

SEQ ID NO: 103666 - DNA, 401 bp, Homo sapiens; identical to SEQ ID NO: 68611
  misc_feature 1..401: note = chr1:221067432-221067833
  misc_feature 1..401: note = Hyper
  source 1..401: mol_type = genomic DNA

SEQ ID NO: 103667 - DNA, 36 bp, Homo sapiens; identical to SEQ ID NO: 68612
  misc_feature 1..36: note = chr1:221176286-221176322
  misc_feature 1..36: note = Hypo
  source 1..36: mol_type = genomic DNA

SEQ ID NO: 103668 - DNA, 90 bp, Homo sapiens; identical to SEQ ID NO: 68613
  misc_feature 1..90: note = chr1:221252407-221252497
  misc_feature 1..90: note = Hypo
  source 1..90: mol_type = genomic DNA

SEQ ID NO: 103669 - DNA, 38 bp, Homo sapiens; identical to SEQ ID NO: 68614
  misc_feature 1..38: note = chr1:221320657-221320695
  misc_feature 1..38: note = Hypo
  source 1..38: mol_type = genomic DNA

SEQ ID NO: 103670 - DNA, 53 bp, Homo sapiens; identical to SEQ ID NO: 68617
  misc_feature 1..53: note = chr1:221706685-221706738
  misc_feature 1..53: note = Hypo
  source 1..53: mol_type = genomic DNA

SEQ ID NO: 103671 - DNA, 357 bp, Homo sapiens; identical to SEQ ID NO: 68618
  misc_feature 1..357: note = chr1:221914136-221914493
  misc_feature 1..357: note = Hyper
  source 1..357: mol_type = genomic DNA

SEQ ID NO: 103672 - DNA, 166 bp, Homo sapiens; identical to SEQ ID NO: 68619
  misc_feature 1..166: note = chr1:222210334-222210500
  misc_feature 1..166: note = Hypo
  source 1..166: mol_type = genomic DNA

SEQ ID NO: 103673 - DNA, 167 bp, Homo sapiens; identical to SEQ ID NO: 68620
  misc_feature 1..167: note = chr1:222279248-222279415
  misc_feature 1..167: note = Hypo
  source 1..167: mol_type = genomic DNA

SEQ ID NO: 103674 - DNA, 30 bp, Homo sapiens; identical to SEQ ID NO: 39244
  misc_feature 1..30: note = chr1:222391027-222391057
  misc_feature 1..30: note = Hypo
  source 1..30: mol_type = genomic DNA

SEQ ID NO: 103675 - DNA, 135 bp, Homo sapiens; identical to SEQ ID NO: 68622
  misc_feature 1..135: note = chr1:222794527-222794662
  misc_feature 1..135: note = Hypo
  source 1..135: mol_type = genomic DNA

SEQ ID NO: 103676 - DNA, 187 bp, Homo sapiens; identical to SEQ ID NO: 68623
  misc_feature 1..187: note = chr1:222987570-222987757
  misc_feature 1..187: note = Hypo
  source 1..187: mol_type = genomic DNA

SEQ ID NO: 103677 - DNA, 267 bp, Homo sapiens; identical to SEQ ID NO: 68624
  misc_feature 1..267: note = chr1:223302777-223303044
  misc_feature 1..267: note = Hyper
  source 1..267: mol_type = genomic DNA

SEQ ID NO: 103678 - DNA, 30 bp, Homo sapiens; identical to SEQ ID NO: 68626
  misc_feature 1..30: note = chr1:223361283-223361313
  misc_feature 1..30: note = Hypo
  source 1..30: mol_type = genomic DNA

SEQ ID NO: 103679 - DNA, 30 bp, Homo sapiens; identical to SEQ ID NO: 68627
  misc_feature 1..30: note = chr1:223376610-223376640
  misc_feature 1..30: note = Hypo
  source 1..30: mol_type = genomic DNA

SEQ ID NO: 103680 - DNA, 175 bp, Homo sapiens; identical to SEQ ID NO: 68629
  misc_feature 1..175: note = chr1:223536480-223536655
  misc_feature 1..175: note = Hyper
  source 1..175: mol_type = genomic DNA

SEQ ID NO: 103681 - DNA, 304 bp, Homo sapiens; identical to SEQ ID NO: 68630
  misc_feature 1..304: note = chr1:223537183-223537487
  misc_feature 1..304: note = Hyper
  source 1..304: mol_type = genomic DNA

SEQ ID NO: 103682 - DNA, 33 bp, Homo sapiens; identical to SEQ ID NO: 68631
  misc_feature 1..33: note = chr1:223537913-223537946
  misc_feature 1..33: note = Hyper
  source 1..33: mol_type = genomic DNA

SEQ ID NO: 103683 - DNA, 423 bp, Homo sapiens; identical to SEQ ID NO: 68632
  misc_feature 1..423: note = chr1:223538158-223538581
  misc_feature 1..423: note = Hyper
  source 1..423: mol_type = genomic DNA

SEQ ID NO: 103684 - DNA, 30 bp, Homo sapiens; identical to SEQ ID NO: 39246
  misc_feature 1..30: note = chr1:223841897-223841927
  misc_feature 1..30: note = Hypo
  source 1..30: mol_type = genomic DNA

SEQ ID NO: 103685 - DNA, 18 bp, Homo sapiens
  misc_feature 1..18: note = chr1:223899327-223899345
  misc_feature 1..18: note = Hypo
  source 1..18: mol_type = genomic DNA
tttgatatggagtttcgc

SEQ ID NO: 103686 - DNA, 189 bp, Homo sapiens; identical to SEQ ID NO: 39247
  misc_feature 1..189: note = chr1:223907491-223907680
  misc_feature 1..189: note = Hypo
  source 1..189: mol_type = genomic DNA

SEQ ID NO: 103687 - DNA, 176 bp, Homo sapiens; identical to SEQ ID NO: 68637
  misc_feature 1..176: note = chr1:223922172-223922348
  misc_feature 1..176: note = Hypo
  source 1..176: mol_type = genomic DNA

SEQ ID NO: 103688 - DNA, 25 bp, Homo sapiens
  misc_feature 1..25: note = chr1:223927954-223927979
  misc_feature 1..25: note = Hypo
  source 1..25: mol_type = genomic DNA
cttgttccctggtgccgtaaagaaa

SEQ ID NO: 103689 - DNA, 630 bp, Homo sapiens
  misc_feature 1..630: note = chr1:223936580-223937210
  misc_feature 1..630: note = Hyper
  source 1..630: mol_type = genomic DNA
ccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccgcggactcggaggccatcacgtttcagaagctggtgaaggggcacgcgtactcggtcaccggagccgaggaggtaacggccggcgcggatgtgcaggggtcctgctgtcctgacacgatggccacaggcacagtttgtggtgatgcccaggggcccgcgcggccccacggtggtccagtttacactcgggccccgcactcctgaagttccgcgcgggaggagaagggcgtccctttcgcagctcgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaa

SEQ ID NO: 103690 - DNA, 30 bp, Homo sapiens; identical to SEQ ID NO: 68641
  misc_feature 1..30: note = chr1:223990949-223990979
  misc_feature 1..30: note = Hypo
  source 1..30: mol_type = genomic DNA

SEQ ID NO: 103691 - DNA, 86 bp, Homo sapiens; identical to SEQ ID NO: 68642
  misc_feature 1..86: note = chr1:224072197-224072283
  misc_feature 1..86: note = Hypo
  source 1..86: mol_type = genomic DNA

SEQ ID NO: 103692 - DNA, 30 bp, Homo sapiens; identical to SEQ ID NO: 39248
  misc_feature 1..30: note = chr1:224232559-224232589
  misc_feature 1..30: note = Hypo
  source 1..30: mol_type = genomic DNA

SEQ ID NO: 103693 - DNA, 24 bp, Homo sapiens
  misc_feature 1..24: note = chr1:224251284-224251308
  misc_feature 1..24: note = Hypo
  source 1..24: mol_type = genomic DNA
gattacaggcgtgagccaccacgc

SEQ ID NO: 103694 - DNA, 120 bp, Homo sapiens; identical to SEQ ID NO: 68645
  misc_feature 1..120: note = chr1:224267382-224267502
  misc_feature 1..120: note = Hypo
  source 1..120: mol_type = genomic DNA

SEQ ID NO: 103695 - DNA, 159 bp, Homo sapiens; identical to SEQ ID NO: 68646
  misc_feature 1..159: note = chr1:224267802-224267961
  misc_feature 1..159: note = Hypo
  source 1..159: mol_type = genomic DNA

SEQ ID NO: 103696 - DNA, 29 bp, Homo sapiens
  misc_feature 1..29: note = chr1:224300927-224300956
  misc_feature 1..29: note = Hypo
  source 1..29: mol_type = genomic DNA
ggcgtgagtcaacacgcccagccttgtaa

SEQ ID NO: 103697 - DNA, 23 bp, Homo sapiens
  misc_feature 1..23: note = chr1:224361283-224361306
  misc_feature 1..23: note = Hypo
  source 1..23: mol_type = genomic DNA
tgagattccgtctcaaaaaaaag

SEQ ID NO: 103698 - DNA, 152 bp, Homo sapiens; identical to SEQ ID NO: 68649
  misc_feature 1..152: note = chr1:224386053-224386205
  misc_feature 1..152: note = Hypo
  source 1..152: mol_type = genomic DNA

SEQ ID NO: 103699 - DNA, 34 bp, Homo sapiens; identical to SEQ ID NO: 68650
  misc_feature 1..34: note = chr1:224400490-224400524
  misc_feature 1..34: note = Hypo
  source 1..34: mol_type = genomic DNA

SEQ ID NO: 103700 - DNA, 277 bp, Homo sapiens; identical to SEQ ID NO: 68652
  misc_feature 1..277: note = chr1:224528612-224528889
  misc_feature 1..277: note = Hyper
  source 1..277: mol_type = genomic DNA

SEQ ID NO: 103701 - DNA, 135 bp, Homo sapiens; identical to SEQ ID NO: 68654
  misc_feature 1..135: note = chr1:224803348-224803483
  misc_feature 1..135: note = Hyper
  source 1..135: mol_type = genomic DNA

SEQ ID NO: 103702 - DNA, 2119 bp, Homo sapiens
  misc_feature 1..2119: note = chr1:224803747-224805866
  misc_feature 1..2119: note = Hyper
  source 1..2119: mol_type = genomic DNA
agtccctgctccaaccggtcccgccccacctccgctcggcctccagccctgcttgtactgctggcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcccggctacctaaagactccttctctcgggaaagagcgctgcccggctctgggatttgggaggagctcggaggccgctcgggcacctcgctggacactatccgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgccggagcctgcgggaatccagcgcttattcgctgaccctcgagtcgcttcgctagctgtgcgccctcctgggcactagcctggagaggagcgtgcagacgcggctccttggagggagtgcggtcctctagggaggcatcgggctcctaggggcttcttggcgtgtgtggtgggattggggtccgccggccatggccttcactttcgctgcgttctgctacatgctgtctctggtgctgtgcgctgcgctcatcttcttcgccatctggcacgtgagtaacacgctttggtctctcttctttcgccccaatttcgctaaatttccccgatttcaccccactttttccaccttgcgggcgtgggcgaaccggaaggttggaccttctgccgctccactgtcccggggcaggaggcagttcgctgcatcccgccgggcgcgccttcggtgccctggctggaggcgaggggccgctggtgcccaggtaggacaccctctgcagggcccgactgggcgtcccgggtcccgggcgccggggagtggcggctacaaccacaactaaccccttcctctcccgccccgtcctctcctgccggcgggaggcgaaggagaagcgccgccgtcggtcccggcaattagtcaagtagctataataactaaacatttaaaatgtcagcatctgtggtgggttgcatttagatataattggagacaaagtggaaacacgacgggagcgccttgtaagaggtagggagaagccgagcccacggagaggaaggagaccaggcgatgggggtcgaagtggaaggcggtgggggaaaggcgagaaggagaagagcaaggaggcgagggagactgggaagggcaggcatcattaaggccatggaggaaagtcacgaagagagaccgtggagagcgacgacggtgtcctccatctgccctcttggcgtctgaagtccgactcctgaagaccccctgcaggtggcgaacctccgctaggcccccagcgtccccagcccacacaagcttcctgtcacccttcccggggctacgccaggtggagggcagccgtggatcccagttctttaggtgtgggtgggaatagaggagcgcaagcttctgaataggggaagagaagtactgagagagcgcgcaggagtgcgtacgccggtcctctcaaaga

SEQ ID NO: 103703 - DNA, 29 bp, Homo sapiens
  misc_feature 1..29: note = chr1:225113123-225113152
  misc_feature 1..29: note = Hypo
  source 1..29: mol_type = genomic DNA
aaatttgtggccaggcgccatggctcacg

SEQ ID NO: 103704 - DNA, 425 bp, Homo sapiens; identical to SEQ ID NO: 68661
  misc_feature 1..425: note = chr1:225117226-225117651
  misc_feature 1..425: note = Hyper
  source 1..425: mol_type = genomic DNA

SEQ ID NO: 103705 - DNA, 120 bp, Homo sapiens; identical to SEQ ID NO: 68662
  misc_feature 1..120: note = chr1:225118168-225118288
  misc_feature 1..120: note = Hypo
  source 1..120: mol_type = genomic DNA

SEQ ID NO: 103706 - DNA, 169 bp, Homo sapiens
  misc_feature 1..169: note = chr1:225632491-225632660
  misc_feature 1..169: note = Hyper
  source 1..169: mol_type = genomic DNA
caacagataacaaatcgacattgtcgtgcataaatgtagagctgatccgtatttcatgtcaaaggcctggactgtgtgaaattggctggtatttgttccagaagcacttgttcatgttgaagatggggcagttctgagtgggttagcaggctgacgagcttggctcaga

SEQ ID NO: 103707 - DNA, 121 bp, Homo sapiens; identical to SEQ ID NO: 14333
  misc_feature 1..121: note = chr1:226062878-226062999
  misc_feature 1..121: note = Hypo
  source 1..121: mol_type = genomic DNA

SEQ ID NO: 103708 - DNA, 36 bp, Homo sapiens; identical to SEQ ID NO: 68666
  misc_feature 1..36: note = chr1:226069474-226069510
  misc_feature 1..36: note = Hyper
  source 1..36: mol_type = genomic DNA

SEQ ID NO: 103709 - DNA, 30 bp, Homo sapiens; identical to SEQ ID NO: 68667
  misc_feature 1..30: note = chr1:226085269-226085299
  misc_feature 1..30: note = Hypo
  source 1..30: mol_type = genomic DNA

SEQ ID NO: 103710 - DNA, 90 bp, Homo sapiens; identical to SEQ ID NO: 68668
  misc_feature 1..90: note = chr1:226109616-226109706
  misc_feature 1..90: note = Hypo
  source 1..90: mol_type = genomic DNA

SEQ ID NO: 103711 - DNA, 99 bp, Homo sapiens; identical to SEQ ID NO: 68669
  misc_feature 1..99: note = chr1:226150253-226150352
  misc_feature 1..99: note = Hyper
  source 1..99: mol_type = genomic DNA

SEQ ID NO: 103712 - DNA, 86 bp, Homo sapiens; identical to SEQ ID NO: 39254
  misc_feature 1..86: note = chr1:226163129-226163215
  misc_feature 1..86: note = Hypo
  source 1..86: mol_type = genomic DNA

SEQ ID NO: 103713 - DNA, 30 bp, Homo sapiens; identical to SEQ ID NO: 39255
  misc_feature 1..30: note = chr1:226284013-226284043
  misc_feature 1..30: note = Hypo
  source 1..30: mol_type = genomic DNA

SEQ ID NO: 103714 - DNA, 127 bp, Homo sapiens; identical to SEQ ID NO: 39256
  misc_feature 1..127: note = chr1:226303892-226304019
  misc_feature 1..127: note = Hypo
  source 1..127: mol_type = genomic DNA

SEQ ID NO: 103715 - DNA, 146 bp, Homo sapiens; identical to SEQ ID NO: 68674
  misc_feature 1..146: note = chr1:226314896-226315042
  misc_feature 1..146: note = Hypo
  source 1..146: mol_type = genomic DNA

SEQ ID NO: 103716 - DNA, 1012 bp, Homo sapiens
  misc_feature 1..1012: note = chr1:226410992-226412004
  misc_feature 1..1012: note = Hyper
  source 1..1012: mol_type = genomic DNA
caggcaaggtgcttccgccgctcttaacggggatttgacccggagaagagagttctgtcgcctgcggcccgcgcacccgggcccctccgggctgcccctcccaggcaaatagtccttcggggatgtggattgcgccgtccgggcgggtgggcggggaagaacacggagggggccgggacccaagttcacgcctccctcctgcatcccgcagccggcggaagcgattattccccggcgtctggcggggccgggggcgggctcgcacccggaggagacacgggtctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtgagggcccgctgcgttcgcaagtgcgcgctggagcggaggcgctgcggactctaggtctggactgcgggctcctgaggccacacccgggacgttgcaggcacggtgcttcccctgaggctctgcgtactagactgaaatagggggtgatatcggcacctgctgcatagggtggttgcgaggcctgtgtgaaataatttaggcctgcactgaacgatttctctcatta

SEQ ID NO: 103717 - DNA, 43 bp, Homo sapiens; identical to SEQ ID NO: 39258
  misc_feature 1..43: note = chr1:226620644-226620687
  misc_feature 1..43: note = Hypo
  source 1..43: mol_type = genomic DNA

SEQ ID NO: 103718 - DNA, 16 bp, Homo sapiens
  misc_feature 1..16: note = chr1:226702271-226702287
  misc_feature 1..16: note = Hypo
  source 1..16: mol_type = genomic DNA
ccgataaacacaagag

SEQ ID NO: 103719 - DNA, 30 bp, Homo sapiens; identical to SEQ ID NO: 39259
  misc_feature 1..30: note = chr1:226725373-226725403
  misc_feature 1..30: note = Hypo
  source 1..30: mol_type = genomic DNA

SEQ ID NO: 103720 - DNA, 249 bp, Homo sapiens; identical to SEQ ID NO: 68682
  misc_feature 1..249: note = chr1:226735996-226736245
  misc_feature 1..249: note = Hyper
  source 1..249: mol_type = genomic DNA

SEQ ID NO: 103721 - DNA, 1021 bp, Homo sapiens; identical to SEQ ID NO: 68683
  misc_feature 1..1021: note = chr1:226736532-226737553
  misc_feature 1..1021: note = Hyper
  source 1..1021: mol_type = genomic DNA

SEQ ID NO: 103722 - DNA, 72 bp, Homo sapiens; identical to SEQ ID NO: 68684
  misc_feature 1..72: note = chr1:226737889-226737961
  misc_feature 1..72: note = Hyper
  source 1..72: mol_type = genomic DNA

SEQ ID NO: 103723 - DNA, 139 bp, Homo sapiens; identical to SEQ ID NO: 68685
  misc_feature 1..139: note = chr1:226816229-226816368
  misc_feature 1..139: note = Hypo
  source 1..139: mol_type = genomic DNA

SEQ ID NO: 103724 - DNA, 18 bp, Homo sapiens
  misc_feature 1..18: note = chr1:226816428-226816446
  misc_feature 1..18: note = Hypo
  source 1..18: mol_type = genomic DNA
ctccgtgacaactacaca

SEQ ID NO: 103725 - DNA, 37 bp, Homo sapiens; identical to SEQ ID NO: 68687
  misc_feature 1..37: note = chr1:226826631-226826668
  misc_feature 1..37: note = Hypo
  source 1..37: mol_type = genomic DNA

SEQ ID NO: 103726 - DNA, 54 bp, Homo sapiens; identical to SEQ ID NO: 68688
  misc_feature 1..54: note = chr1:226829338-226829392
  misc_feature 1..54: note = Hypo
  source 1..54: mol_type = genomic DNA

SEQ ID NO: 103727 - DNA, 300 bp, Homo sapiens; identical to SEQ ID NO: 68689
  misc_feature 1..300: note = chr1:226846358-226846658
  misc_feature 1..300: note = Hypo
  source 1..300: mol_type = genomic DNA

SEQ ID NO: 103728 - DNA, 82 bp, Homo sapiens; identical to SEQ ID NO: 68691
  misc_feature 1..82: note = chr1:226908374-226908456
  misc_feature 1..82: note = Hypo
  source 1..82: mol_type = genomic DNA

SEQ ID NO: 103729 - DNA, 887 bp, Homo sapiens
  misc_feature 1..887: note = chr1:226924772-226925659
  misc_feature 1..887: note = Hyper
  source 1..887: mol_type = genomic DNA
cctcttggcctcctccggccctggcggggagagggtaccggctgccaccacctgctgccggtcccctcgcaggcgaccagcccaacttgggctgctcacgctactgccgctgctgccgctgccactgccgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcccttcaaatcccaatcctaatactcgtctcgcggaccggcgagaag

SEQ ID NO: 103730 - DNA, 86 bp, Homo sapiens; identical to SEQ ID NO: 68694
  misc_feature 1..86: note = chr1:226926865-226926951
  misc_feature 1..86: note = Hyper
  source 1..86: mol_type = genomic DNA

SEQ ID NO: 103731 - DNA, 38 bp, Homo sapiens; identical to SEQ ID NO: 39263
  misc_feature 1..38: note = chr1:226954853-226954891
  misc_feature 1..38: note = Hypo
  source 1..38: mol_type = genomic DNA

SEQ ID NO: 103732 - DNA, 30 bp, Homo sapiens; identical to SEQ ID NO: 68696
  misc_feature 1..30: note = chr1:226972978-226973008
  misc_feature 1..30: note = Hypo
  source 1..30: mol_type = genomic DNA

SEQ ID NO: 103733 - DNA, 30 bp, Homo sapiens; identical to SEQ ID NO: 68699
  misc_feature 1..30: note = chr1:227163741-227163771
  misc_feature 1..30: note = Hypo
  source 1..30: mol_type = genomic DNA

SEQ ID NO: 103734 - DNA, 55 bp, Homo sapiens; identical to SEQ ID NO: 68700
  misc_feature 1..55: note = chr1:227174055-227174110
  misc_feature 1..55: note = Hypo
  source 1..55: mol_type = genomic DNA

SEQ ID NO: 103735 - DNA, 343 bp, Homo sapiens; identical to SEQ ID NO: 68703
  misc_feature 1..343: note = chr1:227505516-227505859
  misc_feature 1..343: note = Hyper
  source 1..343: mol_type = genomic DNA

SEQ ID NO: 103736 - DNA, 913 bp, Homo sapiens
  misc_feature 1..913: note = chr1:227729731-227730644
  misc_feature 1..913: note = Hyper
  source 1..913: mol_type = genomic DNA
cgcgcatgcgggagccgaggccgcagcactgggtgggcagctagctcaccgaagacccacgcagcgggccaggcgccagcggccgctaggtctgggcgcggggccgggccggcgagagaagggtccggggcacccagtgggctcggatctcgagcggtccccgtgacggccccgcgactgcgcgacttcccgctctagagagtttatggaccctgtcccaggagggctccgcagccgccagggaggtaccggagggaccgcggcgctgggagagggtggcgccaggcggccctggagccctgggcgacgcggccgggccggccagagggcggagaagtccaaagcagcagcccggacagccgcttccgcccctgcgccgccctcccggcccaggtgaccggtcgccctacccggggagcagcgccctcctcctcctgggccggagccgggcgtgggggtcgcaggctggtgccacagcctgaggacaccgcggcctctgccccggggagcacgccaaatgccggacggagcggctgttgcagacggtgaggccgcagccccgcttgagggtagggtcgggcggggtgtcggggtcctggcagaggccgcggcgagggcaggagccggtgcgctggccgctgcacatgcgccgcccggcaccgggaccctgcgggcgcgccccctggtggcagccagcgggaggtggcgtccctgtccccagccaggcggcagcgcgaagctgcctccccgcggggggagcggaagtggcccagctgctcgagtgacttactagttaaaaagctggggttggagctgccacgcggggaagtgtggaggcctgcggggctccgcctagactttctgggtgtcctcctgggacctcaggttcctcacctgtcgcagaggactgatg

SEQ ID NO: 103737 - DNA, 203 bp, Homo sapiens; identical to SEQ ID NO: 68707
  misc_feature 1..203: note = chr1:227750829-227751032
  misc_feature 1..203: note = Hypo
  source 1..203: mol_type = genomic DNA

SEQ ID NO: 103738 - DNA, 30 bp, Homo sapiens; identical to SEQ ID NO: 14336
  misc_feature 1..30: note = chr1:227921541-227921571
  misc_feature 1..30: note = Hypo
  source 1..30: mol_type = genomic DNA

SEQ ID NO: 103739 - DNA, 53 bp, Homo sapiens; identical to SEQ ID NO: 68710
  misc_feature 1..53: note = chr1:227921780-227921833
  misc_feature 1..53: note = Hypo
  source 1..53: mol_type = genomic DNA

SEQ ID NO: 103740 - DNA, 61 bp, Homo sapiens; identical to SEQ ID NO: 39268
  misc_feature 1..61: note = chr1:227926624-227926685
  misc_feature 1..61: note = Hypo
  source 1..61: mol_type = genomic DNA

SEQ ID NO: 103741 - DNA, 151 bp, Homo sapiens; identical to SEQ ID NO: 68712
  misc_feature 1..151: note = chr1:227955886-227956037
  misc_feature 1..151: note = Hypo
  source 1..151: mol_type = genomic DNA

SEQ ID NO: 103742 - DNA, 71 bp, Homo sapiens; identical to SEQ ID NO: 68713
  misc_feature 1..71: note = chr1:227975163-227975234
  misc_feature 1..71: note = Hyper
  source 1..71: mol_type = genomic DNA

SEQ ID NO: 103743 - DNA, 360 bp, Homo sapiens; identical to SEQ ID NO: 68714
  misc_feature 1..360: note = chr1:227976261-227976621
  misc_feature 1..360: note = Hyper
  source 1..360: mol_type = genomic DNA

SEQ ID NO: 103744 - DNA, 30 bp, Homo sapiens; identical to SEQ ID NO: 68715
  misc_feature 1..30: note = chr1:228071573-228071603
  misc_feature 1..30: note = Hypo
  source 1..30: mol_type = genomic DNA

SEQ ID NO: 103745 - DNA, 43 bp, Homo sapiens; identical to SEQ ID NO: 68716
  misc_feature 1..43: note = chr1:228074452-228074495
  misc_feature 1..43: note = Hyper
  source 1..43: mol_type = genomic DNA

SEQ ID NO: 103746 - DNA, 375 bp, Homo sapiens; identical to SEQ ID NO: 68717
  misc_feature 1..375: note = chr1:228074787-228075162
  misc_feature 1..375: note = Hyper
  source 1..375: mol_type = genomic DNA

SEQ ID NO: 103747 - DNA, 153 bp, Homo sapiens; identical to SEQ ID NO: 68718
  misc_feature 1..153: note = chr1:228082129-228082282
  misc_feature 1..153: note = Hypo
  source 1..153: mol_type = genomic DNA

SEQ ID NO: 103748 - DNA, 221 bp, Homo sapiens; identical to SEQ ID NO: 39270
  misc_feature 1..221: note = chr1:228083399-228083620
  misc_feature 1..221: note = Hypo
  source 1..221: mol_type = genomic DNA

SEQ ID NO: 103749 - DNA, 30 bp, Homo sapiens; identical to SEQ ID NO: 68720
  misc_feature 1..30: note = chr1:228092133-228092163
  misc_feature 1..30: note = Hypo
  source 1..30: mol_type = genomic DNA

SEQ ID NO: 103750 - DNA, 47 bp, Homo sapiens; identical to SEQ ID NO: 68721
  misc_feature 1..47: note = chr1:228117865-228117912
  misc_feature 1..47: note = Hypo
  source 1..47: mol_type = genomic DNA

SEQ ID NO: 103751 - DNA, 30 bp, Homo sapiens; identical to SEQ ID NO: 68722
  misc_feature 1..30: note = chr1:228126165-228126195
  misc_feature 1..30: note = Hypo
  source 1..30: mol_type = genomic DNA

SEQ ID NO: 103752 - DNA, 200 bp, Homo sapiens; identical to SEQ ID NO: 68723
  misc_feature 1..200: note = chr1:228134691-228134891
  misc_feature 1..200: note = Hyper
  source 1..200: mol_type = genomic DNA

SEQ ID NO: 103753 - DNA, 614 bp, Homo sapiens
  misc_feature 1..614: note = chr1:228135107-228135721
  misc_feature 1..614: note = Hyper
  source 1..614: mol_type = genomic DNA
aagctgctaggtgggcgatggccaggggctgaggactcaggctccagccttttggcaaggacacggcggcccaaggaagtcgggacctgatcccagtccctaagcgcgaggcagtcctgctcacggcggcgactacgacgacgacgactctgcggtcacggaggaccgcggcccggcgcaagccggacgggtccacccgcctctctagccgtgccgcgcagcggacggagcgacgcgcgcgccgcaaacaaacagcgccaggcaacccggcggccccgccgcgccccggccccagccaccccgggtgcctcggggactccggacgaccccgccccggccccgccgcccccgcccaccagtgcgcgccggccgccgaaggcacctacccgaagtaggcggccgaagggcgcagcgcggcgagcagcagcgtcagcccgaaggccgcggccagccagcgcgccagcggggacccatccagcatcttgccgcgcctcggcggccgaccatcgcgctcccagctccgcgcagggcgcgccgcggccgccgccctcttatagcgcccggagcgcggccagctgggcccggccccgccccgcgcccgggaggggatcacg

SEQ ID NO: 103754 - DNA, 46 bp, Homo sapiens; identical to SEQ ID NO: 68726
  misc_feature 1..46: note = chr1:228136106-228136152
  misc_feature 1..46: note = Hyper
  source 1..46: mol_type = genomic DNA

SEQ ID NO: 103755 - DNA, 30 bp, Homo sapiens; identical to SEQ ID NO: 68727
  misc_feature 1..30: note = chr1:228136517-228136547
  misc_feature 1..30: note = Hyper
  source 1..30: mol_type = genomic DNA

SEQ ID NO: 103756 - DNA, 30 bp, Homo sapiens; identical to SEQ ID NO: 68728
  misc_feature 1..30: note = chr1:228193886-228193916
  misc_feature 1..30: note = Hyper
  source 1..30: mol_type = genomic DNA

SEQ ID NO: 103757 - DNA, 2443 bp, Homo sapiens
  misc_feature 1..2443: note = chr1:228194126-228196569
  misc_feature 1..2443: note = Hyper
  source 1..2443: mol_type = genomic DNA
cagctctggtctcagcggaaggagtccggccgcaggcagacggggccaaaggacgtgcacccgacaaccgtccgctccctccccaaacccccgccccgagaaggttgatggatgaaggggagccctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggccggccgcctgcccatctggcgcaccccagcgcgccgcgcacacctgggggcccgcacaccagcacgtcctcagacacaccgacacccacggcagcaggcgggggccaacgccgccgccgcggttcgggctcccgtggccccgcctgcccctgcctgccccgcccgggccccggccccggcgggcgccccccgcggcgctgccccgcccccgccgccccgcgccgccccgggcctcggcccgcagcccggccgccggcccacctggcgcagcgccgccctcggagcccgcgcacacccgcgcacccgcggccgcaggagggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatctttgtcttgtcggccctgagggttcctagcctcggtccccatccacc

SEQ ID NO: 103758 - DNA, 102 bp, Homo sapiens; identical to SEQ ID NO: 68731
  misc_feature 1..102: note = chr1:228201221-228201323
  misc_feature 1..102: note = Hypo
  source 1..102: mol_type = genomic DNA

SEQ ID NO: 103759 - DNA, 413 bp, Homo sapiens; identical to SEQ ID NO: 68732
  misc_feature 1..413: note = chr1:228225526-228225939
  misc_feature 1..413: note = Hyper
  source 1..413: mol_type = genomic DNA

SEQ ID NO: 103760 - DNA, 79 bp, Homo sapiens; identical to SEQ ID NO: 68733
  misc_feature 1..79: note = chr1:228238495-228238574
  misc_feature 1..79: note = Hypo
  source 1..79: mol_type = genomic DNA

SEQ ID NO: 103761 - DNA, 38 bp, Homo sapiens; identical to SEQ ID NO: 68734
  misc_feature 1..38: note = chr1:228247050-228247088
  misc_feature 1..38: note = Hyper
  source 1..38: mol_type = genomic DNA

SEQ ID NO: 103762 - DNA, 30 bp, Homo sapiens; identical to SEQ ID NO: 68735
  misc_feature 1..30: note = chr1:228247856-228247886
  misc_feature 1..30: note = Hyper
  source 1..30: mol_type = genomic DNA

SEQ ID NO: 103763 - DNA, 497 bp, Homo sapiens; identical to SEQ ID NO: 68736
  misc_feature 1..497: note = chr1:228248302-228248799
  misc_feature 1..497: note = Hyper
  source 1..497: mol_type = genomic DNA

SEQ ID NO: 103764 - DNA, 30 bp, Homo sapiens; identical to SEQ ID NO: 68737
  misc_feature 1..30: note = chr1:228264825-228264855
  misc_feature 1..30: note = Hypo
  source 1..30: mol_type = genomic DNA

SEQ ID NO: 103765 - DNA, 30 bp, Homo sapiens; identical to SEQ ID NO: 68738
  misc_feature 1..30: note = chr1:228322401-228322431
  misc_feature 1..30: note = Hypo
  source 1..30: mol_type = genomic DNA

SEQ ID NO: 103766 - DNA, 78 bp, Homo sapiens; identical to SEQ ID NO: 68739
  misc_feature 1..78: note = chr1:228331863-228331941
  misc_feature 1..78: note = Hypo
  source 1..78: mol_type = genomic DNA

SEQ ID NO: 103767 - DNA, 30 bp, Homo sapiens; identical to SEQ ID NO: 39274
  misc_feature 1..30: note = chr1:228342820-228342850
  misc_feature 1..30: note = Hypo
  source 1..30: mol_type = genomic DNA

SEQ ID NO: 103768 - DNA, 30 bp, Homo sapiens; identical to SEQ ID NO: 68741
  misc_feature 1..30: note = chr1:228343136-228343166
  misc_feature 1..30: note = Hypo
  source 1..30: mol_type = genomic DNA

SEQ ID NO: 103769 - DNA, 163 bp, Homo sapiens; identical to SEQ ID NO: 68742
  misc_feature 1..163: note = chr1:228397736-228397899
  misc_feature 1..163: note = Hypo
  source 1..163: mol_type = genomic DNA

SEQ ID NO: 103770 - DNA, 72 bp, Homo sapiens; identical to SEQ ID NO: 68743
  misc_feature 1..72: note = chr1:228398961-228399033
  misc_feature 1..72: note = Hypo
  source 1..72: mol_type = genomic DNA

SEQ ID NO: 103771 - DNA, 66 bp, Homo sapiens; identical to SEQ ID NO: 68744
  misc_feature 1..66: note = chr1:228400877-228400943
  misc_feature 1..66: note = Hyper
  source 1..66: mol_type = genomic DNA

SEQ ID NO: 103772 - DNA, 30 bp, Homo sapiens; identical to SEQ ID NO: 68745
  misc_feature 1..30: note = chr1:228444438-228444468
  misc_feature 1..30: note = Hypo
  source 1..30: mol_type = genomic DNA

SEQ ID NO: 103773 - DNA, 700 bp, Homo sapiens; identical to SEQ ID NO: 68746
  misc_feature 1..700: note = chr1:228463170-228463870
  misc_feature 1..700: note = Hyper
  source 1..700: mol_type = genomic DNA

SEQ ID NO: 103774 - DNA, 30 bp, Homo sapiens; identical to SEQ ID NO: 39275
  misc_feature 1..30: note = chr1:228466507-228466537
  misc_feature 1..30: note = Hypo
  source 1..30: mol_type = genomic DNA

SEQ ID NO: 103775 - DNA, 30 bp, Homo sapiens; identical to SEQ ID NO: 68748
  misc_feature 1..30: note = chr1:228473902-228473932
  misc_feature 1..30: note = Hypo
  source 1..30: mol_type = genomic DNA

SEQ ID NO: 103776 - DNA, 206 bp, Homo sapiens; identical to SEQ ID NO: 68749
  misc_feature 1..206: note = chr1:228495816-228496022
  misc_feature 1..206: note = Hypo
  source 1..206: mol_type = genomic DNA

SEQ ID NO: 103777 - DNA, 47 bp, Homo sapiens; identical to SEQ ID NO: 68750
  misc_feature 1..47: note = chr1:228501386-228501433
  misc_feature 1..47: note = Hypo
  source 1..47: mol_type = genomic DNA

SEQ ID NO: 103778 - DNA, 35 bp, Homo sapiens; identical to SEQ ID NO: 68751
  misc_feature 1..35: note = chr1:228502582-228502617
  misc_feature 1..35: note = Hypo
  source 1..35: mol_type = genomic DNA

SEQ ID NO: 103779 - DNA, 293 bp, Homo sapiens; identical to SEQ ID NO: 68752
  misc_feature 1..293: note = chr1:228504399-228504692
  misc_feature 1..293: note = Hypo
  source 1..293: mol_type = genomic DNA

SEQ ID NO: 103780 - DNA, 591 bp, Homo sapiens; identical to SEQ ID NO: 68753
  misc_feature 1..591: note = chr1:228528791-228529382
  misc_feature 1..591: note = Hypo
  source 1..591: mol_type = genomic DNA

SEQ ID NO: 103781 - DNA, 30 bp, Homo sapiens; identical to SEQ ID NO: 68754
  misc_feature 1..30: note = chr1:228533007-228533037
  misc_feature 1..30: note = Hypo
  source 1..30: mol_type = genomic DNA

SEQ ID NO: 103782 - DNA, 94 bp, Homo sapiens; identical to SEQ ID NO: 68755
  misc_feature 1..94: note = chr1:228536497-228536591
  misc_feature 1..94: note = Hypo
  source 1..94: mol_type = genomic DNA

SEQ ID NO: 103783 - DNA, 30 bp, Homo sapiens; identical to SEQ ID NO: 14339
  misc_feature 1..30: note = chr1:228552593-228552623
  misc_feature 1..30: note = Hypo
  source 1..30: mol_type = genomic DNA

SEQ ID NO: 103784 - DNA, 33 bp, Homo sapiens; identical to SEQ ID NO: 68757
  misc_feature 1..33: note = chr1:228554180-228554213
  misc_feature 1..33: note = Hypo
  source 1..33: mol_type = genomic DNA

SEQ ID NO: 103785 - DNA, 172 bp, Homo sapiens; identical to SEQ ID NO: 68758
  misc_feature 1..172: note = chr1:228554797-228554969
  misc_feature 1..172: note = Hypo
  source 1..172: mol_type = genomic DNA

SEQ ID NO: 103786 - DNA, 865 bp, Homo sapiens; identical to SEQ ID NO: 68759
  misc_feature 1..865: note = chr1:228558699-228559564
  misc_feature 1..865: note = Hypo
  source 1..865: mol_type = genomic DNA

SEQ ID NO: 103787 - DNA, 32 bp, Homo sapiens; identical to SEQ ID NO: 68760
  misc_feature 1..32: note = chr1:228560007-228560039
  misc_feature 1..32: note = Hypo
  source 1..32: mol_type = genomic DNA

SEQ ID NO: 103788 - DNA, 45 bp, Homo sapiens; identical to SEQ ID NO: 26914
  misc_feature 1..45: note = chr1:228566475-228566520
  misc_feature 1..45: note = Hyper
  source 1..45: mol_type = genomic DNA

SEQ ID NO: 103789 - DNA, 246 bp, Homo sapiens; identical to SEQ ID NO: 68762
  misc_feature 1..246: note = chr1:228566723-228566969
  misc_feature 1..246: note = Hyper
  source 1..246: mol_type = genomic DNA

SEQ ID NO: 103790 - DNA, 1013 bp, Homo sapiens
  misc_feature 1..1013: note = chr1:228603596-228604609
  misc_feature 1..1013: note = Hyper
  source 1..1013: mol_type = genomic DNA
cacagatgcacatatcggtaaacatacatgcatgtacacacaggtacacgcgcgcacacacgcacaggcacacaagcatgcacatagatgccccctgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacccggcgccagccctccgactccccccaagagccctaacggaggcacccagcccaccctgaccgaagccgggcagggacagcggcagcgggcctggggctctggctctggctgccgggatggctgtccttcccgctctggtccgctagggtcccggtagagttaccttgttgaagcgcgctagcccctccagggacgcggcggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtct

SEQ ID NO: 103791 - DNA, 774 bp, Homo sapiens
  misc_feature 1..774: note = chr1:228633487-228634261
  misc_feature 1..774: note = Hyper
  source 1..774: mol_type = genomic DNA
aaggcgcctgtcactcgtcactctccacgcgggctggctctggaaagcccaaaggaaaaaaccctcactttcaggaagaataagcctcagcccatgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatccccggcttctctgcagctgtacaccctgcactgcggcgccccccagtcccgctgtccgctccatcgcgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagact

SEQ ID NO: 103792 - DNA, 990 bp, Homo sapiens
  misc_feature 1..990: note = chr1:228644901-228645891
  misc_feature 1..990: note = Hyper
  source 1..990: mol_type = genomic DNA
acacgttgcccacctcgcaagtatgcagcccaatcagtccccagggtctcggttcccgttgcgcccttccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcctcgtcgttgcggatggccagctgcaggtggcgcgggatgatgcgcgtcttcttgttgtcgcgcgccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcacca

SEQ ID NO: 103793 - DNA, 360 bp, Homo sapiens; identical to SEQ ID NO: 68770
  misc_feature 1..360: note = chr1:228646191-228646551
  misc_feature 1..360: note = Hyper
  source 1..360: mol_type = genomic DNA

SEQ ID NO: 103794 - DNA, 90 bp, Homo sapiens; identical to SEQ ID NO: 68771
  misc_feature 1..90: note = chr1:228646851-228646941
  misc_feature 1..90: note = Hyper
  source 1..90: mol_type = genomic DNA

SEQ ID NO: 103795 - DNA, 123 bp, Homo sapiens; identical to SEQ ID NO: 68772
  misc_feature 1..123: note = chr1:228647194-228647317
  misc_feature 1..123: note = Hyper
  source 1..123: mol_type = genomic DNA

SEQ ID NO: 103796 - DNA, 688 bp, Homo sapiens
  misc_feature 1..688: note = chr1:228651254-228651942
  misc_feature 1..688: note = Hyper
  source 1..688: mol_type = genomic DNA
tttgggggtaaaatacgagaatcccttaattggggaaattttagctgagtgataaggagatctgtgagcctgctgttttgatgtttcaagcaggaaggcgtggcataaagagctgcttaggcgcaacgctgctgaaatggttttggctagaagctcacagtgtctagttgtggctaaggagggaggaaaggggcgggagaagaacggacccaagcgcctccgcccagacggcgcgataaccccctcacctccaaccccggacctcagtgagcacgtcctccagtctcagccgccaggaggcactgggggcggggacgtggcacaagatcttcccggaggtgacccacgctcctcgcgcgcagggcgtaagccacacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaaaagagcctttgggttcggggcgccgggacgcacctcacttggagctggtgtacttggtgacag

SEQ ID NO: 103797 - DNA, 387 bp, Homo sapiens
  misc_feature 1..387: note = chr1:228652242-228652629
  misc_feature 1..387: note = Hyper
  source 1..387: mol_type = genomic DNA
gccttcttggagccctttttagaagccggagccgcccgcgatggctccggcatggcgaggtgacaagagcgcctagacgaacgcggatgcggggccggcagggctatttgccatctttatattcaaattaaggctccaaatttgtagtgtctgattggacggcctgactccgcggccgccactgggaggaatttctgtaaatagcagagtccggttcttctttcctattggacggcggtccaaccaatcccaaggcatatccgccgcgcgccggagctgaggttgcgcatctttgttcaaagcctttgttttaaacctggagatttttgtgtctgcagcggatctggaggtagctaaagagaaactgaaaaacggttgcaaccccaa

SEQ ID NO: 103798 - DNA, 30 bp, Homo sapiens; identical to SEQ ID NO: 68776
  misc_feature 1..30: note = chr1:228671304-228671334
  misc_feature 1..30: note = Hypo
  source 1..30: mol_type = genomic DNA

SEQ ID NO: 103799 - DNA, 134 bp, Homo sapiens; identical to SEQ ID NO: 68777
  misc_feature 1..134: note = chr1:228677767-228677901
  misc_feature 1..134: note = Hypo
  source 1..134: mol_type = genomic DNA

SEQ ID NO: 103800 - DNA, 94 bp, Homo sapiens; identical to SEQ ID NO: 68778
  misc_feature 1..94: note = chr1:228870805-228870899
  misc_feature 1..94: note = Hyper
  source 1..94: mol_type = genomic DNA

SEQ ID NO: 103801 - DNA, 369 bp, Homo sapiens; identical to SEQ ID NO: 68779
  misc_feature 1..369: note = chr1:228871227-228871596
  misc_feature 1..369: note = Hyper
  source 1..369: mol_type = genomic DNA

SEQ ID NO: 103802 - DNA, 46 bp, Homo sapiens; identical to SEQ ID NO: 39283
  misc_feature 1..46: note = chr1:228919370-228919416
  misc_feature 1..46: note = Hypo
  source 1..46: mol_type = genomic DNA

SEQ ID NO: 103803 - DNA, 30 bp, Homo sapiens; identical to SEQ ID NO: 68790
  misc_feature 1..30: note = chr1:229354058-229354088
  misc_feature 1..30: note = Hypo
  source 1..30: mol_type = genomic DNA

SEQ ID NO: 103804 - DNA, 748 bp, Homo sapiens
  misc_feature 1..748: note = chr1:229542788-229543536
  misc_feature 1..748: note = Hyper
  source 1..748: mol_type = genomic DNA
cccgccctggtctctcggtttagttcatgctgaggttggtcgcttgtttcattcactgtctcctacgcagtccatgccacgggggataagtttttcacaagtggctttttttccccacagtgaagagacgtggcctgggtctggagttcctcaaccggcaaaatacgacgtgaacagctcctgcacccaaaaaggccccgagttaactctgctgcataggcgaggcaggcaccgcgccgccagtcggggacgcagagcgagcgcgtcctctgggatttgaaggccgcccccgtcaaagttggcattcgggggcctgcgtgttccggagctacggagcggcaactgaggcaggagctcaggactggggggagaaagagagaccctggaagcgattaacgtgccccttgctttacagatgtggcagataagacacgagagggagctctggtccccgaggggctgtcccgggagggagcgaggtggggagggggagcaggccctgccccgagcaccccgcggactgagcgtctggcgtgcacggcggaggggttaccgcggggaggtgacaccccagggtggtgagggcacgcagatgaggctggcctgaggggtgcctgctttggggaaagcagtctgtggagggagggaaggagggcgatcgcggccccacgcgggttgtgctgctgaggctccgcgccgcaggaaaggcaccctagccggattcgccctcggacgccccagctgggca

SEQ ID NO: 103805 - DNA, 257 bp, Homo sapiens; identical to SEQ ID NO: 26933
  misc_feature 1..257: note = chr1:229566603-229566860
  misc_feature 1..257: note = Hyper
  source 1..257: mol_type = genomic DNA

SEQ ID NO: 103806 - DNA, 1287 bp, Homo sapiens
  misc_feature 1..1287: note = chr1:229567087-229568374
  misc_feature 1..1287: note = Hyper
  source 1..1287: mol_type = genomic DNA
gttaatgtatgtacacgttataaacactgtgtcagtttacgatggcagcaacggaagttgttacaaagaaagtgactgcggggtggctggagctcagccgcccccccattgagaagattcgtcgtcctgagaagtcgcgtgctggaggtggagtgtgtctagaagcatttgcggtggacgatggaagggccggcctcgtcgtactcctgcttggtgatccacatctgctggaaggtggacagcgaggccaggatggagccgccgatccacaccgagtatttgcgctccggcggggcgatgatctgcaagacagcgcgtgaggtggggagacctcaccctggagcccaccccgccgacagcccgcgcaggccaccacccaccttgatcttcatggtgctgggtgccagcgcggtgatctctttctgcatgcggtcagcgatcccagggtacatcgtggtgccccccgacatgacgttgttggcatacaggtccttcctgatgtcgatgtcacacttcatgatgctgttgtaggtggtctcgtgaatgcccgccgactccatacctggggaccgcggcggggagcgtgagcagaagctcggggcgccgggggccggcggggcctgggggccggggcgagggcgagcggggctcaccgatgaaggagggctggaagagcgtctccgggcagcggaagcgctcgttgccgatggtgatgacctgcccgtctggcagctcgtagctcttttccagggaggaggaggaggcggccgtcgccatctcgttctcgaagtccagggccacgtagcacagcttctccttgatgtcgcgcacgatctcgcgctcagctgcggagggcagaagcaggagaggagccctcactcaggggccgccgccggccctcccgcccggggtgcaggggcgccgcgcacctgtggtcacgaaggagtagccacgctcagtgaggatcttcatcaggtagtcggtgagatcgcggcccgccaggtccaggcgcatgatggcgtgcggcagcgcgtagccctcataaatgggcacgttgtgggtgacgccgtcgccggagtccagcacgatgcctgtgcgcgcgcgggagagagtgagtggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggccacgtacatggcgggcacgttgaagg

SEQ ID NO: 103807 - DNA, 1128 bp, Homo sapiens; identical to SEQ ID NO: 26937
  misc_feature 1..1128: note = chr1:229569458-229570586
  misc_feature 1..1128: note = Hyper
  source 1..1128: mol_type = genomic DNA

SEQ ID NO: 103808 - DNA, 33 bp, Homo sapiens; identical to SEQ ID NO: 68798
  misc_feature 1..33: note = chr1:229706004-229706037
  misc_feature 1..33: note = Hypo
  source 1..33: mol_type = genomic DNA

SEQ ID NO: 103809 - DNA, 30 bp, Homo sapiens; identical to SEQ ID NO: 68799
  misc_feature 1..30: note = chr1:229764690-229764720
  misc_feature 1..30: note = Hypo
  source 1..30: mol_type = genomic DNA

SEQ ID NO: 103810 - DNA, 30 bp, Homo sapiens; identical to SEQ ID NO: 68800
  misc_feature 1..30: note = chr1:229911522-229911552
  misc_feature 1..30: note = Hypo
  source 1..30: mol_type = genomic DNA

SEQ ID NO: 103811 - DNA, 150 bp, Homo sapiens; identical to SEQ ID NO: 68801
  misc_feature 1..150: note = chr1:230080008-230080158
  misc_feature 1..150: note = Hypo
  source 1..150: mol_type = genomic DNA

SEQ ID NO: 103812 - DNA, 64 bp, Homo sapiens; identical to SEQ ID NO: 39285
  misc_feature 1..64: note = chr1:230107209-230107273
  misc_feature 1..64: note = Hypo
  source 1..64: mol_type = genomic DNA

SEQ ID NO: 103813 - DNA, 30 bp, Homo sapiens; identical to SEQ ID NO: 26938
  misc_feature 1..30: note = chr1:230240615-230240645
  misc_feature 1..30: note = Hyper
  source 1..30: mol_type = genomic DNA

SEQ ID NO: 103814 - DNA, 132 bp, Homo sapiens; identical to SEQ ID NO: 68805
  misc_feature 1..132: note = chr1:230404233-230404365
  misc_feature 1..132: note = Hypo
  source 1..132: mol_type = genomic DNA

SEQ ID NO: 103815 - DNA, 72 bp, Homo sapiens; identical to SEQ ID NO: 39287
  misc_feature 1..72: note = chr1:230423782-230423854
  misc_feature 1..72: note = Hypo
  source 1..72: mol_type = genomic DNA

SEQ ID NO: 103816 - DNA, 176 bp, Homo sapiens; identical to SEQ ID NO: 68807
  misc_feature 1..176: note = chr1:230424479-230424655
  misc_feature 1..176: note = Hypo
  source 1..176: mol_type = genomic DNA

SEQ ID NO: 103817 - DNA, 65 bp, Homo sapiens; identical to SEQ ID NO: 68809
  misc_feature 1..65: note = chr1:230453297-230453362
  misc_feature 1..65: note = Hypo
  source 1..65: mol_type = genomic DNA

SEQ ID NO: 103818 - DNA, 73 bp, Homo sapiens; identical to SEQ ID NO: 68810
  misc_feature 1..73: note = chr1:230453632-230453705
  misc_feature 1..73: note = Hypo
  source 1..73: mol_type = genomic DNA

SEQ ID NO: 103819 - DNA, 54 bp, Homo sapiens; identical to SEQ ID NO: 68811
  misc_feature 1..54: note = chr1:230458365-230458419
  misc_feature 1..54: note = Hypo
  source 1..54: mol_type = genomic DNA

SEQ ID NO: 103820 - DNA, 796 bp, Homo sapiens; identical to SEQ ID NO: 68812
  misc_feature 1..796: note = chr1:230561177-230561973
  misc_feature 1..796: note = Hyper
  source 1..796: mol_type = genomic DNA

SEQ ID NO: 103821 - DNA, 30 bp, Homo sapiens; identical to SEQ ID NO: 68815
  misc_feature 1..30: note = chr1:230841649-230841679
  misc_feature 1..30: note = Hypo
  source 1..30: mol_type = genomic DNA

SEQ ID NO: 103822 - DNA, 128 bp, Homo sapiens; identical to SEQ ID NO: 39292
  misc_feature 1..128: note = chr1:230992827-230992955
  misc_feature 1..128: note = Hypo
  source 1..128: mol_type = genomic DNA

SEQ ID NO: 103823 - DNA, 35 bp, Homo sapiens; identical to SEQ ID NO: 68819
  misc_feature 1..35: note = chr1:231019380-231019415
  misc_feature 1..35: note = Hypo
  source 1..35: mol_type = genomic DNA

SEQ ID NO: 103824 - DNA, 30 bp, Homo sapiens; identical to SEQ ID NO: 68820
  misc_feature 1..30: note = chr1:231037612-231037642
  misc_feature 1..30: note = Hypo
  source 1..30: mol_type = genomic DNA

SEQ ID NO: 103825 - DNA, 43 bp, Homo sapiens; identical to SEQ ID NO: 68821
  misc_feature 1..43: note = chr1:231150213-231150256
  misc_feature 1..43: note = Hypo
  source 1..43: mol_type = genomic DNA

SEQ ID NO: 103826 - DNA, 53 bp, Homo sapiens; identical to SEQ ID NO: 39293
  misc_feature 1..53: note = chr1:231163086-231163139
  misc_feature 1..53: note = Hypo
  source 1..53: mol_type = genomic DNA

SEQ ID NO: 103827 - DNA, 28 bp, Homo sapiens
  misc_feature 1..28: note = chr1:231205699-231205727
  misc_feature 1..28: note = Hypo
  source 1..28: mol_type = genomic DNA
aaccgcagtgtccatcggtggatgaatg

SEQ ID NO: 103828 - DNA, 30 bp, Homo sapiens; identical to SEQ ID NO: 68824
  misc_feature 1..30: note = chr1:231269325-231269355
  misc_feature 1..30: note = Hypo
  source 1..30: mol_type = genomic DNA

SEQ ID NO: 103829 - DNA, 852 bp, Homo sapiens
  misc_feature 1..852: note = chr1:231296717-231297569
  misc_feature 1..852: note = Hyper
  source 1..852: mol_type = genomic DNA
gccccaagccctgggcgcaggctgcagcttccccctgcctgaccccgccagcctgcgcctcctcacccggggactagcagaagcctgggcccgcgcctggcgctacgactccggtctttagtctttgtttggagcacgggagaacctgggacggagggaggcatgacttcaatattcatatcgttgttaaataaacgatttcctaatttgtatctgtttcatgccagcgtgaaacttctgtaggcagagccggctgcgctgccagcactttcttctgctcgtccccacccacctctgcctcccccacccagccttccctcggcagcagcggggaagaacagccgagcagaccaaacagccggggccgcgggtgggaggctgttcccgcagctcgtggctggcgttggagaatgtggagattttcccattcataaaaggaacgtctccgcttgccgccttcccgtccgccgcacaccgccacatccgcagcggggtagggctgggtctgggggcgctgggttcccaggggtctacccgggcgcgctctcgcctttctcaggaaaccccattttgtgagcggcaccgcgtgtcctctctcagtccgtgcacacagttgacctggagcgcggatgagcacccttggttgaaaggaagagacaaaatggcttgtggttcaattcataaataaaacctcacccttggacttcaggctgcccgacattttgggacttggatttttttgctttatcgtagttttaggaagcgactgtcaggccatgttgcctatccatttctaaacgactggctttttaggatcccgttttcacccttctatggcggtgggttgggggt

SEQ ID NO: 103830 - DNA, 1422 bp, Homo sapiens
  misc_feature 1..1422: note = chr1:231297797-231299219
  misc_feature 1..1422: note = Hyper
  source 1..1422: mol_type = genomic DNA
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcctccgccagtctcccgagctccggccattcatccccagcgcagagcagcgctggcagccggcgccgcgatggaggaagagctgaagtgtcccgtgtgcggctctctgtttcgggagcctatcatcctgccctgttcccacaatgtctgcctgccttgcgctcgcaccatcgcggtgcagaccccggacggtgagcagcacctgccccagccgctcctgctttcccggggatcggggctgcaggcgggcgccgccgccgctgcctctctggagcacgacgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctg

SEQ ID NO: 103831 - DNA, 218 bp, Homo sapiens
  misc_feature 1..218: note = chr1:231299423-231299641
  misc_feature 1..218: note = Hyper
  source 1..218: mol_type = genomic DNA
aagtgccatccatcccggggacccttcgccaagcatcgcctggtgcagccgccgccgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatgga

SEQ ID NO: 103832 - DNA, 145 bp, Homo sapiens; identical to SEQ ID NO: 68833
  misc_feature 1..145: note = chr1:231475674-231475819
  misc_feature 1..145: note = Hypo
  source 1..145: mol_type = genomic DNA

SEQ ID NO: 103833 - DNA, 114 bp, Homo sapiens; identical to SEQ ID NO: 68835
  misc_feature 1..114: note = chr1:231663293-231663407
  misc_feature 1..114: note = Hypo
  source 1..114: mol_type = genomic DNA

SEQ ID NO: 103834 - DNA, 120 bp, Homo sapiens; identical to SEQ ID NO: 68836
  misc_feature 1..120: note = chr1:231738890-231739010
  misc_feature 1..120: note = Hypo
  source 1..120: mol_type = genomic DNA

SEQ ID NO: 103835 - DNA, 30 bp, Homo sapiens; identical to SEQ ID NO: 68837
  misc_feature 1..30: note = chr1:232761027-232761057
  misc_feature 1..30: note = Hypo
  source 1..30: mol_type = genomic DNA

SEQ ID NO: 103836 - DNA, 30 bp, Homo sapiens; identical to SEQ ID NO: 39296
  misc_feature 1..30: note = chr1:232761388-232761418
  misc_feature 1..30: note = Hypo
  source 1..30: mol_type = genomic DNA

SEQ ID NO: 103837 - DNA, 60 bp, Homo sapiens; identical to SEQ ID NO: 68839
  misc_feature 1..60: note = chr1:232765315-232765375
  misc_feature 1..60: note = Hyper
  source 1..60: mol_type = genomic DNA

SEQ ID NO: 103838 - DNA, 30 bp, Homo sapiens; identical to SEQ ID NO: 68841
  misc_feature 1..30: note = chr1:233116414-233116444
  misc_feature 1..30: note = Hypo
  source 1..30: mol_type = genomic DNA

SEQ ID NO: 103839 - DNA, 30 bp, Homo sapiens; identical to SEQ ID NO: 68842
  misc_feature 1..30: note = chr1:233118122-233118152
  misc_feature 1..30: note = Hypo
  source 1..30: mol_type = genomic DNA

SEQ ID NO: 103840 - DNA, 292 bp, Homo sapiens; identical to SEQ ID NO: 68845
  misc_feature 1..292: note = chr1:233750219-233750511
  misc_feature 1..292: note = Hyper
  source 1..292: mol_type = genomic DNA

SEQ ID NO: 103841 - DNA, 1377 bp, Homo sapiens
  misc_feature 1..1377: note = chr1:234040247-234041624
  misc_feature 1..1377: note = Hyper
  source 1..1377: mol_type = genomic DNA
gtactgaactgggagcggcagggtttgagtcaaaagagaagggtggaggagcgcgtccggtgccccaaggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcccggtcgcggcgagactcacgcctgcggtgtgctagggcggcggcgacggtgacgggcgtggggcgcggcgctgcctcggctgccgggtcgttgcggcgagcgcgcgggccggcctggagtcaccgggctgaaccgccgcgcctgcatcgtgccgcacgccgcggaggcgctcgggtacagaccgcgcgggcgcgcacaaagcggcccggggcggccggcgcggcgcagaccctcggtgggcagcgcactccagtcttcccaggctagcggctgcagggagctccggcccgcggcccctccgcctcaagtctgggagctgccggtcccactctgtctttgcctatggggattcgagagtttcccagcggcgcacccaggggcaagagcattgccgtgtgagtagcgccccgggcgtgggtgagcgagccggcgggcgggaggccggagcgccggggtagccctttgcagctgggacactgggcagtctgaggctcggggaagggcggcgcgcgcggtggagctgctcgggaagtttcagtcattctttccctcgccactcgccccaacccgcactgccccgagacgcccaggatagggcactggggacagctgcccggggaagtgggtgagtggcggcgggaagggaggagcgcgggctctgccgcggcgctcgcccccggagggccccggccgcgctcttgctctcgccctgggatctgctcctcacgaatcccctcctctctgtccatgctccccctgcccacccacctgcccgtggcgcctgcgaccgcagtggcatgaggaggtcaccggacgtcagcccccggagactgtccgacatcagcccccagctccggcagctcaagtacttggtggtggacgaggcgattaaggaggatctgaaatggtcgcgctccgtggaggatctcaccagcgggccggtggggctcacgtccatcgaggagcggatcctgcgcatcactggctactatggctaccagccctgggcagcgagctgcaaaagtaagaccccctcacgtcatgtttcccgttcactggtccatcttcttaccattgtcacagcagcctcggggagcgcacgcagtgaggcgtccagccaccccctcccgccctgcctgctga

SEQ ID NO: 103842 - DNA, 472 bp, Homo sapiens
  misc_feature 1..472: note = chr1:234349869-234350341
  misc_feature 1..472: note = Hyper
  source 1..472: mol_type = genomic DNA
cagggatgagggctgcggggctgggcgtcccggggaggagggcggagcaggtgagctgcggggtgggagcagggagtgcacttgtacgtgacgttggagtttgcagcaacctccaagtaggaggctgtgcgcgcgtgtgtgtggagtggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggtaatgcgcggccgcctcgcc

SEQ ID NO: 103843 - DNA, 30 bp, Homo sapiens; identical to SEQ ID NO: 39297
  misc_feature 1..30: note = chr1:234445373-234445403
  misc_feature 1..30: note = Hypo
  source 1..30: mol_type = genomic DNA

SEQ ID NO: 103844 - DNA, 278 bp, Homo sapiens; identical to SEQ ID NO: 39298
  misc_feature 1..278: note = chr1:234621065-234621343
  misc_feature 1..278: note = Hypo
  source 1..278: mol_type = genomic DNA

SEQ ID NO: 103845 - DNA, 42 bp, Homo sapiens; identical to SEQ ID NO: 68855
  misc_feature 1..42: note = chr1:234625024-234625066
  misc_feature 1..42: note = Hypo
  source 1..42: mol_type = genomic DNA

SEQ ID NO: 103846 - DNA, 30 bp, Homo sapiens; identical to SEQ ID NO: 39300
  misc_feature 1..30: note = chr1:234724806-234724836
  misc_feature 1..30: note = Hypo
  source 1..30: mol_type = genomic DNA

SEQ ID NO: 103847 - DNA, 30 bp, Homo sapiens; identical to SEQ ID NO: 68857
  misc_feature 1..30: note = chr1:234736426-234736456
  misc_feature 1..30: note = Hyper
  source 1..30: mol_type = genomic DNA

SEQ ID NO: 103848 - DNA, 30 bp, Homo sapiens; identical to SEQ ID NO: 39301
  misc_feature 1..30: note = chr1:234795478-234795508
  misc_feature 1..30: note = Hypo
  source 1..30: mol_type = genomic DNA

SEQ ID NO: 103849 - DNA, 30 bp, Homo sapiens; identical to SEQ ID NO: 68859
  misc_feature 1..30: note = chr1:234812002-234812032
  misc_feature 1..30: note = Hyper
  source 1..30: mol_type = genomic DNA

SEQ ID NO: 103850 - DNA, 94 bp, Homo sapiens; identical to SEQ ID NO: 68860
  misc_feature 1..94: note = chr1:234845049-234845143
  misc_feature 1..94: note = Hypo
  source 1..94: mol_type = genomic DNA

SEQ ID NO: 103851 - DNA, 36 bp, Homo sapiens; identical to SEQ ID NO: 68861
  misc_feature 1..36: note = chr1:234881213-234881249
  misc_feature 1..36: note = Hypo
  source 1..36: mol_type = genomic DNA

SEQ ID NO: 103852 - DNA, 169 bp, Homo sapiens; identical to SEQ ID NO: 39303
  misc_feature 1..169: note = chr1:234882410-234882579
  misc_feature 1..169: note = Hypo
  source 1..169: mol_type = genomic DNA

SEQ ID NO: 103853 - DNA, 242 bp, Homo sapiens; identical to SEQ ID NO: 68863
  misc_feature 1..242: note = chr1:234959367-234959609
  misc_feature 1..242: note = Hypo
  source 1..242: mol_type = genomic DNA

SEQ ID NO: 103854 - DNA, 42 bp, Homo sapiens; identical to SEQ ID NO: 68864
  misc_feature 1..42: note = chr1:234964788-234964830
  misc_feature 1..42: note = Hypo
  source 1..42: mol_type = genomic DNA

SEQ ID NO: 103855 - DNA, 140 bp, Homo sapiens; identical to SEQ ID NO: 68865
  misc_feature 1..140: note = chr1:235003811-235003951
  misc_feature 1..140: note = Hypo
  source 1..140: mol_type = genomic DNA

SEQ ID NO: 103856 - DNA, 39 bp, Homo sapiens; identical to SEQ ID NO: 39306
  misc_feature 1..39: note = chr1:235005711-235005750
  misc_feature 1..39: note = Hypo
  source 1..39: mol_type = genomic DNA

SEQ ID NO: 103857 - DNA, 128 bp, Homo sapiens; identical to SEQ ID NO: 68867
  misc_feature 1..128: note = chr1:235034454-235034582
  misc_feature 1..128: note = Hypo
  source 1..128: mol_type = genomic DNA

SEQ ID NO: 103858 - DNA, 30 bp, Homo sapiens; identical to SEQ ID NO: 68869
  misc_feature 1..30: note = chr1:235260531-235260561
  misc_feature 1..30: note = Hypo
  source 1..30: mol_type = genomic DNA

SEQ ID NO: 103859 - DNA, 155 bp, Homo sapiens; identical to SEQ ID NO: 68870
  misc_feature 1..155: note = chr1:235267075-235267230
  misc_feature 1..155: note = Hypo
  source 1..155: mol_type = genomic DNA

SEQ ID NO: 103860 - DNA, 76 bp, Homo sapiens; identical to SEQ ID NO: 39308
  misc_feature 1..76: note = chr1:235292638-235292714
  misc_feature 1..76: note = Hypo
  source 1..76: mol_type = genomic DNA

SEQ ID NO: 103861 - DNA, 16 bp, Homo sapiens
  misc_feature 1..16: note = chr1:235325301-235325317
  misc_feature 1..16: note = Hypo
  source 1..16: mol_type = genomic DNA
ccaggtgcggtggctc

SEQ ID NO: 103862 - DNA, 120 bp, Homo sapiens; identical to SEQ ID NO: 68873
  misc_feature 1..120: note = chr1:235325377-235325497
  misc_feature 1..120: note = Hypo
  source 1..120: mol_type = genomic DNA

SEQ ID NO: 103863 - DNA, 15 bp, Homo sapiens
  misc_feature 1..15: note = chr1:235325557-235325572
  misc_feature 1..15: note = Hypo
  source 1..15: mol_type = genomic DNA
cggcagaccctggct

SEQ ID NO: 103864 - DNA, 30 bp, Homo sapiens; identical to SEQ ID NO: 68875
  misc_feature 1..30: note = chr1:235443853-235443883
  misc_feature 1..30: note = Hypo
  source 1..30: mol_type = genomic DNA

SEQ ID NO: 103865 - DNA, 30 bp, Homo sapiens; identical to SEQ ID NO: 39311
  misc_feature 1..30: note = chr1:235793720-235793750
  misc_feature 1..30: note = Hypo
  source 1..30: mol_type = genomic DNA

SEQ ID NO: 103866 - DNA, 1146 bp, Homo sapiens; identical to SEQ ID NO: 68877
  misc_feature 1..1146: note = chr1:235812015-235813161
  misc_feature 1..1146: note = Hyper
  source 1..1146: mol_type = genomic DNA

SEQ ID NO: 103867 - DNA, 581 bp, Homo sapiens
  misc_feature 1..581: note = chr1:235813621-235814202
  misc_feature 1..581: note = Hyper
  source 1..581: mol_type = genomic DNA
cgggggggaaatcaccggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggacgcctcggaagcctccggccaaggcggggaacggcggagaaacgcggaatacctgtgcgaattcgcgcggccgcgtcgccactaacccggcgaaggctgacccgacgttgctgagtgacggggaccaggggccggcgaggcccccactccggggggagcgaggccgggagggcggagggcgcgtgctggaggcgggggtgcccttcgcgccccggttctaggagcgactgctctccaggcctcgtccctgtggcaccgcaggcttttgcgctggagattttaaaacactttagtgattacagccctcttcctttcagggaaaaaacagtttaagcgccgtccattttccgacttggtaaaataatacgaaaccttgggaatagagaagcaacgaaaacatttcacg

SEQ ID NO: 103868 - DNA, 93 bp, Homo sapiens; identical to SEQ ID NO: 68880
  misc_feature 1..93: note = chr1:235872465-235872558
  misc_feature 1..93: note = Hypo
  source 1..93: mol_type = genomic DNA

SEQ ID NO: 103869 - DNA, 27 bp, Homo sapiens
  misc_feature 1..27: note = chr1:236044127-236044154
  misc_feature 1..27: note = Hypo
  source 1..27: mol_type = genomic DNA
aagaattccatttagcggccgggcacg

SEQ ID NO: 103870 - DNA, 30 bp, Homo sapiens; identical to SEQ ID NO: 39313
  misc_feature 1..30: note = chr1:236081438-236081468
  misc_feature 1..30: note = Hypo
  source 1..30: mol_type = genomic DNA

SEQ ID NO: 103871 - DNA, 30 bp, Homo sapiens; identical to SEQ ID NO: 68885
  misc_feature 1..30: note = chr1:236087376-236087406
  misc_feature 1..30: note = Hypo
  source 1..30: mol_type = genomic DNA

SEQ ID NO: 103872 - DNA, 30 bp, Homo sapiens; identical to SEQ ID NO: 68886
  misc_feature 1..30: note = chr1:236184191-236184221
  misc_feature 1..30: note = Hypo
  source 1..30: mol_type = genomic DNA

SEQ ID NO: 103873 - DNA, 30 bp, Homo sapiens; identical to SEQ ID NO: 68887
  misc_feature 1..30: note = chr1:236192796-236192826
  misc_feature 1..30: note = Hypo
  source 1..30: mol_type = genomic DNA

SEQ ID NO: 103874 - DNA, 1389 bp, Homo sapiens
  misc_feature 1..1389: note = chr1:236227462-236228851
  misc_feature 1..1389: note = Hyper
  source 1..1389: mol_type = genomic DNA
aggcccggccagtcacggggaggatccagggagctgtaggtcatctggtcccgctcctcgtttggggcctccgtggtgacaatgcctggccacaggaaatgggatcactgggagccctgtgtttcccgctctggactctggactctgaaacgagcccaactggaaagcagcatcactgccaagacacatccggagtccacacacaaatacaggaggctgccggcgaaactctcccgcagccacaagagtcccggggcccgcgcgcagactgcgatccagctccggctcttgccctgcggaggctccgcgcgagaacctggctccacccgggaccggccaggtcctagccccgaagggactggacagccgagggacgcggactgacctccctgcggcgatgcagcccacagccgccggggaggaagctccgcggggtccatgggtgccggggtcacggcccggggcgcgcggagccacccagaccccgcgacccgctcttcggatagcagggaccgggtcgggaagaccttcgcggaccctgcagaggcgggagaccctgcgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctccagggcaggagagacgaagtcatccccgtcctccagctccaggtccccctgtccggggccgaagggaaagagctcctggcggctcaggcagcccacaggccccgccagcagcagcggcagcagcagcgcccgcgtccacgcagcccggatccggctgctcgaggccaacatgttcccgaactgcggtcccgcaaacccggtcccgcggccaggacagaggaaggcggggatgtaaccggacgcccctggcagccccctctcctcccgcctcccggcgttcccaccccgggaaataggggaggggagcggaggggagagcggagggccccgccccgtccagcgggcgcgccgcggggcagcccaatggccgcgagggggagggcgaggggcgaagccgaacctcccgccttgggcgccggtgcctgcgattctcgaaaccagcccgactcccagcgaacggcgcctccgggagggggagcagagcgcgggacccgcaccgtggtcctctgattagggttgggtcgtggagagccggcgacgtggaaacgctccggattcaggaacggcgcccaccccattgccgctcggccgcgtccggggtccaattcgcttgaccctggtaggaagacggggtgggagctgg

SEQ ID NO: 103875 - DNA, 29 bp, Homo sapiens
  misc_feature 1..29: note = chr1:236252519-236252548
  misc_feature 1..29: note = Hypo
  source 1..29: mol_type = genomic DNA
gcttaccaggccaggcgtggtggctcatg

SEQ ID NO: 103876 - DNA, 55 bp, Homo sapiens; identical to SEQ ID NO: 68893
  misc_feature 1..55: note = chr1:236304825-236304880
  misc_feature 1..55: note = Hyper
  source 1..55: mol_type = genomic DNA

SEQ ID NO: 103877 - DNA, 30 bp, Homo sapiens; identical to SEQ ID NO: 68894
  misc_feature 1..30: note = chr1:236464650-236464680
  misc_feature 1..30: note = Hypo
  source 1..30: mol_type = genomic DNA

SEQ ID NO: 103878 - DNA, 1063 bp, Homo sapiens
  misc_feature 1..1063: note = chr1:236558422-236559485
  misc_feature 1..1063: note = Hyper
  source 1..1063: mol_type = genomic DNA
tgtctcagctgagggcgtgagtagggagccaggaaagcgacccgcgactgcagccgtttcttaaggccagtccttcgctcgcagtctgtcccgggcggcagtcgtgtcagccccccgctaggacccgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcgcgccttccccctgcccatgccgcagcccccgtggcttttgttctggactcgggatgccaggttgagacacgtcctgcaaacctctggcagaaatgggcgcaagggggtggatttcgttttcgcctcccgggctttttctttctccccgctcacatgccttctcattactcctcttcctctctcccattgcactttgatgaaatggttttgtctgtctaaacattggccctcggagctatttcatcagatagtatccgcagaatcgagaggcggatccc

SEQ ID NO: 103879 - DNA, 37 bp, Homo sapiens; identical to SEQ ID NO: 68898
  misc_feature 1..37: note = chr1:236607992-236608029
  misc_feature 1..37: note = Hypo
  source 1..37: mol_type = genomic DNA

SEQ ID NO: 103880 - DNA, 84 bp, Homo sapiens; identical to SEQ ID NO: 68899
  misc_feature 1..84: note = chr1:236614144-236614228
  misc_feature 1..84: note = Hypo
  source 1..84: mol_type = genomic DNA

SEQ ID NO: 103881 - DNA, 51 bp, Homo sapiens; identical to SEQ ID NO: 68900
  misc_feature 1..51: note = chr1:236687037-236687088
  misc_feature 1..51: note = Hyper
  source 1..51: mol_type = genomic DNA

SEQ ID NO: 103882 - DNA, 204 bp, Homo sapiens; identical to SEQ ID NO: 68901
  misc_feature 1..204: note = chr1:236768620-236768824
  misc_feature 1..204: note = Hypo
  source 1..204: mol_type = genomic DNA

SEQ ID NO: 103883 - DNA, 83 bp, Homo sapiens; identical to SEQ ID NO: 68902
  misc_feature 1..83: note = chr1:236771371-236771454
  misc_feature 1..83: note = Hypo
  source 1..83: mol_type = genomic DNA

SEQ ID NO: 103884 - DNA, 30 bp, Homo sapiens; identical to SEQ ID NO: 39317
  misc_feature 1..30: note = chr1:236811244-236811274
  misc_feature 1..30: note = Hypo
  source 1..30: mol_type = genomic DNA

SEQ ID NO: 103885 - DNA, 755 bp, Homo sapiens
  misc_feature 1..755: note = chr1:236849457-236850212
  misc_feature 1..755: note = Hyper
  source 1..755: mol_type = genomic DNA
gtccctcccctggctcgcgatcacccacccgggacaccgacggaccccgcgccgctaaccagccgctctcagagcgtgggtggcaggcgtggctctgctcggggccggccgctcccctcacgttcccggaggcctcggcggaaggcgtgcaggcggcctctgggcggcggctgcaggggagacagtggaggggcccggcgcccttgtccgcccgcacgtgctcggggcggggcggctggggcccgacgggcggggccgggggcggtggcggcgggggcgtggccgggcggccacgtgacgggcggcgcggctattaagccgcgcggcagctgctcgcagccggagctggtgcttcgcccgagacccagcgcccaggcgtgtcgccccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaaggtcagcaggggcccgcgggccgcccgcgcgtggtggggccgggtcccccgcggggctcccgtgcgcgtggccgcgtggcctggcgactggcgagagggcgctttgtggaggtg

SEQ ID NO: 103886 - DNA, 113 bp, Homo sapiens; identical to SEQ ID NO: 68906
  misc_feature 1..113: note = chr1:236900491-236900604
  misc_feature 1..113: note = Hypo
  source 1..113: mol_type = genomic DNA

SEQ ID NO: 103887 - DNA, 116 bp, Homo sapiens; identical to SEQ ID NO: 68907
  misc_feature 1..116: note = chr1:236907863-236907979
  misc_feature 1..116: note = Hypo
  source 1..116: mol_type = genomic DNA

SEQ ID NO: 103888 - DNA, 29 bp, Homo sapiens
  misc_feature 1..29: note = chr1:236931484-236931513
  misc_feature 1..29: note = Hypo
  source 1..29: mol_type = genomic DNA
tgatctgcctgcctcggcctcccaaagtg

SEQ ID NO: 103889 - DNA, 127 bp, Homo sapiens; identical to SEQ ID NO: 68912
  misc_feature 1..127: note = chr1:237056379-237056506
  misc_feature 1..127: note = Hypo
  source 1..127: mol_type = genomic DNA

SEQ ID NO: 103890 - DNA, 30 bp, Homo sapiens; identical to SEQ ID NO: 68913
  misc_feature 1..30: note = chr1:237204993-237205023
  misc_feature 1..30: note = Hyper
  source 1..30: mol_type = genomic DNA

SEQ ID NO: 103891 - DNA, 1479 bp, Homo sapiens
  misc_feature 1..1479: note = chr1:237205256-237206735
  misc_feature 1..1479: note = Hyper
  source 1..1479: mol_type = genomic DNA
gcccagggaccccagcggggcgcaggtaggaggctgtgcgctcgccgggtgcgctccggccccgattcccagcgcagccagtaagtggcgctgggcctcgggtttggcggcccggaggagcgggctgcggattacctgcagcagcggggagccgccgagctcctccccgcccgcccccacaccccacccccaccgctgcactaaccccggctcagctggctccgcgcacttgctcggaggagccggggccgagcggaccgccggctgcaggcagcgagcgcggctgggctgcggggctgcttccccgcgtcctccgggcccgggccgccctcctcccgcacagtgcggagcagggaggccccgcgcctcgaccacccgcgcccgagcgtccgcgcctcctcctccgctctgcaggcggggaccgcccggcgctcggcacccggcagcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgtaagcgccgtgcgtcgcgtgtgctgtcaggggaagggggcgtcagggcatccactagcggggtccgggcagagtgacagcgggcagcggggactcgcgggcggggcgagggggtgccccctgaggatgcgggaggagcgggcatcaccaagtgtgtgcaggtgtgcgtgttggggcgagggaaggcaagggcgcgtgtctgtgcgcgcgtgtggaaagctagaggatggagcgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcccgtgggggcgcggggagcggcgggaactcgggctgtttctgggaataccgccgccgggaggtttcttgggctttcgggctggacccgcgcgttgtcacggagcgaagacgttggttcgcttactccgtgtagcgtgcggcgcagctgaccgggggcgggggtgatggtgcaggacgctgcgcggaggtttcccccaagtcaaggtgctgcgaaagcggaggaggagtcgcctccgtggtccccgcggttcccggggctggtgccatccgtggtggtgctgtgaccgcttgcaaagcgtggaaggcatgggaagcgagcgtgtgtttgcgtgtgtgcgcgcgcgcgggtggtggtggggagaacatcgtgaacgtgtcgttctctaaatgctggcttattgcatgccaagtgaagcaaagtgtgtgtgtgtaagtgtaagggcagggtggctgcccgggaaaggttggct

SEQ ID NO: 103892 - DNA, 27 bp, Homo sapiens
  misc_feature 1..27: note = chr1:237230203-237230230
  misc_feature 1..27: note = Hypo
  source 1..27: mol_type = genomic DNA
tgggattacaggcgtgagccaccgcgc

SEQ ID NO: 103893 - DNA, 30 bp, Homo sapiens; identical to SEQ ID NO: 68920
  misc_feature 1..30: note = chr1:237732599-237732629
  misc_feature 1..30: note = Hypo
  source 1..30: mol_type = genomic DNA

SEQ ID NO: 103894 - DNA, 30 bp, Homo sapiens; identical to SEQ ID NO: 39319
  misc_feature 1..30: note = chr1:237753724-237753754
  misc_feature 1..30: note = Hypo
  source 1..30: mol_type = genomic DNA

SEQ ID NO: 103895 - DNA, 30 bp, Homo sapiens; identical to SEQ ID NO: 68922
  misc_feature 1..30: note = chr1:237919696-237919726
  misc_feature 1..30: note = Hypo
  source 1..30: mol_type = genomic DNA

SEQ ID NO: 103896 - DNA, 71 bp, Homo sapiens; identical to SEQ ID NO: 68923
  misc_feature 1..71: note = chr1:237947252-237947323
  misc_feature 1..71: note = Hypo
  source 1..71: mol_type = genomic DNA

SEQ ID NO: 103897 - DNA, 135 bp, Homo sapiens; identical to SEQ ID NO: 68924
  misc_feature 1..135: note = chr1:238018308-238018443
  misc_feature 1..135: note = Hypo
  source 1..135: mol_type = genomic DNA

SEQ ID NO: 103898 - DNA, 43 bp, Homo sapiens; identical to SEQ ID NO: 68925
  misc_feature 1..43: note = chr1:238027719-238027762
  misc_feature 1..43: note = Hyper
  source 1..43: mol_type = genomic DNA

SEQ ID NO: 103899 - DNA, 30 bp, Homo sapiens; identical to SEQ ID NO: 68926
  misc_feature 1..30: note = chr1:238081199-238081229
  misc_feature 1..30: note = Hypo
  source 1..30: mol_type = genomic DNA

SEQ ID NO: 103900 - DNA, 35 bp, Homo sapiens; identical to SEQ ID NO: 68927
  misc_feature 1..35: note = chr1:238235527-238235562
  misc_feature 1..35: note = Hypo
  source 1..35: mol_type = genomic DNA

SEQ ID NO: 103901 - DNA, 29 bp, Homo sapiens
  misc_feature 1..29: note = chr1:238508028-238508057
  misc_feature 1..29: note = Hypo
  source 1..29: mol_type = genomic DNA
tttgtccttacacgcgtgagccactgcgc

SEQ ID NO: 103902 - DNA, 19 bp, Homo sapiens
  misc_feature 1..19: note = chr1:239516662-239516681
  misc_feature 1..19: note = Hypo
  source 1..19: mol_type = genomic DNA
agagcgatactctgattaa

SEQ ID NO: 103903 - DNA, 192 bp, Homo sapiens; identical to SEQ ID NO: 39322
  misc_feature 1..192: note = chr1:239523114-239523306
  misc_feature 1..192: note = Hypo
  source 1..192: mol_type = genomic DNA

SEQ ID NO: 103904 - DNA, 231 bp, Homo sapiens; identical to SEQ ID NO: 68935
  misc_feature 1..231: note = chr1:239549584-239549815
  misc_feature 1..231: note = Hyper
  source 1..231: mol_type = genomic DNA

SEQ ID NO: 103905 - DNA, 1184 bp, Homo sapiens; identical to SEQ ID NO: 68936
  misc_feature 1..1184: note = chr1:239550034-239551218
  misc_feature 1..1184: note = Hyper
  source 1..1184: mol_type = genomic DNA

SEQ ID NO: 103906 - DNA, 125 bp, Homo sapiens; identical to SEQ ID NO: 68938
  misc_feature 1..125: note = chr1:239987328-239987453
  misc_feature 1..125: note = Hypo
  source 1..125: mol_type = genomic DNA

SEQ ID NO: 103907 - DNA, 23 bp, Homo sapiens
  misc_feature 1..23: note = chr1:240102287-240102310
  misc_feature 1..23: note = Hypo
  source 1..23: mol_type = genomic DNA
caagactccgtctcaaaaaaaaa

SEQ ID NO: 103908 - DNA, 250 bp, Homo sapiens; identical to SEQ ID NO: 39324
  misc_feature 1..250: note = chr1:240118753-240119003
  misc_feature 1..250: note = Hypo
  source 1..250: mol_type = genomic DNA

SEQ ID NO: 103909 - DNA, 564 bp, Homo sapiens
  misc_feature 1..564: note = chr1:240160929-240161493
  misc_feature 1..564: note = Hyper
  source 1..564: mol_type = genomic DNA
ggactggggaggctccgagggagcaagacatttaaacccgggcggtgggggggcgggcggtgtcagacgcccaacgaccacctccctcccggcccgcgccgagcccggccacaccctccccgcgacacccgcgatcgccccccaggactggcggccccgggccccgctcccacccacccacctacgcagggggcgtcctgctcaggcaattcctcccgcgcgccccgtcggggaccgggcggggacgggagaaggaaaagggcccctggctccgggaccagggctccggagggtgccgggcggggagcggaacagggaacgggctggtggcggccccaagcgggagggacggaccgacacgcggccccctggcggccttgcgactcgccgacctgcggaacctcgtcgccgccctcacagccccgcggccaccgccgacccgggccggtccccggggcgtcgcgggtgttaaagggcgagtctacgcggatgtcacggtcgccgcgggcaaggaccgcgaggttgcggccctgctccgaatcccggctgcgctggccacgctcc

SEQ ID NO: 103910 - DNA, 2209 bp, Homo sapiens
  misc_feature 1..2209: note = chr1:240254819-240257028
  misc_feature 1..2209: note = Hyper
  source 1..2209: mol_type = genomic DNA
tatgtggctgtgacccgatggcacctctaaactggaattgggcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgcgctggggcccagggatgtggaagccacaaagaaggggagcgggggcaagaaggcgctaggcaagcacggcaaggggggagggggcggcggcggcggcggggagtcgggcaagaagaagagcaagtccgactccagagcctcggtgttttccaacctgcggatcaggaagaatctgtccaaggggaaaggcgccggcggctcccgcgaagatgtactggattcccaggccctgcagaccggggagctggacagcgctcactccctgctcaccaagactccagacctcagcctctcggcggacgaggccggcctgtcggataccgagtgtgcggacccttttgaggtgaccggtccagggggtcctgggcctgccgaggctagggtcgggggccggccgatcgccgaggatgtggaaactgcagcaggggcgcaggatggacaaaggaccagctcgggctcggacacggacatctatagcttccattcggctacggagcaagaggatttgctttcagacatccagcaggcgatccgcctgcagcagcagcagcagcagcagctccagctccagctccagcaacagcagcagcagcagcagctccagggcgccgaggagcctgcagcgccccccactgccgtctcccctcagcccggggccttcctgggcctggaccggttcctgctggggccgagcggcggggctggggaggccccgggcagtccggacaccgagcaggcgctgtccgcgctctccgacctgcccgagagcctggccgccgagccccgggagccccagcaaccgccgtcccccggcggcctcccggtctccgaggcgcccagtctcccggcagcgcaacccgcggccaaagactcgccctcctccacggctttcccatttcccgaggccgggccgggggaggaagcggccggagcccccgtgcgaggggctggggacacggatgaggagggtgaggaggatgcttttgaggatgcgccccggggctctccgggggaggagtgggccccggaggtgggagaggacgccccgcagaggctgggggaagagccggaggaggaggcgcaaggacctgacgcccccgcggccgcttccctgcccggcagccccgcgcctagccagcgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctccgcgcacctgctggagcgcggggtggcgagtgacagcggcggtggggtgtccccagcactggccgccaaggcgtctggggcccccgcggctgcggatggcttccagaacgtgttcacaggtga

SEQ ID NO: 103911 - DNA, 38 bp, Homo sapiens; identical to SEQ ID NO: 68947
  misc_feature 1..38: note = chr1:240267184-240267222
  misc_feature 1..38: note = Hypo
  source 1..38: mol_type = genomic DNA

SEQ ID NO: 103912 - DNA, 30 bp, Homo sapiens; identical to SEQ ID NO: 39325
  misc_feature 1..30: note = chr1:240308662-240308692
  misc_feature 1..30: note = Hypo
  source 1..30: mol_type = genomic DNA

SEQ ID NO: 103913 - DNA, 120 bp, Homo sapiens; identical to SEQ ID NO: 68949
  misc_feature 1..120: note = chr1:240372826-240372946
  misc_feature 1..120: note = Hypo
  source 1..120: mol_type = genomic DNA

SEQ ID NO: 103914 - DNA, 169 bp, Homo sapiens; identical to SEQ ID NO: 14351
  misc_feature 1..169: note = chr1:240463082-240463251
  misc_feature 1..169: note = Hypo
  source 1..169: mol_type = genomic DNA

SEQ ID NO: 103915 - DNA, 34 bp, Homo sapiens; identical to SEQ ID NO: 68951
  misc_feature 1..34: note = chr1:240655738-240655772
  misc_feature 1..34: note = Hypo
  source 1..34: mol_type = genomic DNA

SEQ ID NO: 103916 - DNA, 535 bp, Homo sapiens
  misc_feature 1..535: note = chr1:240774920-240775455
  misc_feature 1..535: note = Hyper
  source 1..535: mol_type = genomic DNA
aagagaaagaaagagcgatcacggtcaagtttgaaggtccttatgttacacccacgcataattcaataggtgaataaaccttgtggcccccagacacacgccaacagcttgaattacccggggtgaaaccggcgagacgtccactcagggctttcggtcctgaccagccacggaacaaacaacgtcaattcattctaagtgcctggtgaaggtagaaatcagaaaccgtgtctgtgtcacgttagtcgtgacaagctgcgtacctgcaatgacgtgatggaagcctcctcctcgggtcccttctctctctctctctccctctccctctgccttctctgagttctctagtccacagcggggtctaagtttggtctcccgccgccgctttcagttcgaccgcagccagactgcagcagacgcccataagagaagcgcgccggctgagggtgcaggagaggcgagagcgcgccccgcgccgcgcggtcccaggctggctgctcctgcagatgtgaaaggagcccggagacttagctct

SEQ ID NO: 103917 - DNA, 40 bp, Homo sapiens; identical to SEQ ID NO: 68954
  misc_feature 1..40: note = chr1:240892900-240892940
  misc_feature 1..40: note = Hypo
  source 1..40: mol_type = genomic DNA

SEQ ID NO: 103918 - DNA, 40 bp, Homo sapiens; identical to SEQ ID NO: 68955
  misc_feature 1..40: note = chr1:240893180-240893220
  misc_feature 1..40: note = Hypo
  source 1..40: mol_type = genomic DNA

SEQ ID NO: 103919 - DNA, 56 bp, Homo sapiens; identical to SEQ ID NO: 68956
  misc_feature 1..56: note = chr1:240986717-240986773
  misc_feature 1..56: note = Hypo
  source 1..56: mol_type = genomic DNA

SEQ ID NO: 103920 - DNA, 142 bp, Homo sapiens; identical to SEQ ID NO: 68957
  misc_feature 1..142: note = chr1:241052144-241052286
  misc_feature 1..142: note = Hypo
  source 1..142: mol_type = genomic DNA

SEQ ID NO: 103921 - DNA, 39 bp, Homo sapiens; identical to SEQ ID NO: 39330
  misc_feature 1..39: note = chr1:241096456-241096495
  misc_feature 1..39: note = Hypo
  source 1..39: mol_type = genomic DNA

SEQ ID NO: 103922 - DNA, 462 bp, Homo sapiens; identical to SEQ ID NO: 68960
  misc_feature 1..462: note = chr1:241520071-241520533
  misc_feature 1..462: note = Hyper
  source 1..462: mol_type = genomic DNA

SEQ ID NO: 103923 - DNA, 30 bp, Homo sapiens; identical to SEQ ID NO: 68961
  misc_feature 1..30: note = chr1:241520759-241520789
  misc_feature 1..30: note = Hyper
  source 1..30: mol_type = genomic DNA

SEQ ID NO: 103924 - DNA, 772 bp, Homo sapiens
  misc_feature 1..772: note = chr1:241587106-241587878
  misc_feature 1..772: note = Hyper
  source 1..772: mol_type = genomic DNA
gcaggcagtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggcagctgactacacctcccccaccctcctgcagcagggtggatcccacctagcgggactccccacccacccctccaggccttctccactccggactctggccacttgccaccgttgtcgcccgccgccgctgcagggagggtgcacggagggagcagaccgtctccggagcccgccgccctgggggctgcagtgatggggccgggctgaggcacctgccggcggggtagcagggcagtcgagcacggagggaggggcgggcctccaggggacttcagcgggagccgggcctggggcggtgccgcacttgcacacggagtgtggggggccaggcctgggaccaggagctggggccgggcttcggcgcagaggcaggaagaggaagcggcacccgcttcggggacccagccggcggccaggccaccgcgcccacccggccgatggcaccgtgttcctgcgcctcgggagggaggaggctctgcgcgggactgcaggttctgccccgcatcggagtgatcgctgagcctgacgctctcgaaggctgggcctggggcccgcaatctactccggaggctttcccactgggcagggtcgctagcagggtgagagaaagccccgggccatccccgag

SEQ ID NO: 103925 - DNA, 87 bp, Homo sapiens; identical to SEQ ID NO: 68964
  misc_feature 1..87: note = chr1:241647308-241647395
  misc_feature 1..87: note = Hypo
  source 1..87: mol_type = genomic DNA

SEQ ID NO: 103926 - DNA, 123 bp, Homo sapiens; identical to SEQ ID NO: 68965
  misc_feature 1..123: note = chr1:241753208-241753331
  misc_feature 1..123: note = Hypo
  source 1..123: mol_type = genomic DNA

SEQ ID NO: 103927 - DNA, 30 bp, Homo sapiens; identical to SEQ ID NO: 68966
  misc_feature 1..30: note = chr1:241888798-241888828
  misc_feature 1..30: note = Hypo
  source 1..30: mol_type = genomic DNA

SEQ ID NO: 103928 - DNA, 30 bp, Homo sapiens; identical to SEQ ID NO: 39332
  misc_feature 1..30: note = chr1:241913315-241913345
  misc_feature 1..30: note = Hypo
  source 1..30: mol_type = genomic DNA

SEQ ID NO: 103929 - DNA, 30 bp, Homo sapiens; identical to SEQ ID NO: 68968
  misc_feature 1..30: note = chr1:241979590-241979620
  misc_feature 1..30: note = Hypo
  source 1..30: mol_type = genomic DNA

SEQ ID NO: 103930 - DNA, 30 bp, Homo sapiens; identical to SEQ ID NO: 68969
  misc_feature 1..30: note = chr1:242012857-242012887
  misc_feature 1..30: note = Hypo
  source 1..30: mol_type = genomic DNA

SEQ ID NO: 103931 - DNA, 38 bp, Homo sapiens; identical to SEQ ID NO: 68970
  misc_feature 1..38: note = chr1:242013289-242013327
  misc_feature 1..38: note = Hypo
  source 1..38: mol_type = genomic DNA

SEQ ID NO: 103932 - DNA, 85 bp, Homo sapiens; identical to SEQ ID NO: 68971
  misc_feature 1..85: note = chr1:242087513-242087598
  misc_feature 1..85: note = Hypo
  source 1..85: mol_type = genomic DNA

SEQ ID NO: 103933 - DNA, 27 bp, Homo sapiens
  misc_feature 1..27: note = chr1:242122948-242122975
  misc_feature 1..27: note = Hypo
  source 1..27: mol_type = genomic DNA
catgagccaccccgcccagcccacttt

SEQ ID NO: 103934 - DNA, 54 bp, Homo sapiens; identical to SEQ ID NO: 68973
  misc_feature 1..54: note = chr1:242161776-242161830
  misc_feature 1..54: note = Hyper
  source 1..54: mol_type = genomic DNA

SEQ ID NO: 103935 - DNA, 30 bp, Homo sapiens; identical to SEQ ID NO: 68974
  misc_feature 1..30: note = chr1:242182244-242182274
  misc_feature 1..30: note = Hypo
  source 1..30: mol_type = genomic DNA

SEQ ID NO: 103936 - DNA, 20 bp, Homo sapiens
  misc_feature 1..20: note = chr1:242194963-242194983
  misc_feature 1..20: note = Hypo
  source 1..20: mol_type = genomic DNA
gccaccgcacccggctgcta

SEQ ID NO: 103937 - DNA, 177 bp, Homo sapiens; identical to SEQ ID NO: 14352
  misc_feature 1..177: note = chr1:242286750-242286927
  misc_feature 1..177: note = Hypo
  source 1..177: mol_type = genomic DNA

SEQ ID NO: 103938 - DNA, 31 bp, Homo sapiens; identical to SEQ ID NO: 68978
  misc_feature 1..31: note = chr1:242633349-242633380
  misc_feature 1..31: note = Hypo
  source 1..31: mol_type = genomic DNA

SEQ ID NO: 103939 - DNA, 2004 bp, Homo sapiens
  misc_feature 1..2004: note = chr1:242686691-242688695
  misc_feature 1..2004: note = Hyper
  source 1..2004: mol_type = genomic DNA
agagccaattcacttcgcgtgaagtcggcactccttgggagtagaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggccgagagccactcgtgctgccggatctccatcctgacatgaccgggcggccgccggcgagcagcggactcgggacgggcgcgcggggagccgggcgcggagggcgagcgggaggcccagcgggagccggaggtggagctggagactgagctggaggagctggaggagcgagcgggcgcggggagcgcggggtgctgagcgccagctgggagcgcggccgggcgggagggggcgatcgcgggaggcgcggggcggaaggagggagggcgaggtgcgggcgggggcgggggcgggggcggagggggacggacggggagaagggggacgagaggggacagggagggaaaggaacctgctccggggagacagaagtgcccggtgcggcggcgacgtcgcccggcggctgcggtcccgagcgggcgctccgctcgccggctccttgcggcacctactgggacccgggccggctcccggggcggcggcggcggcgggggtggggtgcggtgggaggggccgcggctggcccagccagcccgcgcctgcaggttggtgcagtgaggagccgccgccgcccctcccgccgcgcccaggcccgggcggccgcgctcccgctccgcacccgcctttcccgagcaggctacacctctccctggcgcatctttactggaaagccggcaggcgaggggagaagtgagcgccgtctccgcgcctcctcggtcctgctggctgagcgcggggatggctccggagggagacactcaggaaaccacctccgcccttcccccatctctatccagcggcgccccctcaccctgcccccggctcgcttgggctgcgccttcccccattctgaaagttcactaacttcccaccccaagggacttagagcagagggtgcccagcattcccccctgaaaatagccgagagacatgtgttttctggagccgtacacgctactttcatccgatggtgtggcgatgcaaatacgcccgggggcagtagcccctcgggcaggcacgcgggaccggttgctccccagccctcggtgtccacctagaaccgggctccccgggccgcacccattccgatcctgggagggtgatccagggctcctctgcaacgctccgcttgtgcggtgactgttcctt

SEQ ID NO: 103940 - DNA, 30 bp, Homo sapiens; identical to SEQ ID NO: 68983
  misc_feature 1..30: note = chr1:242843570-242843600
  misc_feature 1..30: note = Hypo
  source 1..30: mol_type = genomic DNA

SEQ ID NO: 103941 - DNA, 140 bp, Homo sapiens; identical to SEQ ID NO: 68984
  misc_feature 1..140: note = chr1:242973108-242973248
  misc_feature 1..140: note = Hypo
  source 1..140: mol_type = genomic DNA

SEQ ID NO: 103942 - DNA, 30 bp, Homo sapiens; identical to SEQ ID NO: 68985
  misc_feature 1..30: note = chr1:243002516-243002546
  misc_feature 1..30: note = Hypo
  source 1..30: mol_type = genomic DNA

SEQ ID NO: 103943 - DNA, 260 bp, Homo sapiens
  misc_feature 1..260: note = chr1:243053773-243054033
  misc_feature 1..260: note = Hyper
  source 1..260: mol_type = genomic DNA
ccggccagcaggcctcgcgctgctctcggtcctgggcgcagggagagccgcggaggcggagagcagggctggcgggccggctcctgggcctcgctgaagagcttcccgcgggccaggctcggccccagcacgacctgaacaacgtctgcttcttgcaagccgccacccggcctatgggcgcgaactccacccgctcgccccctccacgtccccgcctggcctgccgctgatgggggcgggcagggcggaattccagcaac

SEQ ID NO: 103944 - DNA, 17 bp, Homo sapiens
  misc_feature 1..17: note = chr1:243057071-243057088
  misc_feature 1..17: note = Hypo
  source 1..17: mol_type = genomic DNA
gccaggtgcggttaccg

SEQ ID NO: 103945 - DNA, 84 bp, Homo sapiens; identical to SEQ ID NO: 68990
  misc_feature 1..84: note = chr1:243080471-243080555
  misc_feature 1..84: note = Hypo
  source 1..84: mol_type = genomic DNA

SEQ ID NO: 103946 - DNA, 16 bp, Homo sapiens
  misc_feature 1..16: note = chr1:243120279-243120295
  misc_feature 1..16: note = Hypo
  source 1..16: mol_type = genomic DNA
ccgtctcaaaaaaaac

SEQ ID NO: 103947 - DNA, 29 bp, Homo sapiens
  misc_feature 1..29: note = chr1:243139472-243139501
  misc_feature 1..29: note = Hypo
  source 1..29: mol_type = genomic DNA
caggcgtgagccaccgtgcccggcctctc

SEQ ID NO: 103948 - DNA, 82 bp, Homo sapiens; identical to SEQ ID NO: 68993
  misc_feature 1..82: note = chr1:243145032-243145114
  misc_feature 1..82: note = Hypo
  source 1..82: mol_type = genomic DNA

SEQ ID NO: 103949 - DNA, 400 bp, Homo sapiens
  misc_feature 1..400: note = chr1:243646379-243646779
  misc_feature 1..400: note = Hyper
  source 1..400: mol_type = genomic DNA
tgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaaggcgccctcctcccttg

SEQ ID NO: 103950 - DNA, 30 bp, Homo sapiens; identical to SEQ ID NO: 68998
  misc_feature 1..30: note = chr1:243844807-243844837
  misc_feature 1..30: note = Hypo
  source 1..30: mol_type = genomic DNA

SEQ ID NO: 103951 - DNA, 120 bp, Homo sapiens; identical to SEQ ID NO: 68999
  misc_feature 1..120: note = chr1:243982361-243982481
  misc_feature 1..120: note = Hypo
  source 1..120: mol_type = genomic DNA

SEQ ID NO: 103952 - DNA, 424 bp, Homo sapiens; identical to SEQ ID NO: 69000
  misc_feature 1..424: note = chr1:244014247-244014671
  misc_feature 1..424: note = Hyper
  source 1..424: mol_type = genomic DNA

SEQ ID NO: 103953 - DNA, 30 bp, Homo sapiens; identical to SEQ ID NO: 69001
  misc_feature 1..30: note = chr1:244019046-244019076
  misc_feature 1..30: note = Hypo
  source 1..30: mol_type = genomic DNA

SEQ ID NO: 103954 - DNA, 364 bp, Homo sapiens; identical to SEQ ID NO: 69002
  misc_feature 1..364: note = chr1:244080431-244080795
  misc_feature 1..364: note = Hyper
  source 1..364: mol_type = genomic DNA

SEQ ID NO: 103955 - DNA, 170 bp, Homo sapiens; identical to SEQ ID NO: 69003
  misc_feature 1..170: note = chr1:244087001-244087171
  misc_feature 1..170: note = Hypo
  source 1..170: mol_type = genomic DNA

SEQ ID NO: 103956 - DNA, 44 bp, Homo sapiens; identical to SEQ ID NO: 69004
  misc_feature 1..44: note = chr1:244115675-244115719
  misc_feature 1..44: note = Hypo
  source 1..44: mol_type = genomic DNA

SEQ ID NO: 103957 - DNA, 30 bp, Homo sapiens; identical to SEQ ID NO: 39341
  misc_feature 1..30: note = chr1:244139857-244139887
  misc_feature 1..30: note = Hypo
  source 1..30: mol_type = genomic DNA

SEQ ID NO: 103958 - DNA, 111 bp, Homo sapiens; identical to SEQ ID NO: 69006
  misc_feature 1..111: note = chr1:244142957-244143068
  misc_feature 1..111: note = Hypo
  source 1..111: mol_type = genomic DNA

SEQ ID NO: 103959 - DNA, 35 bp, Homo sapiens; identical to SEQ ID NO: 69007
  misc_feature 1..35: note = chr1:244198767-244198802
  misc_feature 1..35: note = Hypo
  source 1..35: mol_type = genomic DNA

SEQ ID NO: 103960 - DNA, 105 bp, Homo sapiens; identical to SEQ ID NO: 39343
  misc_feature 1..105: note = chr1:244200765-244200870
  misc_feature 1..105: note = Hypo
  source 1..105: mol_type = genomic DNA

SEQ ID NO: 103961 - DNA, 206 bp, Homo sapiens; identical to SEQ ID NO: 69009
  misc_feature 1..206: note = chr1:244243925-244244131
  misc_feature 1..206: note = Hypo
  source 1..206: mol_type = genomic DNA

SEQ ID NO: 103962 - DNA, 180 bp, Homo sapiens
  misc_feature 1..180: note = chr1:244318992-244319172
  misc_feature 1..180: note = Hypo
  source 1..180: mol_type = genomic DNA
ctatggagctgtcagcgtaaatatagaggctggttacatgggctcctcaaactctcccaccgtataaccctgcttgattcattcctgtttctttccccgacgccagtgtctccaggaggagtgggcatcacaggcggctgcgtgcttattaccccctcttcctgccgtgtaggggtggtg

SEQ ID NO: 103963 - DNA, 30 bp, Homo sapiens; identical to SEQ ID NO: 69013
  misc_feature 1..30: note = chr1:244402710-244402740
  misc_feature 1..30: note = Hypo
  source 1..30: mol_type = genomic DNA

SEQ ID NO: 103964 - DNA, 21 bp, Homo sapiens
  misc_feature 1..21: note = chr1:244625361-244625382
  misc_feature 1..21: note = Hypo
  source 1..21: mol_type = genomic DNA
tcctgccggggcctcccaaag

SEQ ID NO: 103965 - DNA, 30 bp, Homo sapiens; identical to SEQ ID NO: 69015
  misc_feature 1..30: note = chr1:244805002-244805032
  misc_feature 1..30: note = Hypo
  source 1..30: mol_type = genomic DNA

SEQ ID NO: 103966 - DNA, 16 bp, Homo sapiens
  misc_feature 1..16: note = chr1:244893239-244893255
  misc_feature 1..16: note = Hyper
  source 1..16: mol_type = genomic DNA
atttttttgacggggc

SEQ ID NO: 103967 - DNA, 1035 bp, Homo sapiens
  misc_feature 1..1035: note = chr1:244893315-244894350
  misc_feature 1..1035: note = Hyper
  source 1..1035: mol_type = genomic DNA
gtttgagtccagcccgggcaacatagttggttttttttttttttctcctgtctcaaaaaaaaggcattgcagagattgaaaaccgtttcccaccttctcccctgcagtgtttaggaagagacaatccgcccccgattcagcgcttcccagcccgcagcaactgcgcagcggggggaacccagggctccgcggcacccgcaggctttagttactgctccgaggccctcggaccaaagagaggctgcgaggaggacgcggctcgtttagctcgctgcgaacctcaagataacccttggtttccatgcacatccccccaacattgcatgtgctttcattcctacggtgctggggttactttcatttattgcttttgttgaccaaaaagaaaaaaacaatcctgagcgtgcacagggggcgcaacgggggaccggctcctcgtggctgaccggcggcggggctggcgcgcgggggcggcctgcgcgggccgcccggggacgctgctctggggtccggccgcggcctcgtggccgccctgcgcgcggtccagcaccagcagcgggatctcctccagccggtccggccgctccttgcgccgcaggtagcgccgcctccacgtcgccagcctctgaagcagcctctgcaggctcgaggggccccacaggccgcgctccggggcctccttgcctgcgcgcgcgtgagcttgcctgagcttcttcctgcgcgggccgcggaacagccgccgccagcaccagcacccagagcaggagccgccgtcgccggccaccgcgcgccgcccgaccgcctccggatccccgcgcggaggggggccccgctccaggcgcgccgccttctccagcagctcgtgctgcgcgccgccgcgccgggggccaccaaaccggggggccgccatggcccgcgcaggcctcttctcggagcgcggggcccacatctcgggaaccgtcgggctggacaacaacgctgccgcctccaggactccaaagggcccctcgcgtcctctcccgggaatgtacccac

SEQ ID NO: 103968 - DNA, 30 bp, Homo sapiens; identical to SEQ ID NO: 39346
  misc_feature 1..30: note = chr1:244914578-244914608
  misc_feature 1..30: note = Hypo
  source 1..30: mol_type = genomic DNA

SEQ ID NO: 103969 - DNA, 23 bp, Homo sapiens
  misc_feature 1..23: note = chr1:245032177-245032200
  misc_feature 1..23: note = Hypo
  source 1..23: mol_type = genomic DNA
accgtgcccggcctatatgcagt

SEQ ID NO: 103970 - DNA, 180 bp, Homo sapiens; identical to SEQ ID NO: 39347
  misc_feature 1..180: note = chr1:245060866-245061046
  misc_feature 1..180: note = Hypo
  source 1..180: mol_type = genomic DNA

SEQ ID NO: 103971 - DNA, 144 bp, Homo sapiens; identical to SEQ ID NO: 69022
  misc_feature 1..144: note = chr1:245135719-245135863
  misc_feature 1..144: note = Hypo
  source 1..144: mol_type = genomic DNA

SEQ ID NO: 103972 - DNA, 32 bp, Homo sapiens; identical to SEQ ID NO: 69023
  misc_feature 1..32: note = chr1:245254414-245254446
  misc_feature 1..32: note = Hypo
  source 1..32: mol_type = genomic DNA

SEQ ID NO: 103973 - DNA, 50 bp, Homo sapiens; identical to SEQ ID NO: 69024
  misc_feature 1..50: note = chr1:245305933-245305983
  misc_feature 1..50: note = Hypo
  source 1..50: mol_type = genomic DNA

SEQ ID NO: 103974 - DNA, 178 bp, Homo sapiens; identical to SEQ ID NO: 69025
  misc_feature 1..178: note = chr1:245317376-245317554
  misc_feature 1..178: note = Hyper
  source 1..178: mol_type = genomic DNA

SEQ ID NO: 103975 - DNA, 82 bp, Homo sapiens; identical to SEQ ID NO: 69026
  misc_feature 1..82: note = chr1:245318718-245318800
  misc_feature 1..82: note = Hyper
  source 1..82: mol_type = genomic DNA

SEQ ID NO: 103976 - DNA, 311 bp, Homo sapiens; identical to SEQ ID NO: 69027
  misc_feature 1..311: note = chr1:245319150-245319461
  misc_feature 1..311: note = Hyper
  source 1..311: mol_type = genomic DNA

SEQ ID NO: 103977 - DNA, 37 bp, Homo sapiens; identical to SEQ ID NO: 69028
  misc_feature 1..37: note = chr1:245376976-245377013
  misc_feature 1..37: note = Hypo
  source 1..37: mol_type = genomic DNA

SEQ ID NO: 103978 - DNA, 151 bp, Homo sapiens; identical to SEQ ID NO: 39350
  misc_feature 1..151: note = chr1:245461494-245461645
  misc_feature 1..151: note = Hypo
  source 1..151: mol_type = genomic DNA

SEQ ID NO: 103979 - DNA, 30 bp, Homo sapiens; identical to SEQ ID NO: 69030
  misc_feature 1..30: note = chr1:245472787-245472817
  misc_feature 1..30: note = Hypo
  source 1..30: mol_type = genomic DNA

SEQ ID NO: 103980 - DNA, 32 bp, Homo sapiens; identical to SEQ ID NO: 69031
  misc_feature 1..32: note = chr1:245494495-245494527
  misc_feature 1..32: note = Hypo
  source 1..32: mol_type = genomic DNA

SEQ ID NO: 103981 - DNA, 32 bp, Homo sapiens; identical to SEQ ID NO: 69032
  misc_feature 1..32: note = chr1:245498973-245499005
  misc_feature 1..32: note = Hypo
  source 1..32: mol_type = genomic DNA

SEQ ID NO: 103982 - DNA, 182 bp, Homo sapiens; identical to SEQ ID NO: 69033
  misc_feature 1..182: note = chr1:245499593-245499775
  misc_feature 1..182: note = Hypo
  source 1..182: mol_type = genomic DNA

SEQ ID NO: 103983 - DNA, 31 bp, Homo sapiens; identical to SEQ ID NO: 69034
  misc_feature 1..31: note = chr1:245522555-245522586
  misc_feature 1..31: note = Hypo
  source 1..31: mol_type = genomic DNA

SEQ ID NO: 103984 - DNA, 38 bp, Homo sapiens; identical to SEQ ID NO: 69035
  misc_feature 1..38: note = chr1:245627605-245627643
  misc_feature 1..38: note = Hypo
  source 1..38: mol_type = genomic DNA

SEQ ID NO: 103985 - DNA, 120 bp, Homo sapiens; identical to SEQ ID NO: 69036
  misc_feature 1..120: note = chr1:245627763-245627883
  misc_feature 1..120: note = Hypo
  source 1..120: mol_type = genomic DNA

SEQ ID NO: 103986 - DNA, 30 bp, Homo sapiens; identical to SEQ ID NO: 69037
  misc_feature 1..30: note = chr1:245633295-245633325
  misc_feature 1..30: note = Hypo
  source 1..30: mol_type = genomic DNA

SEQ ID NO: 103987 - DNA, 170 bp, Homo sapiens; identical to SEQ ID NO: 69038
  misc_feature 1..170: note = chr1:245725716-245725886
  misc_feature 1..170: note = Hypo
  source 1..170: mol_type = genomic DNA

SEQ ID NO: 103988 - DNA, 176 bp, Homo sapiens; identical to SEQ ID NO: 69039
  misc_feature 1..176: note = chr1:245750646-245750822
  misc_feature 1..176: note = Hypo
  source 1..176: mol_type = genomic DNA

SEQ ID NO: 103989 - DNA, 38 bp, Homo sapiens; identical to SEQ ID NO: 69040
  misc_feature 1..38: note = chr1:245753462-245753500
  misc_feature 1..38: note = Hypo
  source 1..38: mol_type = genomic DNA

SEQ ID NO: 103990 - DNA, 95 bp, Homo sapiens; identical to SEQ ID NO: 69041
  misc_feature 1..95: note = chr1:245755482-245755577
  misc_feature 1..95: note = Hypo
  source 1..95: mol_type = genomic DNA

SEQ ID NO: 103991 - DNA, 30 bp, Homo sapiens; identical to SEQ ID NO: 69042
  misc_feature 1..30: note = chr1:245761829-245761859
  misc_feature 1..30: note = Hypo
  source 1..30: mol_type = genomic DNA

SEQ ID NO: 103992 - DNA, 297 bp, Homo sapiens; identical to SEQ ID NO: 69043
  misc_feature 1..297: note = chr1:245772571-245772868
  misc_feature 1..297: note = Hypo
  source 1..297: mol_type = genomic DNA

SEQ ID NO: 103993 - DNA, 30 bp, Homo sapiens; identical to SEQ ID NO: 69044
  misc_feature 1..30: note = chr1:245786226-245786256
  misc_feature 1..30: note = Hypo
  source 1..30: mol_type = genomic DNA

SEQ ID NO: 103994 - DNA, 30 bp, Homo sapiens; identical to SEQ ID NO: 69045
  misc_feature 1..30: note = chr1:245835512-245835542
  misc_feature 1..30: note = Hypo
  source 1..30: mol_type = genomic DNA

SEQ ID NO: 103995 - DNA, 32 bp, Homo sapiens; identical to SEQ ID NO: 69046
  misc_feature 1..32: note = chr1:245859338-245859370
  misc_feature 1..32: note = Hypo
  source 1..32: mol_type = genomic DNA

SEQ ID NO: 103996 - DNA, 23 bp, Homo sapiens
  misc_feature 1..23: note = chr1:245969918-245969941
  misc_feature 1..23: note = Hypo
  source 1..23: mol_type = genomic DNA
aaagagggagaaggccgggcgcg

SEQ ID NO: 103997 - DNA, 141 bp, Homo sapiens; identical to SEQ ID NO: 69048
  misc_feature 1..141: note = chr1:245979706-245979847
  misc_feature 1..141: note = Hypo
  source 1..141: mol_type = genomic DNA

SEQ ID NO: 103998 - DNA, 178 bp, Homo sapiens; identical to SEQ ID NO: 69049
  misc_feature 1..178: note = chr1:245986618-245986796
  misc_feature 1..178: note = Hypo
  source 1..178: mol_type = genomic DNA

SEQ ID NO: 103999 - DNA, 30 bp, Homo sapiens; identical to SEQ ID NO: 69053
  misc_feature 1..30: note = chr1:246171927-246171957
  misc_feature 1..30: note = Hypo
  source 1..30: mol_type = genomic DNA

SEQ ID NO: 104000 - DNA, 109 bp, Homo sapiens; identical to SEQ ID NO: 39357
  misc_feature 1..109: note = chr1:246172251-246172360
  misc_feature 1..109: note = Hypo
  source 1..109: mol_type = genomic DNA

SEQ ID NO: 104001 - DNA, 30 bp, Homo sapiens; identical to SEQ ID NO: 39358
  misc_feature 1..30: note = chr1:246330476-246330506
  misc_feature 1..30: note = Hypo
  source 1..30: mol_type = genomic DNA

SEQ ID NO: 104002 - DNA, 30 bp, Homo sapiens; identical to SEQ ID NO: 69057
  misc_feature 1..30: note = chr1:246363402-246363432
  misc_feature 1..30: note = Hypo
  source 1..30: mol_type = genomic DNA

SEQ ID NO: 104003 - DNA, 30 bp, Homo sapiens; identical to SEQ ID NO: 39359
  misc_feature 1..30: note = chr1:246363735-246363765
  misc_feature 1..30: note = Hypo
  source 1..30: mol_type = genomic DNA

SEQ ID NO: 104004 - DNA, 165 bp, Homo sapiens; identical to SEQ ID NO: 69060
  misc_feature 1..165: note = chr1:246488142-246488307
  misc_feature 1..165: note = Hypo
  source 1..165: mol_type = genomic DNA

SEQ ID NO: 104005 - DNA, 17 bp, Homo sapiens
  misc_feature 1..17: note = chr1:246666970-246666987
  misc_feature 1..17: note = Hypo
  source 1..17: mol_type = genomic DNA
taagtgatttcaggccg

SEQ ID NO: 104006 - DNA, 142 bp, Homo sapiens; identical to SEQ ID NO: 69065
  misc_feature 1..142: note = chr1:246899152-246899294
  misc_feature 1..142: note = Hypo
  source 1..142: mol_type = genomic DNA

SEQ ID NO: 104007 - DNA, 39 bp, Homo sapiens; identical to SEQ ID NO: 69066
  misc_feature 1..39: note = chr1:246912280-246912319
  misc_feature 1..39: note = Hypo
  source 1..39: mol_type = genomic DNA

SEQ ID NO: 104008 - DNA, 70 bp, Homo sapiens; identical to SEQ ID NO: 69067
  misc_feature 1..70: note = chr1:246959219-246959289
  misc_feature 1..70: note = Hypo
  source 1..70: mol_type = genomic DNA

SEQ ID NO: 104009 - DNA, 120 bp, Homo sapiens; identical to SEQ ID NO: 69068
  misc_feature 1..120: note = chr1:246964078-246964198
  misc_feature 1..120: note = Hypo
  source 1..120: mol_type = genomic DNA

SEQ ID NO: 104010 - DNA, 95 bp, Homo sapiens; identical to SEQ ID NO: 69069
  misc_feature 1..95: note = chr1:246991090-246991185
  misc_feature 1..95: note = Hypo
  source 1..95: mol_type = genomic DNA

SEQ ID NO: 104011 - DNA, 561 bp, Homo sapiens
  misc_feature 1..561: note = chr1:247171005-247171566
  misc_feature 1..561: note = Hyper
  source 1..561: mol_type = genomic DNA
cagcggccgggatcccgctgccggcccggcccccacctgcgcgggacgggactgagggccgagctgcgccagcgggactcggccgcacactccggagccgaccgccgggaggcccggggccgccagcgctggttccagccaattccaaccgattccaaccaccccctctcccttctcgggacaccctgctccgcacactcaccatttcccagcttttgggggtcccagcgtcctccctataaatctcgcaatacctgcaggccacagggcgatggagcctgcggcagtcacccgggactctccgagaggcagcagacgggaacccagcaccccgccggccgcaaggagacaaaggccccgccagatccccaaggccgccccttcctctctggctgcacgcctgattggacagttctcacgctagcgccgctgactggatggggctccaggccccaccccctcaggtcttgagtgacaggaggtgcgatcagacactgggccgaatgaaacaagagtgacaggtttttgggtgcagcccttttgaagcgacattcctcacgg

SEQ ID NO: 104012 - DNA, 176 bp, Homo sapiens; identical to SEQ ID NO: 69073
  misc_feature 1..176: note = chr1:247185335-247185511
  misc_feature 1..176: note = Hypo
  source 1..176: mol_type = genomic DNA

SEQ ID NO: 104013 - DNA, 274 bp, Homo sapiens; identical to SEQ ID NO: 69075
  misc_feature 1..274: note = chr1:247274326-247274600
  misc_feature 1..274: note = Hyper
  source 1..274: mol_type = genomic DNA

SEQ ID NO: 104014 - DNA, 204 bp, Homo sapiens; identical to SEQ ID NO: 69076
  misc_feature 1..204: note = chr1:247274826-247275030
  misc_feature 1..204: note = Hyper
  source 1..204: mol_type = genomic DNA

SEQ ID NO: 104015 - DNA, 121 bp, Homo sapiens; identical to SEQ ID NO: 69077
  misc_feature 1..121: note = chr1:247275546-247275667
  misc_feature 1..121: note = Hyper
  source 1..121: mol_type = genomic DNA

SEQ ID NO: 104016 - DNA, 30 bp, Homo sapiens; identical to SEQ ID NO: 69078
  misc_feature 1..30: note = chr1:247278844-247278874
  misc_feature 1..30: note = Hypo
  source 1..30: mol_type = genomic DNA

SEQ ID NO: 104017 - DNA, 91 bp, Homo sapiens; identical to SEQ ID NO: 69079
  misc_feature 1..91: note = chr1:247399809-247399900
  misc_feature 1..91: note = Hypo
  source 1..91: mol_type = genomic DNA

SEQ ID NO: 104018 - DNA, 30 bp, Homo sapiens; identical to SEQ ID NO: 69081
  misc_feature 1..30: note = chr1:247582310-247582340
  misc_feature 1..30: note = Hypo
  source 1..30: mol_type = genomic DNA

SEQ ID NO: 104019 - DNA, 30 bp, Homo sapiens; identical to SEQ ID NO: 69082
  misc_feature 1..30: note = chr1:247587392-247587422
  misc_feature 1..30: note = Hypo
  source 1..30: mol_type = genomic DNA

SEQ ID NO: 104020 - DNA, 261 bp, Homo sapiens; identical to SEQ ID NO: 69083
  misc_feature 1..261: note = chr1:247589856-247590117
  misc_feature 1..261: note = Hypo
  source 1..261: mol_type = genomic DNA

SEQ ID NO: 104021 - DNA, 224 bp, Homo sapiens; identical to SEQ ID NO: 69084
  misc_feature 1..224: note = chr1:247615881-247616105
  misc_feature 1..224: note = Hypo
  source 1..224: mol_type = genomic DNA

SEQ ID NO: 104022 - DNA, 30 bp, Homo sapiens; identical to SEQ ID NO: 69085
  misc_feature 1..30: note = chr1:247617725-247617755
  misc_feature 1..30: note = Hypo
  source 1..30: mol_type = genomic DNA

SEQ ID NO: 104023 - DNA, 38 bp, Homo sapiens; identical to SEQ ID NO: 69086
  misc_feature 1..38: note = chr1:247682027-247682065
  misc_feature 1..38: note = Hypo
  source 1..38: mol_type = genomic DNA

SEQ ID NO: 104024 - DNA, 195 bp, Homo sapiens; identical to SEQ ID NO: 69088
  misc_feature 1..195: note = chr1:247694897-247695092
  misc_feature 1..195: note = Hypo
  source 1..195: mol_type = genomic DNA

SEQ ID NO: 104025 - DNA, 209 bp, Homo sapiens; identical to SEQ ID NO: 69089
  misc_feature 1..209: note = chr1:247709336-247709545
  misc_feature 1..209: note = Hypo
  source 1..209: mol_type = genomic DNA

SEQ ID NO: 104026 - DNA, 203 bp, Homo sapiens; identical to SEQ ID NO: 69090
  misc_feature 1..203: note = chr1:247752018-247752221
  misc_feature 1..203: note = Hypo
  source 1..203: mol_type = genomic DNA

SEQ ID NO: 104027 - DNA, 40 bp, Homo sapiens; identical to SEQ ID NO: 69091
  misc_feature 1..40: note = chr1:247910639-247910679
  misc_feature 1..40: note = Hypo
  source 1..40: mol_type = genomic DNA

SEQ ID NO: 104028 - DNA, 28 bp, Homo sapiens
  misc_feature 1..28: note = chr1:247994928-247994956
  misc_feature 1..28: note = Hypo
  source 1..28: mol_type = genomic DNA
tattctggccaggtgcggtggctcatgc

SEQ ID NO: 104029 - DNA, 32 bp, Homo sapiens; identical to SEQ ID NO: 39368
  misc_feature 1..32: note = chr1:248002278-248002310
  misc_feature 1..32: note = Hypo
  source 1..32: mol_type = genomic DNA

SEQ ID NO: 104030 - DNA, 1034 bp, Homo sapiens
  misc_feature 1..1034: note = chr1:248020315-248021349
  misc_feature 1..1034: note = Hyper
  source 1..1034: mol_type = genomic DNA
tgggtgtgtgtgtgacgggggcggggaaccacaacgttaattttatccccgacatagggagcgcctgagtggtggcttttcaccgggtgtggctcgtctgagctcttgaactgaagccagcggacaccacccgtcggcgcctgctttcctggggcgtgggctcctccccctgtgcagaccgcgaggggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaacttgccata

SEQ ID NO: 104031 - DNA, 22 bp, Homo sapiens
  misc_feature 1..22: note = chr1:248026563-248026585
  misc_feature 1..22: note = Hypo
  source 1..22: mol_type = genomic DNA
gggcacagtggctcacgcctgt

SEQ ID NO: 104032 - DNA, 141 bp, Homo sapiens; identical to SEQ ID NO: 69098
  misc_feature 1..141: note = chr1:248026825-248026966
  misc_feature 1..141: note = Hypo
  source 1..141: mol_type = genomic DNA

SEQ ID NO: 104033 - DNA, 294 bp, Homo sapiens; identical to SEQ ID NO: 39370
  misc_feature 1..294: note = chr1:248027965-248028259
  misc_feature 1..294: note = Hypo
  source 1..294: mol_type = genomic DNA

SEQ ID NO: 104034 - DNA, 30 bp, Homo sapiens; identical to SEQ ID NO: 69100
  misc_feature 1..30: note = chr1:248029451-248029481
  misc_feature 1..30: note = Hypo
  source 1..30: mol_type = genomic DNA

SEQ ID NO: 104035 - DNA, 197 bp, Homo sapiens; identical to SEQ ID NO: 39371
  misc_feature 1..197: note = chr1:248034262-248034459
  misc_feature 1..197: note = Hypo
  source 1..197: mol_type = genomic DNA

SEQ ID NO: 104036 - DNA, 113 bp, Homo sapiens; identical to SEQ ID NO: 69102
  misc_feature 1..113: note = chr1:248039213-248039326
  misc_feature 1..113: note = Hypo
  source 1..113: mol_type = genomic DNA

SEQ ID NO: 104037 - DNA, 22 bp, Homo sapiens
  misc_feature 1..22: note = chr1:248047093-248047115
  misc_feature 1..22: note = Hypo
  source 1..22: mol_type = genomic DNA
taaattatgacaggccgggcgt

SEQ ID NO: 104038 - DNA, 120 bp, Homo sapiens; identical to SEQ ID NO: 69104
  misc_feature 1..120: note = chr1:248047790-248047910
  misc_feature 1..120: note = Hypo
  source 1..120: mol_type = genomic DNA

SEQ ID NO: 104039 - DNA, 37 bp, Homo sapiens; identical to SEQ ID NO: 69105
  misc_feature 1..37: note = chr1:248048162-248048199
  misc_feature 1..37: note = Hypo
  source 1..37: mol_type = genomic DNA

SEQ ID NO: 104040 - DNA, 34 bp, Homo sapiens; identical to SEQ ID NO: 69106
  misc_feature 1..34: note = chr1:248074314-248074348
  misc_feature 1..34: note = Hypo
  source 1..34: mol_type = genomic DNA

SEQ ID NO: 104041 - DNA, 90 bp, Homo sapiens; identical to SEQ ID NO: 69107
  misc_feature 1..90: note = chr1:248074687-248074777
  misc_feature 1..90: note = Hypo
  source 1..90: mol_type = genomic DNA

SEQ ID NO: 104042 - DNA, 90 bp, Homo sapiens; identical to SEQ ID NO: 69108
  misc_feature 1..90: note = chr1:248074837-248074927
  misc_feature 1..90: note = Hypo
  source 1..90: mol_type = genomic DNA

SEQ ID NO: 104043 - DNA, 32 bp, Homo sapiens; identical to SEQ ID NO: 69109
  misc_feature 1..32: note = chr1:248092102-248092134
  misc_feature 1..32: note = Hypo
  source 1..32: mol_type = genomic DNA

SEQ ID NO: 104044 - DNA, 21 bp, Homo sapiens
  misc_feature 1..21: note = chr1:248098787-248098808
  misc_feature 1..21: note = Hypo
  source 1..21: mol_type = genomic DNA
aatgtatgggccaggcgcggt

SEQ ID NO: 104045 - DNA, 30 bp, Homo sapiens; identical to SEQ ID NO: 39377
  misc_feature 1..30: note = chr1:248099290-248099320
  misc_feature 1..30: note = Hypo
  source 1..30: mol_type = genomic DNA

SEQ ID NO: 104046 - DNA, 424 bp, Homo sapiens; identical to SEQ ID NO: 69112
  misc_feature 1..424: note = chr1:248099705-248100129
  misc_feature 1..424: note = Hypo
  source 1..424: mol_type = genomic DNA

SEQ ID NO: 104047 - DNA, 203 bp, Homo sapiens; identical to SEQ ID NO: 69113
  misc_feature 1..203: note = chr1:248140923-248141126
  misc_feature 1..203: note = Hypo
  source 1..203: mol_type = genomic DNA

SEQ ID NO: 104048 - DNA, 30 bp, Homo sapiens; identical to SEQ ID NO: 69114
  misc_feature 1..30: note = chr1:248244670-248244700
  misc_feature 1..30: note = Hypo
  source 1..30: mol_type = genomic DNA

SEQ ID NO: 104049 - DNA, 30 bp, Homo sapiens; identical to SEQ ID NO: 69115
  misc_feature 1..30: note = chr1:248292238-248292268
  misc_feature 1..30: note = Hypo
  source 1..30: mol_type = genomic DNA

SEQ ID NO: 104050 - DNA, 203 bp, Homo sapiens; identical to SEQ ID NO: 39379
  misc_feature 1..203: note = chr1:248328673-248328876
  misc_feature 1..203: note = Hypo
  source 1..203: mol_type = genomic DNA

SEQ ID NO: 104051 - DNA, 30 bp, Homo sapiens; identical to SEQ ID NO: 39380
  misc_feature 1..30: note = chr1:248329246-248329276
  misc_feature 1..30: note = Hypo
  source 1..30: mol_type = genomic DNA

SEQ ID NO: 104052 - DNA, 30 bp, Homo sapiens; identical to SEQ ID NO: 69119
  misc_feature 1..30: note = chr1:248538382-248538412
  misc_feature 1..30: note = Hypo
  source 1..30: mol_type = genomic DNA

SEQ ID NO: 104053 - DNA, 30 bp, Homo sapiens; identical to SEQ ID NO: 69120
  misc_feature 1..30: note = chr1:248685560-248685590
  misc_feature 1..30: note = Hypo
  source 1..30: mol_type = genomic DNA

SEQ ID NO: 104054 - DNA, 126 bp, Homo sapiens; identical to SEQ ID NO: 69121
  misc_feature 1..126: note = chr1:248792899-248793025
  misc_feature 1..126: note = Hypo
  source 1..126: mol_type = genomic DNA

SEQ ID NO: 104055 - DNA, 24 bp, Homo sapiens
  misc_feature 1..24: note = chr1:249121618-249121642
  misc_feature 1..24: note = Hypo
  source 1..24: mol_type = genomic DNA
gagccaccacgcccagcctagctt

SEQ ID NO: 104056 - DNA, 30 bp, Homo sapiens; identical to SEQ ID NO: 69123
  misc_feature 1..30: note = chr1:249151579-249151609
  misc_feature 1..30: note = Hypo
  source 1..30: mol_type = genomic DNA

SEQ ID NO: 104057 - DNA, 129 bp, Homo sapiens; identical to SEQ ID NO: 69124
  misc_feature 1..129: note = chr1:249212385-249212514
  misc_feature 1..129: note = Hypo
  source 1..129: mol_type = genomic DNA

SEQ ID NO: 104058 - DNA, 30 bp, Homo sapiens; identical to SEQ ID NO: 71417
  misc_feature 1..30: note = chr10:467990-468020
  misc_feature 1..30: note = Hypo
  source 1..30: mol_type = genomic DNA

SEQ ID NO: 104059 - DNA, 30 bp, Homo sapiens; identical to SEQ ID NO: 42428
  misc_feature 1..30: note = chr10:482288-482318
  misc_feature 1..30: note = Hypo
  source 1..30: mol_type = genomic DNA

SEQ ID NO: 104060 - DNA, 30 bp, Homo sapiens; identical to SEQ ID NO: 71466
  misc_feature 1..30: note = chr10:518309-518339
  misc_feature 1..30: note = Hypo
  source 1..30: mol_type = genomic DNA

SEQ ID NO: 104061 - DNA, 163 bp, Homo sapiens; identical to SEQ ID NO: 71470
  misc_feature 1..163: note = chr10:524508-524671
  misc_feature 1..163: note = Hypo
  source 1..163: mol_type = genomic DNA

SEQ ID NO: 104062 - DNA, 30 bp, Homo sapiens; identical to SEQ ID NO: 71566
  misc_feature 1..30: note = chr10:673796-673826
  misc_feature 1..30: note = Hypo
  source 1..30: mol_type = genomic DNA

SEQ ID NO: 104063 - DNA, 39 bp, Homo sapiens; identical to SEQ ID NO: 71568
  misc_feature 1..39: note = chr10:679363-679402
  misc_feature 1..39: note = Hypo
  source 1..39: mol_type = genomic DNA

SEQ ID NO: 104064 - DNA, 73 bp, Homo sapiens; identical to SEQ ID NO: 71656
  misc_feature 1..73: note = chr10:734976-735049
  misc_feature 1..73: note = Hyper
  source 1..73: mol_type = genomic DNA

SEQ ID NO: 104065 - DNA, 30 bp, Homo sapiens; identical to SEQ ID NO: 71675
  misc_feature 1..30: note = chr10:741557-741587
  misc_feature 1..30: note = Hypo
  source 1..30: mol_type = genomic DNA

SEQ ID NO: 104066 - DNA, 60 bp, Homo sapiens; identical to SEQ ID NO: 71686
  misc_feature 1..60: note = chr10:746643-746703
  misc_feature 1..60: note = Hypo
  source 1..60: mol_type = genomic DNA

SEQ ID NO: 104067 - DNA, 35 bp, Homo sapiens; identical to SEQ ID NO: 42430
  misc_feature 1..35: note = chr10:769828-769863
  misc_feature 1..35: note = Hypo
  source 1..35: mol_type = genomic DNA

SEQ ID NO: 104068 - DNA, 259 bp, Homo sapiens; identical to SEQ ID NO: 71772
  misc_feature 1..259: note = chr10:819352-819611
  misc_feature 1..259: note = Hypo
  source 1..259: mol_type = genomic DNA

SEQ ID NO: 104069 - DNA, 353 bp, Homo sapiens; identical to SEQ ID NO: 71775
  misc_feature 1..353: note = chr10:821379-821732
  misc_feature 1..353: note = Hypo
  source 1..353: mol_type = genomic DNA

SEQ ID NO: 104070 - DNA, 179 bp, Homo sapiens
  misc_feature 1..179: note = chr10:830731-830910
  misc_feature 1..179: note = Hyper
  source 1..179: mol_type = genomic DNA
gagcttccagcctcccgggtctaggggactgggggatgcgtcttcctcccgcccccgcagcgcccggggcaggagtggcatcggcgtccccggcgtccccgcatcgggcttctctggtcctttgtgaatcgggcctgagtcatccccggctcacggctgcgccacgtacccactgggcg

SEQ ID NO: 104071 - DNA, 197 bp, Homo sapiens; identical to SEQ ID NO: 71783
  misc_feature 1..197: note = chr10:833140-833337
  misc_feature 1..197: note = Hypo
  source 1..197: mol_type = genomic DNA

SEQ ID NO: 104072 - DNA, 43 bp, Homo sapiens; identical to SEQ ID NO: 71791
  misc_feature 1..43: note = chr10:838096-838139
  misc_feature 1..43: note = Hypo
  source 1..43: mol_type = genomic DNA

SEQ ID NO: 104073 - DNA, 255 bp, Homo sapiens; identical to SEQ ID NO: 71792
  misc_feature 1..255: note = chr10:851249-851504
  misc_feature 1..255: note = Hypo
  source 1..255: mol_type = genomic DNA

SEQ ID NO: 104074 - DNA, 30 bp, Homo sapiens; identical to SEQ ID NO: 71854
  misc_feature 1..30: note = chr10:963402-963432
  misc_feature 1..30: note = Hypo
  source 1..30: mol_type = genomic DNA

SEQ ID NO: 104075 - DNA, 267 bp, Homo sapiens; identical to SEQ ID NO: 71857
  misc_feature 1..267: note = chr10:978811-979078
  misc_feature 1..267: note = Hypo
  source 1..267: mol_type = genomic DNA

SEQ ID NO: 104076 - DNA, 30 bp, Homo sapiens; identical to SEQ ID NO: 70233
  misc_feature 1..30: note = chr10:1035526-1035556
  misc_feature 1..30: note = Hypo
  source 1..30: mol_type = genomic DNA

SEQ ID NO: 104077 - DNA, 165 bp, Homo sapiens; identical to SEQ ID NO: 70376
  misc_feature 1..165: note = chr10:1156723-1156888
  misc_feature 1..165: note = Hypo
  source 1..165: mol_type = genomic DNA

SEQ ID NO: 104078 - DNA, 30 bp, Homo sapiens; identical to SEQ ID NO: 70474
  misc_feature 1..30: note = chr10:1206813-1206843
  misc_feature 1..30: note = Hypo
  source 1..30: mol_type = genomic DNA

SEQ ID NO: 104079 - DNA, 52 bp, Homo sapiens; identical to SEQ ID NO: 42435
  misc_feature 1..52: note = chr10:1209169-1209221
  misc_feature 1..52: note = Hypo
  source 1..52: mol_type = genomic DNA

SEQ ID NO: 104080 - DNA, 196 bp, Homo sapiens; identical to SEQ ID NO: 70490
  misc_feature 1..196: note = chr10:1218175-1218371
  misc_feature 1..196: note = Hypo
  source 1..196: mol_type = genomic DNA

SEQ ID NO: 104081 - DNA, 150 bp, Homo sapiens; identical to SEQ ID NO: 70501
  misc_feature 1..150: note = chr10:1233090-1233240
  misc_feature 1..150: note = Hypo
  source 1..150: mol_type = genomic DNA

SEQ ID NO: 104082 - DNA, 30 bp, Homo sapiens; identical to SEQ ID NO: 70506
  misc_feature 1..30: note = chr10:1233724-1233754
  misc_feature 1..30: note = Hypo
  source 1..30: mol_type = genomic DNA

SEQ ID NO: 104083 - DNA, 135 bp, Homo sapiens; identical to SEQ ID NO: 70517
  misc_feature 1..135: note = chr10:1245923-1246058
  misc_feature 1..135: note = Hypo
  source 1..135: mol_type = genomic DNA

SEQ ID NO: 104084 - DNA, 30 bp, Homo sapiens; identical to SEQ ID NO: 42437
  misc_feature 1..30: note = chr10:1248527-1248557
  misc_feature 1..30: note = Hypo
  source 1..30: mol_type = genomic DNA

SEQ ID NO: 104085 - DNA, 43 bp, Homo sapiens; identical to SEQ ID NO: 70547
  misc_feature 1..43: note = chr10:1250432-1250475
  misc_feature 1..43: note = Hypo
  source 1..43: mol_type = genomic DNA

SEQ ID NO: 104086 - DNA, 229 bp, Homo sapiens; identical to SEQ ID NO: 70548
  misc_feature 1..229: note = chr10:1252126-1252355
  misc_feature 1..229: note = Hypo
  source 1..229: mol_type = genomic DNA

SEQ ID NO: 104087 - DNA, 30 bp, Homo sapiens; identical to SEQ ID NO: 70551
  misc_feature 1..30: note = chr10:1252590-1252620
  misc_feature 1..30: note = Hypo
  source 1..30: mol_type = genomic DNA

SEQ ID NO: 104088 - DNA, 221 bp, Homo sapiens; identical to SEQ ID NO: 42439
  misc_feature 1..221: note = chr10:1259797-1260018
  misc_feature 1..221: note = Hypo
  source 1..221: mol_type = genomic DNA

SEQ ID NO: 104089 - DNA, 35 bp, Homo sapiens; identical to SEQ ID NO: 70566
  misc_feature 1..35: note = chr10:1260381-1260416
  misc_feature 1..35: note = Hypo
  source 1..35: mol_type = genomic DNA

SEQ ID NO: 104090 - DNA, 30 bp, Homo sapiens; identical to SEQ ID NO: 70672
  misc_feature 1..30: note = chr10:1313323-1313353
  misc_feature 1..30: note = Hypo
  source 1..30: mol_type = genomic DNA

SEQ ID NO: 104091 - DNA, 30 bp, Homo sapiens; identical to SEQ ID NO: 70993
  misc_feature 1..30: note = chr10:1367578-1367608
  misc_feature 1..30: note = Hypo
  source 1..30: mol_type = genomic DNA

SEQ ID NO: 104092 - DNA, 43 bp, Homo sapiens; identical to SEQ ID NO: 70999
  misc_feature 1..43: note = chr10:1383819-1383862
  misc_feature 1..43: note = Hypo
  source 1..43: mol_type = genomic DNA

SEQ ID NO: 104093 - DNA, 30 bp, Homo sapiens; identical to SEQ ID NO: 71008
  misc_feature 1..30: note = chr10:1406940-1406970
  misc_feature 1..30: note = Hypo
  source 1..30: mol_type = genomic DNA

SEQ ID NO: 104094 - DNA, 79 bp, Homo sapiens; identical to SEQ ID NO: 71009
  misc_feature 1..79: note = chr10:1416159-1416238
  misc_feature 1..79: note = Hypo
  source 1..79: mol_type = genomic DNA

SEQ ID NO: 104095 - DNA, 30 bp, Homo sapiens; identical to SEQ ID NO: 71011
  misc_feature 1..30: note = chr10:1418261-1418291
  misc_feature 1..30: note = Hypo
  source 1..30: mol_type = genomic DNA

SEQ ID NO: 104096 - DNA, 64 bp, Homo sapiens; identical to SEQ ID NO: 71014
  misc_feature 1..64: note = chr10:1438451-1438515
  misc_feature 1..64: note = Hypo
  source 1..64: mol_type = genomic DNA

SEQ ID NO: 104097 - DNA, 92 bp, Homo sapiens; identical to SEQ ID NO: 71015
  misc_feature 1..92: note = chr10:1443474-1443566
  misc_feature 1..92: note = Hypo
  source 1..92: mol_type = genomic DNA

SEQ ID NO: 104098 - DNA, 38 bp, Homo sapiens; identical to SEQ ID NO: 71016
  misc_feature 1..38: note = chr10:1451436-1451474
  misc_feature 1..38: note = Hypo
  source 1..38: mol_type = genomic DNA

SEQ ID NO: 104099 - DNA, 332 bp, Homo sapiens; identical to SEQ ID NO: 71025
  misc_feature 1..332: note = chr10:1506252-1506584
  misc_feature 1..332: note = Hypo
  source 1..332: mol_type = genomic DNA

SEQ ID NO: 104100 - DNA, 30 bp, Homo sapiens; identical to SEQ ID NO: 42442
  misc_feature 1..30: note = chr10:1555620-1555650
  misc_feature 1..30: note = Hypo
  source 1..30: mol_type = genomic DNA

SEQ ID NO: 104101 - DNA, 244 bp, Homo sapiens; identical to SEQ ID NO: 71036
  misc_feature 1..244: note = chr10:1558592-1558836
  misc_feature 1..244: note = Hypo
  source 1..244: mol_type = genomic DNA

SEQ ID NO: 104102 - DNA, 129 bp, Homo sapiens; identical to SEQ ID NO: 71041
  misc_feature 1..129: note = chr10:1585292-1585421
  misc_feature 1..129: note = Hypo
  source 1..129: mol_type = genomic DNA

SEQ ID NO: 104103 - DNA, 30 bp, Homo sapiens; identical to SEQ ID NO: 71044
  misc_feature 1..30: note = chr10:1621521-1621551
  misc_feature 1..30: note = Hypo
  source 1..30: mol_type = genomic DNA

SEQ ID NO: 104104 - DNA, 149 bp, Homo sapiens; identical to SEQ ID NO: 71050
  misc_feature 1..149: note = chr10:1669194-1669343
  misc_feature 1..149: note = Hypo
  source 1..149: mol_type = genomic DNA

SEQ ID NO: 104105 - DNA, 38 bp, Homo sapiens; identical to SEQ ID NO: 71056
  misc_feature 1..38: note = chr10:1708651-1708689
  misc_feature 1..38: note = Hypo
  source 1..38: mol_type = genomic DNA

SEQ ID NO: 104106 - DNA, 35 bp, Homo sapiens; identical to SEQ ID NO: 71057
  misc_feature 1..35: note = chr10:1714389-1714424
  misc_feature 1..35: note = Hypo
  source 1..35: mol_type = genomic DNA

SEQ ID NO: 104107 - DNA, 186 bp, Homo sapiens; identical to SEQ ID NO: 71058
  misc_feature 1..186: note = chr10:1716294-1716480
  misc_feature 1..186: note = Hypo
  source 1..186: mol_type = genomic DNA

SEQ ID NO: 104108 - DNA, 30 bp, Homo sapiens; identical to SEQ ID NO: 71059
  misc_feature 1..30: note = chr10:1725740-1725770
  misc_feature 1..30: note = Hypo
  source 1..30: mol_type = genomic DNA

SEQ ID NO: 104109 - DNA, 165 bp, Homo sapiens; identical to SEQ ID NO: 71074
  misc_feature 1..165: note = chr10:1767764-1767929
  misc_feature 1..165: note = Hypo
  source 1..165: mol_type = genomic DNA

SEQ ID NO: 104110 - DNA, 1488 bp, Homo sapiens
  misc_feature 1..1488: note = chr10:1778568-1780056
  misc_feature 1..1488: note = Hyper
  source 1..1488: mol_type = genomic DNA
gagtttgtcagtggccgctgtcagccggctgcttttcctgctttcctggtttgcggtttttttctaccactaacaaaatatgatgcttctttctgttttcctgtattcatttctgcttatttctccaaggacgagccctgtgttctctttacgacccaatgtttacaaatcgacgggcaccacattgagtaaaaactgccagccaatttggagaggcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttccacgggatctgaactcccgagcgccctgcacggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggccgcttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaagacacagggacgggtttttccaacc

SEQ ID NO: 104111 - DNA, 41 bp, Homo sapiens; identical to SEQ ID NO: 71078
  misc_feature 1..41: note = chr10:1789225-1789266
  misc_feature 1..41: note = Hypo
  source 1..41: mol_type = genomic DNA

SEQ ID NO: 104112 - DNA, 30 bp, Homo sapiens; identical to SEQ ID NO: 71079
  misc_feature 1..30: note = chr10:1829119-1829149
  misc_feature 1..30: note = Hypo
  source 1..30: mol_type = genomic DNA

SEQ ID NO: 104113 - DNA, 90 bp, Homo sapiens; identical to SEQ ID NO: 42447
  misc_feature 1..90: note = chr10:1850230-1850320
  misc_feature 1..90: note = Hypo
  source 1..90: mol_type = genomic DNA

SEQ ID NO: 104114 - DNA, 30 bp, Homo sapiens; identical to SEQ ID NO: 71088
  misc_feature 1..30: note = chr10:1889085-1889115
  misc_feature 1..30: note = Hypo
  source 1..30: mol_type = genomic DNA

SEQ ID NO: 104115 - DNA, 30 bp, Homo sapiens; identical to SEQ ID NO: 71091
  misc_feature 1..30: note = chr10:1981745-1981775
  misc_feature 1..30: note = Hypo
  source 1..30: mol_type = genomic DNA

SEQ ID NO: 104116 - DNA, 389 bp, Homo sapiens; identical to SEQ ID NO: 71093
  misc_feature 1..389: note = chr10:1994909-1995298
  misc_feature 1..389: note = Hypo
  source 1..389: mol_type = genomic DNA

SEQ ID NO: 104117 - DNA, 30 bp, Homo sapiens; identical to SEQ ID NO: 71095
  misc_feature 1..30: note = chr10:2005972-2006002
  misc_feature 1..30: note = Hypo
  source 1..30: mol_type = genomic DNA

SEQ ID NO: 104118 - DNA, 193 bp, Homo sapiens; identical to SEQ ID NO: 71102
  misc_feature 1..193: note = chr10:2094436-2094629
  misc_feature 1..193: note = Hypo
  source 1..193: mol_type = genomic DNA

SEQ ID NO: 104119 - DNA, 30 bp, Homo sapiens; identical to SEQ ID NO: 71131
  misc_feature 1..30: note = chr10:2264537-2264567
  misc_feature 1..30: note = Hypo
  source 1..30: mol_type = genomic DNA

SEQ ID NO: 104120 - DNA, 30 bp, Homo sapiens; identical to SEQ ID NO: 15322
  misc_feature 1..30: note = chr10:2283030-2283060
  misc_feature 1..30: note = Hypo
  source 1..30: mol_type = genomic DNA

SEQ ID NO: 104121 - DNA, 126 bp, Homo sapiens; identical to SEQ ID NO: 71167
  misc_feature 1..126: note = chr10:2374203-2374329
  misc_feature 1..126: note = Hypo
  source 1..126: mol_type = genomic DNA

SEQ ID NO: 104122 - DNA, 102 bp, Homo sapiens; identical to SEQ ID NO: 42450
  misc_feature 1..102: note = chr10:2452926-2453028
  misc_feature 1..102: note = Hypo
  source 1..102: mol_type = genomic DNA

SEQ ID NO: 104123 - DNA, 30 bp, Homo sapiens; identical to SEQ ID NO: 71191
  misc_feature 1..30: note = chr10:2620590-2620620
  misc_feature 1..30: note = Hypo
  source 1..30: mol_type = genomic DNA

SEQ ID NO: 104124 - DNA, 30 bp, Homo sapiens; identical to SEQ ID NO: 42451
  misc_feature 1..30: note = chr10:2706731-2706761
  misc_feature 1..30: note = Hypo
  source 1..30: mol_type = genomic DNA

SEQ ID NO: 104125 - DNA, 222 bp, Homo sapiens; identical to SEQ ID NO: 71244
  misc_feature 1..222: note = chr10:2758950-2759172
  misc_feature 1..222: note = Hypo
  source 1..222: mol_type = genomic DNA

SEQ ID NO: 104126 - DNA, 54 bp, Homo sapiens; identical to SEQ ID NO: 71245
  misc_feature 1..54: note = chr10:2775287-2775341
  misc_feature 1..54: note = Hypo
  source 1..54: mol_type = genomic DNA

SEQ ID NO: 104127 - DNA, 30 bp, Homo sapiens; identical to SEQ ID NO: 71261
  misc_feature 1..30: note = chr10:2871024-2871054
  misc_feature 1..30: note = Hypo
  source 1..30: mol_type = genomic DNA

SEQ ID NO: 104128 - DNA, 30 bp, Homo sapiens; identical to SEQ ID NO: 71270
  misc_feature 1..30: note = chr10:2908213-2908243
  misc_feature 1..30: note = Hypo
  source 1..30: mol_type = genomic DNA

SEQ ID NO: 104129 - DNA, 30 bp, Homo sapiens; identical to SEQ ID NO: 71272
  misc_feature 1..30: note = chr10:2921407-2921437
  misc_feature 1..30: note = Hypo
  source 1..30: mol_type = genomic DNA

SEQ ID NO: 104130 - DNA, 30 bp, Homo sapiens; identical to SEQ ID NO: 71274
  misc_feature 1..30: note = chr10:2932563-2932593
  misc_feature 1..30: note = Hypo
  source 1..30: mol_type = genomic DNA

SEQ ID NO: 104131 - DNA, 30 bp, Homo sapiens; identical to SEQ ID NO: 71275
  misc_feature 1..30: note = chr10:2969923-2969953
  misc_feature 1..30: note = Hypo
  source 1..30: mol_type = genomic DNA

SEQ ID NO: 104132 - DNA, 91 bp, Homo sapiens; identical to SEQ ID NO: 71283
  misc_feature 1..91: note = chr10:3063272-3063363
  misc_feature 1..91: note = Hypo
  source 1..91: mol_type = genomic DNA

SEQ ID NO: 104133 - DNA, 266 bp, Homo sapiens
  misc_feature 1..266: note = chr10:3108902-3109168
  misc_feature 1..266: note = Hyper
  source 1..266: mol_type = genomic DNA
gggaaatggcagcttcgtcatggcccagcccgccacgctcaccttttcccaccacctggaggatccactctccgtccgtccttcccgacctcaggctgcagaggaaacctgggggcgggggtcgaggaagccgagccccgaggctcccagcgccgccccaggaggaatcttgcgggccactagaagctgtgcgcgcggccgggctcggcccccacaacggcccgagcggccgggcctgccgcgagcctccgcgtccaggtggggtc

SEQ ID NO: 104134 - DNA, 34 bp, Homo sapiens; identical to SEQ ID NO: 71293
  misc_feature 1..34: note = chr10:3118378-3118412
  misc_feature 1..34: note = Hypo
  source 1..34: mol_type = genomic DNA

SEQ ID NO: 104135 - DNA, 183 bp, Homo sapiens; identical to SEQ ID NO: 71297
  misc_feature 1..183: note = chr10:3160988-3161171
  misc_feature 1..183: note = Hypo
  source 1..183: mol_type = genomic DNA

SEQ ID NO: 104136 - DNA, 138 bp, Homo sapiens; identical to SEQ ID NO: 71302
  misc_feature 1..138: note = chr10:3216467-3216605
  misc_feature 1..138: note = Hypo
  source 1..138: mol_type = genomic DNA

SEQ ID NO: 104137 - DNA, 30 bp, Homo sapiens; identical to SEQ ID NO: 71310
  misc_feature 1..30: note = chr10:3280167-3280197
  misc_feature 1..30: note = Hypo
  source 1..30: mol_type = genomic DNA

SEQ ID NO: 104138 - DNA, 23 bp, Homo sapiens
  misc_feature 1..23: note = chr10:3285542-3285565
  misc_feature 1..23: note = Hypo
  source 1..23: mol_type = genomic DNA
aacaaatgagccaggcgtgctgg

SEQ ID NO: 104139 - DNA, 83 bp, Homo sapiens; identical to SEQ ID NO: 71312
  misc_feature 1..83: note = chr10:3285685-3285768
  misc_feature 1..83: note = Hypo
  source 1..83: mol_type = genomic DNA

SEQ ID NO: 104140 - DNA, 30 bp, Homo sapiens; identical to SEQ ID NO: 71314
  misc_feature 1..30: note = chr10:3329449-3329479
  misc_feature 1..30: note = Hypo
  source 1..30: mol_type = genomic DNA

SEQ ID NO: 104141 - DNA, 270 bp, Homo sapiens; identical to SEQ ID NO: 71315
  misc_feature 1..270: note = chr10:3329539-3329809
  misc_feature 1..270: note = Hypo
  source 1..270: mol_type = genomic DNA

SEQ ID NO: 104142 - DNA, 30 bp, Homo sapiens; identical to SEQ ID NO: 71316
  misc_feature 1..30: note = chr10:3330158-3330188
  misc_feature 1..30: note = Hypo
  source 1..30: mol_type = genomic DNA

SEQ ID NO: 104143 - DNA, 204 bp, Homo sapiens; identical to SEQ ID NO: 71317
  misc_feature 1..204: note = chr10:3330414-3330618
  misc_feature 1..204: note = Hypo
  source 1..204: mol_type = genomic DNA

SEQ ID NO: 104144 - DNA, 30 bp, Homo sapiens; identical to SEQ ID NO: 71324
  misc_feature 1..30: note = chr10:3438367-3438397
  misc_feature 1..30: note = Hypo
  source 1..30: mol_type = genomic DNA

SEQ ID NO: 104145 - DNA, 39 bp, Homo sapiens; identical to SEQ ID NO: 71325
  misc_feature 1..39: note = chr10:3440138-3440177
  misc_feature 1..39: note = Hypo
  source 1..39: mol_type = genomic DNA

SEQ ID NO: 104146 - DNA, 83 bp, Homo sapiens; identical to SEQ ID NO: 71338
  misc_feature 1..83: note = chr10:3641339-3641422
  misc_feature 1..83: note = Hypo
  source 1..83: mol_type = genomic DNA

SEQ ID NO: 104147 - DNA, 82 bp, Homo sapiens; identical to SEQ ID NO: 71339
  misc_feature 1..82: note = chr10:3678219-3678301
  misc_feature 1..82: note = Hypo
  source 1..82: mol_type = genomic DNA

SEQ ID NO: 104148 - DNA, 261 bp, Homo sapiens; identical to SEQ ID NO: 71340
  misc_feature 1..261: note = chr10:3678601-3678862
  misc_feature 1..261: note = Hypo
  source 1..261: mol_type = genomic DNA

SEQ ID NO: 104149 - DNA, 30 bp, Homo sapiens; identical to SEQ ID NO: 71347
  misc_feature 1..30: note = chr10:3862581-3862611
  misc_feature 1..30: note = Hypo
  source 1..30: mol_type = genomic DNA

SEQ ID NO: 104150 - DNA, 177 bp, Homo sapiens; identical to SEQ ID NO: 71349
  misc_feature 1..177: note = chr10:3895354-3895531
  misc_feature 1..177: note = Hypo
  source 1..177: mol_type = genomic DNA

SEQ ID NO: 104151 - DNA, 163 bp, Homo sapiens; identical to SEQ ID NO: 71350
  misc_feature 1..163: note = chr10:3983403-3983566
  misc_feature 1..163: note = Hypo
  source 1..163: mol_type = genomic DNA

SEQ ID NO: 104152 - DNA, 228 bp, Homo sapiens; identical to SEQ ID NO: 71411
  misc_feature 1..228: note = chr10:4599777-4600005
  misc_feature 1..228: note = Hypo
  source 1..228: mol_type = genomic DNA

SEQ ID NO: 104153 - DNA, 30 bp, Homo sapiens; identical to SEQ ID NO: 32855
  misc_feature 1..30: note = chr10:4698935-4698965
  misc_feature 1..30: note = Hyper
  source 1..30: mol_type = genomic DNA

SEQ ID NO: 104154 - DNA, 185 bp, Homo sapiens; identical to SEQ ID NO: 42464
  misc_feature 1..185: note = chr10:5507960-5508145
  misc_feature 1..185: note = Hypo
  source 1..185: mol_type = genomic DNA

SEQ ID NO: 104155 - DNA, 30 bp, Homo sapiens; identical to SEQ ID NO: 42465
  misc_feature 1..30: note = chr10:5523260-5523290
  misc_feature 1..30: note = Hypo
  source 1..30: mol_type = genomic DNA

SEQ ID NO: 104156 - DNA, 355 bp, Homo sapiens; identical to SEQ ID NO: 71484
  misc_feature 1..355: note = chr10:5530764-5531119
  misc_feature 1..355: note = Hypo
  source 1..355: mol_type = genomic DNA

SEQ ID NO: 104157 - DNA, 163 bp, Homo sapiens; identical to SEQ ID NO: 71485
  misc_feature 1..163: note = chr10:5538775-5538938
  misc_feature 1..163: note = Hypo
  source 1..163: mol_type = genomic DNA

SEQ ID NO: 104158 - DNA, 877 bp, Homo sapiens; identical to SEQ ID NO: 42469
  misc_feature 1..877: note = chr10:5540651-5541528
  misc_feature 1..877: note = Hypo
  source 1..877: mol_type = genomic DNA

SEQ ID NO: 104159 - DNA, 30 bp, Homo sapiens; identical to SEQ ID NO: 71487
  misc_feature 1..30: note = chr10:5546861-5546891
  misc_feature 1..30: note = Hypo
  source 1..30: mol_type = genomic DNA

SEQ ID NO: 104160 - DNA, 44 bp, Homo sapiens; identical to SEQ ID NO: 71488
  misc_feature 1..44: note = chr10:5551853-5551897
  misc_feature 1..44: note = Hypo
  source 1..44: mol_type = genomic DNA

SEQ ID NO: 104161 - DNA, 47 bp, Homo sapiens; identical to SEQ ID NO: 42470
  misc_feature 1..47: note = chr10:5553281-5553328
  misc_feature 1..47: note = Hypo
  source 1..47: mol_type = genomic DNA

SEQ ID NO: 104162 - DNA, 87 bp, Homo sapiens; identical to SEQ ID NO: 71490
  misc_feature 1..87: note = chr10:5567123-5567210
  misc_feature 1..87: note = Hypo
  source 1..87: mol_type = genomic DNA

SEQ ID NO: 104163 - DNA, 30 bp, Homo sapiens; identical to SEQ ID NO: 71491
  misc_feature 1..30: note = chr10:5567536-5567566
  misc_feature 1..30: note = Hypo
  source 1..30: mol_type = genomic DNA

SEQ ID NO: 104164 - DNA, 58 bp, Homo sapiens; identical to SEQ ID NO: 71492
  misc_feature 1..58: note = chr10:5576230-5576288
  misc_feature 1..58: note = Hypo
  source 1..58: mol_type = genomic DNA

SEQ ID NO: 104165 - DNA, 30 bp, Homo sapiens; identical to SEQ ID NO: 71493
  misc_feature 1..30: note = chr10:5576653-5576683
  misc_feature 1..30: note = Hypo
  source 1..30: mol_type = genomic DNA

SEQ ID NO: 104166 - DNA, 211 bp, Homo sapiens; identical to SEQ ID NO: 71494
  misc_feature 1..211: note = chr10:5588268-5588479
  misc_feature 1..211: note = Hypo
  source 1..211: mol_type = genomic DNA

SEQ ID NO: 104167 - DNA, 30 bp, Homo sapiens; identical to SEQ ID NO: 71495
  misc_feature 1..30: note = chr10:5617971-5618001
  misc_feature 1..30: note = Hypo
  source 1..30: mol_type = genomic DNA

SEQ ID NO: 104168 - DNA, 30 bp, Homo sapiens; identical to SEQ ID NO: 71503
  misc_feature 1..30: note = chr10:5757140-5757170
  misc_feature 1..30: note = Hypo
  source 1..30: mol_type = genomic DNA

SEQ ID NO: 104169 - DNA, 160 bp, Homo sapiens; identical to SEQ ID NO: 42473
  misc_feature 1..160: note = chr10:5868078-5868238
  misc_feature 1..160: note = Hypo
  source 1..160: mol_type = genomic DNA

SEQ ID NO: 104170 - DNA, 570 bp, Homo sapiens; identical to SEQ ID NO: 42474
  misc_feature 1..570: note = chr10:5874775-5875345
  misc_feature 1..570: note = Hypo
  source 1..570: mol_type = genomic DNA

SEQ ID NO: 104171 - DNA, 48 bp, Homo sapiens; identical to SEQ ID NO: 42475
  misc_feature 1..48: note = chr10:5952951-5952999
  misc_feature 1..48: note = Hypo
  source 1..48: mol_type = genomic DNA

SEQ ID NO: 104172 - DNA, 294 bp, Homo sapiens; identical to SEQ ID NO: 71509
  misc_feature 1..294: note = chr10:5998554-5998848
  misc_feature 1..294: note = Hypo
  source 1..294: mol_type = genomic DNA

SEQ ID NO: 104173 - DNA, 45 bp, Homo sapiens; identical to SEQ ID NO: 42476
  misc_feature 1..45: note = chr10:6003482-6003527
  misc_feature 1..45: note = Hypo
  source 1..45: mol_type = genomic DNA

SEQ ID NO: 104174 - DNA, 26 bp, Homo sapiens
  misc_feature 1..26: note = chr10:6009733-6009759
  misc_feature 1..26: note = Hypo
  source 1..26: mol_type = genomic DNA
agaataggctgggtgcggtagctcac

SEQ ID NO: 104175 - DNA, 30 bp, Homo sapiens; identical to SEQ ID NO: 71512
  misc_feature 1..30: note = chr10:6018636-6018666
  misc_feature 1..30: note = Hyper
  source 1..30: mol_type = genomic DNA

SEQ ID NO: 104176 - DNA, 44 bp, Homo sapiens; identical to SEQ ID NO: 71513
  misc_feature 1..44: note = chr10:6024581-6024625
  misc_feature 1..44: note = Hypo
  source 1..44: mol_type = genomic DNA

SEQ ID NO: 104177 - DNA, 30 bp, Homo sapiens; identical to SEQ ID NO: 71518
  misc_feature 1..30: note = chr10:6041312-6041342
  misc_feature 1..30: note = Hypo
  source 1..30: mol_type = genomic DNA

SEQ ID NO: 104178 - DNA, 205 bp, Homo sapiens; identical to SEQ ID NO: 15336
  misc_feature 1..205: note = chr10:6042309-6042514
  misc_feature 1..205: note = Hypo
  source 1..205: mol_type = genomic DNA

SEQ ID NO: 104179 - DNA, 28 bp, Homo sapiens
  misc_feature 1..28: note = chr10:6055232-6055260
  misc_feature 1..28: note = Hypo
  source 1..28: mol_type = genomic DNA
tgcagttgtgctgtccgataacacagac

SEQ ID NO: 104180 - DNA, 88 bp, Homo sapiens; identical to SEQ ID NO: 71521
  misc_feature 1..88: note = chr10:6055320-6055408
  misc_feature 1..88: note = Hypo
  source 1..88: mol_type = genomic DNA

SEQ ID NO: 104181 - DNA, 30 bp, Homo sapiens; identical to SEQ ID NO: 71525
  misc_feature 1..30: note = chr10:6109019-6109049
  misc_feature 1..30: note = Hypo
  source 1..30: mol_type = genomic DNA

SEQ ID NO: 104182 - DNA, 24 bp, Homo sapiens
  misc_feature 1..24: note = chr10:6127024-6127048
  misc_feature 1..24: note = Hypo
  source 1..24: mol_type = genomic DNA
gagccaccgcgcccagccttcttt

SEQ ID NO: 104183 - DNA, 205 bp, Homo sapiens; identical to SEQ ID NO: 71530
  misc_feature 1..205: note = chr10:6159761-6159966
  misc_feature 1..205: note = Hypo
  source 1..205: mol_type = genomic DNA

SEQ ID NO: 104184 - DNA, 87 bp, Homo sapiens; identical to SEQ ID NO: 42482
  misc_feature 1..87: note = chr10:6162138-6162225
  misc_feature 1..87: note = Hypo
  source 1..87: mol_type = genomic DNA

SEQ ID NO: 104185 - DNA, 24 bp, Homo sapiens
  misc_feature 1..24: note = chr10:6199196-6199220
  misc_feature 1..24: note = Hypo
  source 1..24: mol_type = genomic DNA
tttttttttttgagacggagtctc

SEQ ID NO: 104186 - DNA, 18 bp, Homo sapiens
  misc_feature 1..18: note = chr10:6222017-6222035
  misc_feature 1..18: note = Hypo
  source 1..18: mol_type = genomic DNA
tgtgtgggccaggctcgg

SEQ ID NO: 104187 - DNA, 152 bp, Homo sapiens; identical to SEQ ID NO: 71535
  misc_feature 1..152: note = chr10:6242759-6242911
  misc_feature 1..152: note = Hyper
  source 1..152: mol_type = genomic DNA

SEQ ID NO: 104188 - DNA, 30 bp, Homo sapiens; identical to SEQ ID NO: 71537
  misc_feature 1..30: note = chr10:6261147-6261177
  misc_feature 1..30: note = Hypo
  source 1..30: mol_type = genomic DNA

SEQ ID NO: 104189 - DNA, 133 bp, Homo sapiens; identical to SEQ ID NO: 42484
  misc_feature 1..133: note = chr10:6462190-6462323
  misc_feature 1..133: note = Hypo
  source 1..133: mol_type = genomic DNA

SEQ ID NO: 104190 - DNA, 186 bp, Homo sapiens; identical to SEQ ID NO: 42485
  misc_feature 1..186: note = chr10:6505370-6505556
  misc_feature 1..186: note = Hypo
  source 1..186: mol_type = genomic DNA

SEQ ID NO: 104191 - DNA, 130 bp, Homo sapiens; identical to SEQ ID NO: 71552
  misc_feature 1..130: note = chr10:6520821-6520951
  misc_feature 1..130: note = Hypo
  source 1..130: mol_type = genomic DNA

SEQ ID NO: 104192 - DNA, 178 bp, Homo sapiens; identical to SEQ ID NO: 71553
  misc_feature 1..178: note = chr10:6527860-6528038
  misc_feature 1..178: note = Hypo
  source 1..178: mol_type = genomic DNA

SEQ ID NO: 104193 - DNA, 140 bp, Homo sapiens; identical to SEQ ID NO: 42487
  misc_feature 1..140: note = chr10:6531036-6531176
  misc_feature 1..140: note = Hypo
  source 1..140: mol_type = genomic DNA

SEQ ID NO: 104194 - DNA, 30 bp, Homo sapiens; identical to SEQ ID NO: 71555
  misc_feature 1..30: note = chr10:6531585-6531615
  misc_feature 1..30: note = Hypo
  source 1..30: mol_type = genomic DNA

SEQ ID NO: 104195 - DNA, 163 bp, Homo sapiens; identical to SEQ ID NO: 71556
  misc_feature 1..163: note = chr10:6562091-6562254
  misc_feature 1..163: note = Hypo
  source 1..163: mol_type = genomic DNA

SEQ ID NO: 104196 - DNA, 118 bp, Homo sapiens; identical to SEQ ID NO: 42489
  misc_feature 1..118: note = chr10:6577643-6577761
  misc_feature 1..118: note = Hypo
  source 1..118: mol_type = genomic DNA

SEQ ID NO: 104197 - DNA, 30 bp, Homo sapiens; identical to SEQ ID NO: 71558
  misc_feature 1..30: note = chr10:6586370-6586400
  misc_feature 1..30: note = Hypo
  source 1..30: mol_type = genomic DNA

SEQ ID NO: 104198 - DNA, 21 bp, Homo sapiens
  misc_feature 1..21: note = chr10:6586866-6586887
  misc_feature 1..21: note = Hypo
  source 1..21: mol_type = genomic DNA
ccactgcgcccagacccacat

SEQ ID NO: 104199 - DNA, 23 bp, Homo sapiens
  misc_feature 1..23: note = chr10:6591880-6591903
  misc_feature 1..23: note = Hypo
  source 1..23: mol_type = genomic DNA
accgcgcccggctgaaattcacc

SEQ ID NO: 104200 - DNA, 186 bp, Homo sapiens; identical to SEQ ID NO: 71561
  misc_feature 1..186: note = chr10:6622520-6622706
  misc_feature 1..186: note = Hyper
  source 1..186: mol_type = genomic DNA

SEQ ID NO: 104201 - DNA, 30 bp, Homo sapiens; identical to SEQ ID NO: 71563
  misc_feature 1..30: note = chr10:6661702-6661732
  misc_feature 1..30: note = Hypo
  source 1..30: mol_type = genomic DNA

SEQ ID NO: 104202 - DNA, 198 bp, Homo sapiens; identical to SEQ ID NO: 71564
  misc_feature 1..198: note = chr10:6666769-6666967
  misc_feature 1..198: note = Hypo
  source 1..198: mol_type = genomic DNA

SEQ ID NO: 104203 - DNA, 26 bp, Homo sapiens
  misc_feature 1..26: note = chr10:6680303-6680329
  misc_feature 1..26: note = Hypo
  source 1..26: mol_type = genomic DNA
attttcttaagaagtcggtcacgcct

SEQ ID NO: 104204 - DNA, 21 bp, Homo sapiens
  misc_feature 1..21: note = chr10:6781373-6781394
  misc_feature 1..21: note = Hypo
  source 1..21: mol_type = genomic DNA
ttgcatagccgggctcggtgg

SEQ ID NO: 104205 - DNA, 25 bp, Homo sapiens
  misc_feature 1..25: note = chr10:6810214-6810239
  misc_feature 1..25: note = Hypo
  source 1..25: mol_type = genomic DNA
attaagcttgtaggccgggcgtggt

SEQ ID NO: 104206 - DNA, 106 bp, Homo sapiens; identical to SEQ ID NO: 71575
  misc_feature 1..106: note = chr10:6962043-6962149
  misc_feature 1..106: note = Hyper
  source 1..106: mol_type = genomic DNA

SEQ ID NO: 104207 - DNA, 30 bp, Homo sapiens; identical to SEQ ID NO: 71576
  misc_feature 1..30: note = chr10:6984700-6984730
  misc_feature 1..30: note = Hypo
  source 1..30: mol_type = genomic DNA

SEQ ID NO: 104208 - DNA, 40 bp, Homo sapiens; identical to SEQ ID NO: 71578
  misc_feature 1..40: note = chr10:7028274-7028314
  misc_feature 1..40: note = Hypo
  source 1..40: mol_type = genomic DNA

SEQ ID NO: 104209 - DNA, 75 bp, Homo sapiens; identical to SEQ ID NO: 71585
  misc_feature 1..75: note = chr10:7105495-7105570
  misc_feature 1..75: note = Hypo
  source 1..75: mol_type = genomic DNA

SEQ ID NO: 104210 - DNA, 192 bp, Homo sapiens; identical to SEQ ID NO: 71601
  misc_feature 1..192: note = chr10:7139938-7140130
  misc_feature 1..192: note = Hypo
  source 1..192: mol_type = genomic DNA

SEQ ID NO: 104211 - DNA, 30 bp, Homo sapiens; identical to SEQ ID NO: 71604
  misc_feature 1..30: note = chr10:7156226-7156256
  misc_feature 1..30: note = Hypo
  source 1..30: mol_type = genomic DNA

SEQ ID NO: 104212 - DNA, 30 bp, Homo sapiens; identical to SEQ ID NO: 71605
  misc_feature 1..30: note = chr10:7164293-7164323
  misc_feature 1..30: note = Hypo
  source 1..30: mol_type = genomic DNA

SEQ ID NO: 104213 - DNA, 158 bp, Homo sapiens; identical to SEQ ID NO: 71608
  misc_feature 1..158: note = chr10:7202969-7203127
  misc_feature 1..158: note = Hypo
  source 1..158: mol_type = genomic DNA

SEQ ID NO: 104214 - DNA, 110 bp, Homo sapiens; identical to SEQ ID NO: 71610
  misc_feature 1..110: note = chr10:7205677-7205787
  misc_feature 1..110: note = Hypo
  source 1..110: mol_type = genomic DNA

SEQ ID NO: 104215 - DNA, 30 bp, Homo sapiens; identical to SEQ ID NO: 71611
  misc_feature 1..30: note = chr10:7209019-7209049
  misc_feature 1..30: note = Hypo
  source 1..30: mol_type = genomic DNA

SEQ ID NO: 104216 - DNA, 30 bp, Homo sapiens; identical to SEQ ID NO: 71612
  misc_feature 1..30: note = chr10:7211951-7211981
  misc_feature 1..30: note = Hypo
  source 1..30: mol_type = genomic DNA

SEQ ID NO: 104217 - DNA, 378 bp, Homo sapiens; identical to SEQ ID NO: 71613
  misc_feature 1..378: note = chr10:7212745-7213123
  misc_feature 1..378: note = Hypo
  source 1..378: mol_type = genomic DNA

SEQ ID NO: 104218 - DNA, 833 bp, Homo sapiens; identical to SEQ ID NO: 71614
  misc_feature 1..833: note = chr10:7213624-7214457
  misc_feature 1..833: note = Hypo
  source 1..833: mol_type = genomic DNA

SEQ ID NO: 104219 - DNA, 314 bp, Homo sapiens; identical to SEQ ID NO: 71615
  misc_feature 1..314: note = chr10:7215974-7216288
  misc_feature 1..314: note = Hypo
  source 1..314: mol_type = genomic DNA

SEQ ID NO: 104220 - DNA, 166 bp, Homo sapiens; identical to SEQ ID NO: 71616
  misc_feature 1..166: note = chr10:7216521-7216687
  misc_feature 1..166: note = Hypo
  source 1..166: mol_type = genomic DNA

SEQ ID NO: 104221 - DNA, 43 bp, Homo sapiens; identical to SEQ ID NO: 71617
  misc_feature 1..43: note = chr10:7219062-7219105
  misc_feature 1..43: note = Hypo
  source 1..43: mol_type = genomic DNA

SEQ ID NO: 104222 - DNA, 30 bp, Homo sapiens; identical to SEQ ID NO: 71624
  misc_feature 1..30: note = chr10:7234209-7234239
  misc_feature 1..30: note = Hypo
  source 1..30: mol_type = genomic DNA

SEQ ID NO: 104223 - DNA, 155 bp, Homo sapiens; identical to SEQ ID NO: 42498
  misc_feature 1..155: note = chr10:7236090-7236245
  misc_feature 1..155: note = Hypo
  source 1..155: mol_type = genomic DNA

SEQ ID NO: 104224 - DNA, 30 bp, Homo sapiens; identical to SEQ ID NO: 71626
  misc_feature 1..30: note = chr10:7237870-7237900
  misc_feature 1..30: note = Hypo
  source 1..30: mol_type = genomic DNA

SEQ ID NO: 104225 - DNA, 30 bp, Homo sapiens; identical to SEQ ID NO: 71627
  misc_feature 1..30: note = chr10:7240552-7240582
  misc_feature 1..30: note = Hypo
  source 1..30: mol_type = genomic DNA

SEQ ID NO: 104226 - DNA, 52 bp, Homo sapiens; identical to SEQ ID NO: 71632
  misc_feature 1..52: note = chr10:7255513-7255565
  misc_feature 1..52: note = Hypo
  source 1..52: mol_type = genomic DNA

SEQ ID NO: 104227 - DNA, 81 bp, Homo sapiens; identical to SEQ ID NO: 71633
  misc_feature 1..81: note = chr10:7258531-7258612
  misc_feature 1..81: note = Hypo
  source 1..81: mol_type = genomic DNA

SEQ ID NO: 104228 - DNA, 102 bp, Homo sapiens; identical to SEQ ID NO: 71635
  misc_feature 1..102: note = chr10:7271976-7272078
  misc_feature 1..102: note = Hypo
  source 1..102: mol_type = genomic DNA

SEQ ID NO: 104229 - DNA, 22 bp, Homo sapiens
  misc_feature 1..22: note = chr10:7288388-7288410
  misc_feature 1..22: note = Hypo
  source 1..22: mol_type = genomic DNA
gaatgtgagagaggccgggtgc

SEQ ID NO: 104230 - DNA, 88 bp, Homo sapiens; identical to SEQ ID NO: 71639
  misc_feature 1..88: note = chr10:7288706-7288794
  misc_feature 1..88: note = Hypo
  source 1..88: mol_type = genomic DNA

SEQ ID NO: 104231 - DNA, 67 bp, Homo sapiens; identical to SEQ ID NO: 71640
  misc_feature 1..67: note = chr10:7290469-7290536
  misc_feature 1..67: note = Hypo
  source 1..67: mol_type = genomic DNA

SEQ ID NO: 104232 - DNA, 30 bp, Homo sapiens; identical to SEQ ID NO: 71650
  misc_feature 1..30: note = chr10:7323490-7323520
  misc_feature 1..30: note = Hypo
  source 1..30: mol_type = genomic DNA

SEQ ID NO: 104233 - DNA, 166 bp, Homo sapiens; identical to SEQ ID NO: 71651
  misc_feature 1..166: note = chr10:7339896-7340062
  misc_feature 1..166: note = Hypo
  source 1..166: mol_type = genomic DNA

SEQ ID NO: 104234 - DNA, 30 bp, Homo sapiens; identical to SEQ ID NO: 71659
  misc_feature 1..30: note = chr10:7367191-7367221
  misc_feature 1..30: note = Hypo
  source 1..30: mol_type = genomic DNA

SEQ ID NO: 104235 - DNA, 30 bp, Homo sapiens; identical to SEQ ID NO: 42503
  misc_feature 1..30: note = chr10:7391910-7391940
  misc_feature 1..30: note = Hypo
  source 1..30: mol_type = genomic DNA

SEQ ID NO: 104236 - DNA, 36 bp, Homo sapiens; identical to SEQ ID NO: 71668
  misc_feature 1..36: note = chr10:7401231-7401267
  misc_feature 1..36: note = Hypo
  source 1..36: mol_type = genomic DNA

SEQ ID NO: 104237 - DNA, 127 bp, Homo sapiens; identical to SEQ ID NO: 71670
  misc_feature 1..127: note = chr10:7407101-7407228
  misc_feature 1..127: note = Hypo
  source 1..127: mol_type = genomic DNA

SEQ ID NO: 104238 - DNA, 74 bp, Homo sapiens; identical to SEQ ID NO: 71671
  misc_feature 1..74: note = chr10:7409558-7409632
  misc_feature 1..74: note = Hypo
  source 1..74: mol_type = genomic DNA

SEQ ID NO: 104239 - DNA, 19 bp, Homo sapiens
  misc_feature 1..19: note = chr10:7414170-7414189
  misc_feature 1..19: note = Hypo
  source 1..19: mol_type = genomic DNA
cgcccggccttcttgaaat

SEQ ID NO: 104240 - DNA, 44 bp, Homo sapiens; identical to SEQ ID NO: 42505
  misc_feature 1..44: note = chr10:7414544-7414588
  misc_feature 1..44: note = Hypo
  source 1..44: mol_type = genomic DNA

SEQ ID NO: 104241 - DNA, 30 bp, Homo sapiens; identical to SEQ ID NO: 71676
  misc_feature 1..30: note = chr10:7424626-7424656
  misc_feature 1..30: note = Hypo
  source 1..30: mol_type = genomic DNA

SEQ ID NO: 104242 - DNA, 186 bp, Homo sapiens; identical to SEQ ID NO: 71677
  misc_feature 1..186: note = chr10:7443826-7444012
  misc_feature 1..186: note = Hypo
  source 1..186: mol_type = genomic DNA

SEQ ID NO: 104243 - DNA, 3082 bp, Homo sapiens
  misc_feature 1..3082: note = chr10:7449954-7453036
  misc_feature 1..3082: note = Hyper
  source 1..3082: mol_type = genomic DNA
aaaacttgggcccttcgagaaccctgtggaatgttctttgtaatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccccgggagggcgcgcccaaacgcaggctggaggagccacggacgcgtcctggccggcgtgtcgccatcgttcagcctcgctgcccaggtgggaggggtcacctgccgcggggtctccaagccagtgccgcttgctcccggcccccacccactgacagcacggcgtccgagtgaccctgtctagcctcgttctgcgctcctgcaaaccacgttgctgcgctaactacaaacctggccaacatgtctttgtaaccctatcatttaaaaacgcttccaggcacctggccgctgccagatcaggttcgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgctcggcgctcttttttttt

SEQ ID NO: 104244 - DNA, 981 bp, Homo sapiens
  misc_feature 1..981: note = chr10:7453096-7454077
  misc_feature 1..981: note = Hyper
  source 1..981: mol_type = genomic DNA
gcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccgggcgagctgccaggtagccgtgctcgccacggcgtctcatggggcacctagctagtggcgggcctcatagggcgggaaaagaatcgtcgctcacaccccagcaaaacgtggccctcgacggtccgttggagagccccggcggccgtgagccccgggcagggctggacgtctgcggagccctcgggcactttgtcccgggcgcctggggaggaacgcggagctcccagggccttaggtgcaacggctgcgcagagcccaaacgaaatgtccccagtgcggaaaagccggtgacgccctggtagcaagaccaagagcttccgaagaacgctgcgcccttaactagggggcctcgcagagatgcctgtgtgggcctgcattgtatatttctgcgaaatagcgaatggacacgtttgctcagggtt

SEQ ID NO: 104245 - DNA, 659 bp, Homo sapiens
  misc_feature 1..659: note = chr10:7454305-7454964
  misc_feature 1..659: note = Hyper
  source 1..659: mol_type = genomic DNA
acagaggtcctcaggcgggccctctcctggacggtggggccggagctgatctagaagaaatacggagggacgtgccgagaagccgctctccttcgccgcgaccctggagagcgcctctccacccaaaggatctgccgagctgagagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaagagtccagcgactcgccgcgcggcgcactttaaactctagcctgagtctgcgacccctccagctctccagtccccagctgttggggacatcaagccggagccctgggctctctgccctgtgggtcgctgaaagcagagactcctcaaaccaaccgaaccgggcgcattaaccctctcgcctgcaccccgctgcctcccggttgagccccgaggcggctccaggtagaacctgctggactgactgcggcgtccagaaatctggagtgtgggctccagacactctccacggtttggccccgggtctcaacacccaagtcgcctcttctggctccttcaccacacagcggggcctgtggaaa

SEQ ID NO: 104246 - DNA, 40 bp, Homo sapiens; identical to SEQ ID NO: 71687
  misc_feature 1..40: note = chr10:7472551-7472591
  misc_feature 1..40: note = Hypo
  source 1..40: mol_type = genomic DNA

SEQ ID NO: 104247 - DNA, 352 bp, Homo sapiens; identical to SEQ ID NO: 71688
  misc_feature 1..352: note = chr10:7488720-7489072
  misc_feature 1..352: note = Hypo
  source 1..352: mol_type = genomic DNA

SEQ ID NO: 104248 - DNA, 30 bp, Homo sapiens; identical to SEQ ID NO: 71689
  misc_feature 1..30: note = chr10:7498536-7498566
  misc_feature 1..30: note = Hypo
  source 1..30: mol_type = genomic DNA

SEQ ID NO: 104249 - DNA, 30 bp, Homo sapiens; identical to SEQ ID NO: 71692
  misc_feature 1..30: note = chr10:7505493-7505523
  misc_feature 1..30: note = Hypo
  source 1..30: mol_type = genomic DNA

SEQ ID NO: 104250 - DNA, 36 bp, Homo sapiens; identical to SEQ ID NO: 71697
  misc_feature 1..36: note = chr10:7542725-7542761
  misc_feature 1..36: note = Hypo
  source 1..36: mol_type = genomic DNA

SEQ ID NO: 104251 - DNA, 156 bp, Homo sapiens; identical to SEQ ID NO: 71705
  misc_feature 1..156: note = chr10:7608010-7608166
  misc_feature 1..156: note = Hypo
  source 1..156: mol_type = genomic DNA

SEQ ID NO: 104252 - DNA, 30 bp, Homo sapiens; identical to SEQ ID NO: 71706
  misc_feature 1..30: note = chr10:7641473-7641503
  misc_feature 1..30: note = Hypo
  source 1..30: mol_type = genomic DNA

SEQ ID NO: 104253 - DNA, 30 bp, Homo sapiens; identical to SEQ ID NO: 71708
  misc_feature 1..30: note = chr10:7673219-7673249
  misc_feature 1..30: note = Hypo
  source 1..30: mol_type = genomic DNA

SEQ ID NO: 104254 - DNA, 21 bp, Homo sapiens
  misc_feature 1..21: note = chr10:7678984-7679005
  misc_feature 1..21: note = Hypo
  source 1..21: mol_type = genomic DNA
gcctggcgacagaggacttcg

SEQ ID NO: 104255 - DNA, 30 bp, Homo sapiens; identical to SEQ ID NO: 71712
  misc_feature 1..30: note = chr10:7698170-7698200
  misc_feature 1..30: note = Hypo
  source 1..30: mol_type = genomic DNA

SEQ ID NO: 104256 - DNA, 579 bp, Homo sapiens
  misc_feature 1..579: note = chr10:7708410-7708989
  misc_feature 1..579: note = Hyper
  source 1..579: mol_type = genomic DNA
agactgccccccacgcgtgataaggaaaaaaccttgtaattataataacttttggagctacctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatggcggggcgagggcgcgggacgctcggggacccggcgggacacgctttgcagcgcccagggctccagccactgcgggacgctctcggggccgcccaccccgcggtcccagcccggaccccgcccaccccacgga

SEQ ID NO: 104257 - DNA, 66 bp, Homo sapiens; identical to SEQ ID NO: 71718
  misc_feature 1..66: note = chr10:7709654-7709720
  misc_feature 1..66: note = Hyper
  source 1..66: mol_type = genomic DNA

SEQ ID NO: 104258 - DNA, 58 bp, Homo sapiens; identical to SEQ ID NO: 42508
  misc_feature 1..58: note = chr10:7765067-7765125
  misc_feature 1..58: note = Hypo
  source 1..58: mol_type = genomic DNA

SEQ ID NO: 104259 - DNA, 30 bp, Homo sapiens; identical to SEQ ID NO: 42509
  misc_feature 1..30: note = chr10:7780425-7780455
  misc_feature 1..30: note = Hypo
  source 1..30: mol_type = genomic DNA

SEQ ID NO: 104260 - DNA, 30 bp, Homo sapiens; identical to SEQ ID NO: 71728
  misc_feature 1..30: note = chr10:7786837-7786867
  misc_feature 1..30: note = Hypo
  source 1..30: mol_type = genomic DNA

SEQ ID NO: 104261 - DNA, 34 bp, Homo sapiens; identical to SEQ ID NO: 42510
  misc_feature 1..34: note = chr10:7985160-7985194
  misc_feature 1..34: note = Hypo
  source 1..34: mol_type = genomic DNA

SEQ ID NO: 104262 - DNA, 30 bp, Homo sapiens; identical to SEQ ID NO: 42511
  misc_feature 1..30: note = chr10:8025070-8025100
  misc_feature 1..30: note = Hypo
  source 1..30: mol_type = genomic DNA

SEQ ID NO: 104263 - DNA, 30 bp, Homo sapiens; identical to SEQ ID NO: 42512
  misc_feature 1..30: note = chr10:8067803-8067833
  misc_feature 1..30: note = Hypo
  source 1..30: mol_type = genomic DNA

SEQ ID NO: 104264 - DNA, 1444 bp, Homo sapiens
  misc_feature 1..1444: note = chr10:8075930-8077374
  misc_feature 1..1444: note = Hyper
  source 1..1444: mol_type = genomic DNA
gctggcagccaacttcgtttctatggcggaactcagggttcccacgctcttggagtaggaccaggatgggatcgccctgggcacgtggtatcccctccgcctgcggggtcacgacagcctaggcgacggacagtcccgggcttagggagggaggctgatcccgggagctctcaggagtccttccacctgccacctaggagcccagttcgcatctctacagcgccacacatctaggccagcccagctccggtcccagtcggtctctgcggagccccagccagctccgcgtcttggtcctggcttgcgggtggcacacagacaagcgaccggggtggcccggagaggtcgtgcccctggctgcgagacgacgcgacagcagggcgctccgggggccgcagcggcgtcgaaggcggtccctgggggcggggctctggcacgagggggaccctcccgggtcaagttcacagaggcggaggggcctgggctgcgccccagagccccagggggtcctctgctcccataaaaaacaaagacgggggcggcggagggtgtggaaggaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggcgcggcctgggagccggggtcccttctgaccacagacgtggccaccgcctcttctcatcccgaaggtcccagccatcccgaggtggtcagagaagaccccgacgggcggatcgggcagtggagagacccgtggtcctcgcgcctgctgtgtcgctgtgtcaatgaccgtgacactcagggcaatccttaccaacacagagcaggacaacgataccccgcacccccccgtacaagtgcaaactagtttctgtgttgggggaaaaaagcgaataaaagtttaa

SEQ ID NO: 104265 - DNA, 369 bp, Homo sapiens; identical to SEQ ID NO: 71743
  misc_feature 1..369: note = chr10:8077874-8078243
  misc_feature 1..369: note = Hyper
  source 1..369: mol_type = genomic DNA

SEQ ID NO: 104266 - DNA, 63 bp, Homo sapiens; identical to SEQ ID NO: 71744
  misc_feature 1..63: note = chr10:8078628-8078691
  misc_feature 1..63: note = Hyper
  source 1..63: mol_type = genomic DNA

SEQ ID NO: 104267 - DNA, 30 bp, Homo sapiens; identical to SEQ ID NO: 71745
  misc_feature 1..30: note = chr10:8079285-8079315
  misc_feature 1..30: note = Hyper
  source 1..30: mol_type = genomic DNA

SEQ ID NO: 104268 - DNA, 30 bp, Homo sapiens; identical to SEQ ID NO: 32867
  misc_feature 1..30: note = chr10:8079721-8079751
  misc_feature 1..30: note = Hyper
  source 1..30: mol_type = genomic DNA

SEQ ID NO: 104269 - DNA, 42 bp, Homo sapiens; identical to SEQ ID NO: 71747
  misc_feature 1..42: note = chr10:8083222-8083264
  misc_feature 1..42: note = Hyper
  source 1..42: mol_type = genomic DNA

SEQ ID NO: 104270 - DNA, 1052 bp, Homo sapiens
  misc_feature 1..1052: note = chr10:8084996-8086048
  misc_feature 1..1052: note = Hyper
  source 1..1052: mol_type = genomic DNA
gagtcactttggacccgagaaaagcaagtgcccgcgtcagcagaaaaggaacgaggagcgaggccgccagatcgacgggaaacaggcggagagagggtcgtcggcgctcagggccggggtggcccgggggacggaggagagataggagagcccgccctgggtctcagagggtgctgttgcgtgctgcaggttctaagggaaaagggctttcccctggcaggagagccaaaggcggggaagggagaaggaggggcgggagaatgaggaccagaagccggagaagggaggctggaggaagacgcaagtggcccctccgacctagtggacggcgagttgaggtacagttaatgcccgggccaaggagacaactgtcgccgccttggtgacggatgccccctccctgggcccccgccctagtccccatggggggagcagcgcgccagaagggagtaggcgttgttgggaccctctgggggtctggaatgccagcgacacttctcttcccagccgcaggggccttcctgggacaggccaggtagaccccacccccccgaccccgttcgtcagggcaacaggttgggtgcaagctgtcaagagatggccttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgcccccagcctgggcatcgcgctcaactgctctctgaaccccatgtccacgagggttcgccctcaaaccacc

SEQ ID NO: 104271 - DNA, 55 bp, Homo sapiens; identical to SEQ ID NO: 71749
  misc_feature 1..55: note = chr10:8086685-8086740
  misc_feature 1..55: note = Hyper
  source 1..55: mol_type = genomic DNA

SEQ ID NO: 104272 - DNA, 359 bp, Homo sapiens; identical to SEQ ID NO: 71750
  misc_feature 1..359: note = chr10:8087043-8087402
  misc_feature 1..359: note = Hyper
  source 1..359: mol_type = genomic DNA

SEQ ID NO: 104273 - DNA, 337 bp, Homo sapiens
  misc_feature 1..337: note = chr10:8090421-8090758
  misc_feature 1..337: note = Hyper
  source 1..337: mol_type = genomic DNA
ggacggaggagaggtcgggtctagaagtagcaagcccctggctaggagtcactgatgccactgggggcagggtaagatgtccaaagcccgggagacccagggacgccggctgggctgcctccaccccttcttttcctcccgtggcacccacctgtccccccacctgccaaggccaggagggagggagagagctgaaaagggcacttttcctccagggtgactccaattcctttccactcaccctcaaggcgagttccttctctcccacccaacccggggctccccccaactgccactcgcctcacgtgtgagttgttaaacccgaaagcagaaatcc

SEQ ID NO: 104274 - DNA, 639 bp, Homo sapiens; identical to SEQ ID NO: 71753
  misc_feature 1..639: note = chr10:8091359-8091998
  misc_feature 1..639: note = Hyper
  source 1..639: mol_type = genomic DNA

SEQ ID NO: 104275 - DNA, 89 bp, Homo sapiens; identical to SEQ ID NO: 32874
  misc_feature 1..89: note = chr10:8092446-8092535
  misc_feature 1..89: note = Hyper
  source 1..89: mol_type = genomic DNA

SEQ ID NO: 104276 - DNA, 680 bp, Homo sapiens
  misc_feature 1..680: note = chr10:8093360-8094040
  misc_feature 1..680: note = Hyper
  source 1..680: mol_type = genomic DNA
tcgcctgctcggctgcgggatgcttgctcccaaggtcccaggcgtccaggttgatcgccagccccttaccctggtgagggaggccttgcgccctgcagaagccccgggccctgcggcggcggcggcggcatcctcctggtcgcctcctcgctttcctccacccgagctccgccggctgctccttgggaggaaggggactcgctagaccaggccgaggcccaggtacctgggagggggtcgcgtcaggtctgcgggaaggcgctcaggcttctccgcaggaggccaggatcagctttgtggcggtggcacagggagaatcaggaccacctttcccccttacccccggccaggatccccctttccctcccccgcccgccaagggaggaggaagcccggcctgctcttgccggcgaggcgggtcaggccggcgcctggcctggcccggacccccgcagcccggctctccgcctcaggccacgcgccgcagcctctccagcctcgctcccttcccccttccttccccgtgggtcccgaggccgacctcggccctccctcctcggcatccccctcccatccttttcccttccccgctgccctgtgctccgggctccggggctgggcccgtgacgtcaaacccagtgtggcgtcggcgagactggccggcgcgggccatcaaaaga

SEQ ID NO: 104277 - DNA, 67 bp, Homo sapiens
  misc_feature 1..67: note = chr10:8094243-8094310
  misc_feature 1..67: note = Hyper
  source 1..67: mol_type = genomic DNA
gcccttctccatccccggccagtccgacttggtgctcgcgattgaatttaaacgaataatccctact

SEQ ID NO: 104278 - DNA, 491 bp, Homo sapiens
  misc_feature 1..491: note = chr10:8095198-8095689
  misc_feature 1..491: note = Hyper
  source 1..491: mol_type = genomic DNA
tatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcgggccagcggctgcagccacccgggcgccgctaggggatgcagtggctcaaaggaccgagcgggcggtgcaggttggaacccgcggggcggaccaatcgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcgg

SEQ ID NO: 104279 - DNA, 1593 bp, Homo sapiens; identical to SEQ ID NO: 71761
  misc_feature 1..1593: note = chr10:8095944-8097537
  misc_feature 1..1593: note = Hyper
  source 1..1593: mol_type = genomic DNA

SEQ ID NO: 104280 - DNA, 403 bp, Homo sapiens; identical to SEQ ID NO: 71790
  misc_feature 1..403: note = chr10:8374325-8374728
  misc_feature 1..403: note = Hyper
  source 1..403: mol_type = genomic DNA

SEQ ID NO: 104281 - DNA, 30 bp, Homo sapiens; identical to SEQ ID NO: 71793
  misc_feature 1..30: note = chr10:8556196-8556226
  misc_feature 1..30: note = Hypo
  source 1..30: mol_type = genomic DNA

SEQ ID NO: 104282 - DNA, 19 bp, Homo sapiens
  misc_feature 1..19: note = chr10:9071404-9071423
  misc_feature 1..19: note = Hypo
  source 1..19: mol_type = genomic DNA
ttttagacagagtctcgct

SEQ ID NO: 104283 - DNA, 30 bp, Homo sapiens; identical to SEQ ID NO: 71855
  misc_feature 1..30: note = chr10:9637898-9637928
  misc_feature 1..30: note = Hypo
  source 1..30: mol_type = genomic DNA

SEQ ID NO: 104284 - DNA, 182 bp, Homo sapiens; identical to SEQ ID NO: 70292
  misc_feature 1..182: note = chr10:10767560-10767742
  misc_feature 1..182: note = Hypo
  source 1..182: mol_type = genomic DNA

SEQ ID NO: 104285 - DNA, 40 bp, Homo sapiens; identical to SEQ ID NO: 70293
  misc_feature 1..40: note = chr10:10769445-10769485
  misc_feature 1..40: note = Hypo
  source 1..40: mol_type = genomic DNA

SEQ ID NO: 104286 - DNA, 30 bp, Homo sapiens; identical to SEQ ID NO: 42513
  misc_feature 1..30: note = chr10:10770967-10770997
  misc_feature 1..30: note = Hypo
  source 1..30: mol_type = genomic DNA

SEQ ID NO: 104287 - DNA, 196 bp, Homo sapiens; identical to SEQ ID NO: 70296
  misc_feature 1..196: note = chr10:10854925-10855121
  misc_feature 1..196: note = Hypo
  source 1..196: mol_type = genomic DNA

SEQ ID NO: 104288 - DNA, 36 bp, Homo sapiens; identical to SEQ ID NO: 70299
  misc_feature 1..36: note = chr10:10867457-10867493
  misc_feature 1..36: note = Hypo
  source 1..36: mol_type = genomic DNA

SEQ ID NO: 104289 - DNA, 30 bp, Homo sapiens; identical to SEQ ID NO: 70306
  misc_feature 1..30: note = chr10:10910269-10910299
  misc_feature 1..30: note = Hypo
  source 1..30: mol_type = genomic DNA

SEQ ID NO: 104290 - DNA, 1424 bp, Homo sapiens
  misc_feature 1..1424: note = chr10:11059322-11060746
  misc_feature 1..1424: note = Hyper
  source 1..1424: mol_type = genomic DNA
aaaaggcagtgccatcgtgcagagacaggtttgtcttccttagggcactgcgataagtccctaaatgtcacttgggtcatagatctgatctttattttgcctaaacctcctatatcctttcggtgatcgcccttagttcctgcccgggcaagcacaccacaccgaggagcatcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggagcgggtttgccttcgggggcccaggggaccctgagaagtctggccgtgcccgggcggtgagcgcggaggcggcccgccctgtgtccccgcggggcggagccgggttcggggccgcgctctgggccggcgggcccgcaggggttaagcggcggcgggcgccccgcgagctccgcccccgcccgccgcacctggcgctcggcagccggccgccccggcgctggatttcggaggggattggcggagcgcgaggagagaatgtgacaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaatgtgagtggcgccgcgtcccgaggccgggcgagcgggcgtcctcctcccagagtcggcggcgcgaaggggacgggcgtcgcccgcagctcccgggcgcgactcggccgcttcggatccgtcgcctccctcggccttcggaggccggcacgggacgcgggaggagggagcgggtgcggacgagcagcgccggcggtgcagggcgcggggcttcccggagggacgagcggagcgcggcgtcccggggaccgggcggggtccgcgagtccgggtgaggaccagcgggccgagcgcggcgtcccgggtccccgcggggtgagtgggggacgggcggggtccaccgaccggcgcgaggacccgcgagcagggtgagcggggcgcggcgtcccggggtccgggcggggtccatgagtccaagtgggaccggcgagccgggcgcggagtcccggggtccggtggggcgggcggggaccgggcggggtctgggggtccgggtgaggactgagcggagcgcggcgtgacggggaccgggcggggaccggcgagcgggcacggggtccgggcggggtgcgcgcgtgcgagtgtgcacgcttgtgtcatttgaaatgcggggctgacggagc

SEQ ID NO: 104291 - DNA, 30 bp, Homo sapiens; identical to SEQ ID NO: 70335
  misc_feature 1..30: note = chr10:11201306-11201336
  misc_feature 1..30: note = Hypo
  source 1..30: mol_type = genomic DNA

SEQ ID NO: 104292 - DNA, 454 bp, Homo sapiens
  misc_feature 1..454: note = chr10:11206876-11207330
  misc_feature 1..454: note = Hyper
  source 1..454: mol_type = genomic DNA
tgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcac

SEQ ID NO: 104293 - DNA, 135 bp, Homo sapiens
  misc_feature 1..135: note = chr10:11207589-11207724
  misc_feature 1..135: note = Hyper
  source 1..135: mol_type = genomic DNA
cgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctg

SEQ ID NO: 104294 - DNA, 30 bp, Homo sapiens; identical to SEQ ID NO: 70355
  misc_feature 1..30: note = chr10:11343824-11343854
  misc_feature 1..30: note = Hypo
  source 1..30: mol_type = genomic DNA

SEQ ID NO: 104295 - DNA, 30 bp, Homo sapiens; identical to SEQ ID NO: 42515
  misc_feature 1..30: note = chr10:11344374-11344404
  misc_feature 1..30: note = Hypo
  source 1..30: mol_type = genomic DNA

SEQ ID NO: 104296 - DNA, 30 bp, Homo sapiens; identical to SEQ ID NO: 70357
  misc_feature 1..30: note = chr10:11344756-11344786
  misc_feature 1..30: note = Hypo
  source 1..30: mol_type = genomic DNA

SEQ ID NO: 104297 - DNA, 155 bp, Homo sapiens; identical to SEQ ID NO: 70358
  misc_feature 1..155: note = chr10:11357627-11357782
  misc_feature 1..155: note = Hypo
  source 1..155: mol_type = genomic DNA

SEQ ID NO: 104298 - DNA, 30 bp, Homo sapiens; identical to SEQ ID NO: 70360
  misc_feature 1..30: note = chr10:11367015-11367045
  misc_feature 1..30: note = Hypo
  source 1..30: mol_type = genomic DNA

SEQ ID NO: 104299 - DNA, 30 bp, Homo sapiens; identical to SEQ ID NO: 70362
  misc_feature 1..30: note = chr10:11381701-11381731
  misc_feature 1..30: note = Hypo
  source 1..30: mol_type = genomic DNA

SEQ ID NO: 104300 - DNA, 30 bp, Homo sapiens; identical to SEQ ID NO: 70363
  misc_feature 1..30: note = chr10:11405472-11405502
  misc_feature 1..30: note = Hypo
  source 1..30: mol_type = genomic DNA

SEQ ID NO: 104301 - DNA, 30 bp, Homo sapiens; identical to SEQ ID NO: 70364
  misc_feature 1..30: note = chr10:11429024-11429054
  misc_feature 1..30: note = Hypo
  source 1..30: mol_type = genomic DNA

SEQ ID NO: 104302 - DNA, 57 bp, Homo sapiens; identical to SEQ ID NO: 70365
  misc_feature 1..57: note = chr10:11436196-11436253
  misc_feature 1..57: note = Hypo
  source 1..57: mol_type = genomic DNA

SEQ ID NO: 104303 - DNA, 151 bp, Homo sapiens; identical to SEQ ID NO: 42517
  misc_feature 1..151: note = chr10:11472842-11472993
  misc_feature 1..151: note = Hypo
  source 1..151: mol_type = genomic DNA

SEQ ID NO: 104304 - DNA, 30 bp, Homo sapiens; identical to SEQ ID NO: 70371
  misc_feature 1..30: note = chr10:11480033-11480063
  misc_feature 1..30: note = Hypo
  source 1..30: mol_type = genomic DNA

SEQ ID NO: 104305 - DNA, 30 bp, Homo sapiens; identical to SEQ ID NO: 42518
  misc_feature 1..30: note = chr10:11486576-11486606
  misc_feature 1..30: note = Hypo
  source 1..30: mol_type = genomic DNA

SEQ ID NO: 104306 - DNA, 71 bp, Homo sapiens; identical to SEQ ID NO: 70397
  misc_feature 1..71: note = chr10:11700944-11701015
  misc_feature 1..71: note = Hypo
  source 1..71: mol_type = genomic DNA

SEQ ID NO: 104307 - DNA, 295 bp, Homo sapiens
  misc_feature 1..295: note = chr10:11784135-11784430
  misc_feature 1..295: note = Hyper
  source 1..295: mol_type = genomic DNA
caaacgccacattcccggtgttggtgcaaaaagaaatcatcctactcctcccctcgcttaaactttcccacaggccttgtcaaacaacccctggagccggcctgcaggttttcaatgcgcgcctttcaccgtgcggggcgcggcggggagcggcgagccgggggcgggcctcgtgggggcggggcggggcgtgccggggcggggaggggcgtgccggggcggggcggggcgtgccggggcggggcgtagtacggactgggcctggcctggggcgtccccgcgaagcctgggcctg

SEQ ID NO: 104308 - DNA, 30 bp, Homo sapiens; identical to SEQ ID NO: 70409
  misc_feature 1..30: note = chr10:11825336-11825366
  misc_feature 1..30: note = Hypo
  source 1..30: mol_type = genomic DNA

SEQ ID NO: 104309 - DNA, 30 bp, Homo sapiens; identical to SEQ ID NO: 42519
  misc_feature 1..30: note = chr10:12139715-12139745
  misc_feature 1..30: note = Hypo
  source 1..30: mol_type = genomic DNA

SEQ ID NO: 104310 - DNA, 35 bp, Homo sapiens; identical to SEQ ID NO: 70502
  misc_feature 1..35: note = chr10:12331252-12331287
  misc_feature 1..35: note = Hypo
  source 1..35: mol_type = genomic DNA

SEQ ID NO: 104311 - DNA, 30 bp, Homo sapiens; identical to SEQ ID NO: 70511
  misc_feature 1..30: note = chr10:12398063-12398093
  misc_feature 1..30: note = Hypo
  source 1..30: mol_type = genomic DNA

SEQ ID NO: 104312 - DNA, 30 bp, Homo sapiens; identical to SEQ ID NO: 70516
  misc_feature 1..30: note = chr10:12436198-12436228
  misc_feature 1..30: note = Hypo
  source 1..30: mol_type = genomic DNA

SEQ ID NO: 104313 - DNA, 30 bp, Homo sapiens; identical to SEQ ID NO: 70519
  misc_feature 1..30: note = chr10:12464455-12464485
  misc_feature 1..30: note = Hypo
  source 1..30: mol_type = genomic DNA

SEQ ID NO: 104314 - DNA, 119 bp, Homo sapiens; identical to SEQ ID NO: 70521
  misc_feature 1..119: note = chr10:12481458-12481577
  misc_feature 1..119: note = Hypo
  source 1..119: mol_type = genomic DNA

SEQ ID NO: 104315 - DNA, 189 bp, Homo sapiens; identical to SEQ ID NO: 70552
  misc_feature 1..189: note = chr10:12531976-12532165
  misc_feature 1..189: note = Hypo
  source 1..189: mol_type = genomic DNA

SEQ ID NO: 104316 - DNA, 29 bp, Homo sapiens
  misc_feature 1..29: note = chr10:12554507-12554536
  misc_feature 1..29: note = Hypo
  source 1..29: mol_type = genomic DNA
cctcagcagctgcccgttgggagactcgg

SEQ ID NO: 104317 - DNA, 44 bp, Homo sapiens; identical to SEQ ID NO: 70589
  misc_feature 1..44: note = chr10:12685417-12685461
  misc_feature 1..44: note = Hypo
  source 1..44: mol_type = genomic DNA

SEQ ID NO: 104318 - DNA, 38 bp, Homo sapiens; identical to SEQ ID NO: 70606
  misc_feature 1..38: note = chr10:12828013-12828051
  misc_feature 1..38: note = Hypo
  source 1..38: mol_type = genomic DNA

SEQ ID NO: 104319 - DNA, 30 bp, Homo sapiens; identical to SEQ ID NO: 42522
  misc_feature 1..30: note = chr10:12844882-12844912
  misc_feature 1..30: note = Hypo
  source 1..30: mol_type = genomic DNA

SEQ ID NO: 104320 - DNA, 30 bp, Homo sapiens; identical to SEQ ID NO: 70609
  misc_feature 1..30: note = chr10:12872726-12872756
  misc_feature 1..30: note = Hypo
  source 1..30: mol_type = genomic DNA

SEQ ID NO: 104321 - DNA, 30 bp, Homo sapiens; identical to SEQ ID NO: 70610
  misc_feature 1..30: note = chr10:12876451-12876481
  misc_feature 1..30: note = Hypo
  source 1..30: mol_type = genomic DNA

SEQ ID NO: 104322 - DNA, 76 bp, Homo sapiens; identical to SEQ ID NO: 70640
  misc_feature 1..76: note = chr10:13027839-13027915
  misc_feature 1..76: note = Hypo
  source 1..76: mol_type = genomic DNA

SEQ ID NO: 104323 - DNA, 781 bp, Homo sapiens
  misc_feature 1..781: note = chr10:13043120-13043901
  misc_feature 1..781: note = Hyper
  source 1..781: mol_type = genomic DNA
cctggctctaggtaacggcgacctcgggaggtggcgcagagagagagagaggtggcggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgccaggcagagcgcggcgagcagcagctggcgcagcatgccgggccctcccggggcgcacggggcggcggcggggagcccggggagcccgccggcccgggaagggcagccctgggcgctcggctgctcgggccgctcccgggagctgagcgcaccgctgtctccgccacggggctcggcatgcccggccctggcgcgccacgctttaaaagggtcccggggactggacgcgccgggcgcccgcctcccgccctgccccctgcggctggggcgtgggcgggggaggggcggggagtcgggcgggtcccggcgccggctggggcggggaccagggactcggagaacgcggggacgccgggacccagccctg

SEQ ID NO: 104324 - DNA, 203 bp, Homo sapiens; identical to SEQ ID NO: 70655
  misc_feature 1..203: note = chr10:13081775-13081978
  misc_feature 1..203: note = Hypo
  source 1..203: mol_type = genomic DNA

SEQ ID NO: 104325 - DNA, 23 bp, Homo sapiens
  misc_feature 1..23: note = chr10:13130732-13130755
  misc_feature 1..23: note = Hypo
  source 1..23: mol_type = genomic DNA
tgaatattagctgggcgcagtgg

SEQ ID NO: 104326 - DNA, 75 bp, Homo sapiens; identical to SEQ ID NO: 70673
  misc_feature 1..75: note = chr10:13137668-13137743
  misc_feature 1..75: note = Hypo
  source 1..75: mol_type = genomic DNA

SEQ ID NO: 104327 - DNA, 155 bp, Homo sapiens; identical to SEQ ID NO: 70675
  misc_feature 1..155: note = chr10:13140531-13140686
  misc_feature 1..155: note = Hypo
  source 1..155: mol_type = genomic DNA

SEQ ID NO: 104328 - DNA, 34 bp, Homo sapiens; identical to SEQ ID NO: 70676
  misc_feature 1..34: note = chr10:13140986-13141020
  misc_feature 1..34: note = Hypo
  source 1..34: mol_type = genomic DNA

SEQ ID NO: 104329 - DNA, 30 bp, Homo sapiens; identical to SEQ ID NO: 70722
  misc_feature 1..30: note = chr10:13276800-13276830
  misc_feature 1..30: note = Hypo
  source 1..30: mol_type = genomic DNA

SEQ ID NO: 104330 - DNA, 17 bp, Homo sapiens
  misc_feature 1..17: note = chr10:13345114-13345131
  misc_feature 1..17: note = Hypo
  source 1..17: mol_type = genomic DNA
tttttttttttgagacg

SEQ ID NO: 104331 - DNA, 222 bp, Homo sapiens; identical to SEQ ID NO: 70745
  misc_feature 1..222: note = chr10:13355033-13355255
  misc_feature 1..222: note = Hypo
  source 1..222: mol_type = genomic DNA

SEQ ID NO: 104332 - DNA, 29 bp, Homo sapiens
  misc_feature 1..29: note = chr10:13404822-13404851
  misc_feature 1..29: note = Hypo
  source 1..29: mol_type = genomic DNA
gaaaagatctcaaaccggccgggcgcggt

SEQ ID NO: 104333 - DNA, 149 bp, Homo sapiens; identical to SEQ ID NO: 70792
  misc_feature 1..149: note = chr10:13405091-13405240
  misc_feature 1..149: note = Hypo
  source 1..149: mol_type = genomic DNA

SEQ ID NO: 104334 - DNA, 24 bp, Homo sapiens
  misc_feature 1..24: note = chr10:13426145-13426169
  misc_feature 1..24: note = Hypo
  source 1..24: mol_type = genomic DNA
cgcgcccagcggagtatggtagac

SEQ ID NO: 104335 - DNA, 80 bp, Homo sapiens; identical to SEQ ID NO: 70992
  misc_feature 1..80: note = chr10:13571373-13571453
  misc_feature 1..80: note = Hyper
  source 1..80: mol_type = genomic DNA

SEQ ID NO: 104336 - DNA, 30 bp, Homo sapiens; identical to SEQ ID NO: 70994
  misc_feature 1..30: note = chr10:13706037-13706067
  misc_feature 1..30: note = Hypo
  source 1..30: mol_type = genomic DNA

SEQ ID NO: 104337 - DNA, 40 bp, Homo sapiens; identical to SEQ ID NO: 70995
  misc_feature 1..40: note = chr10:13715561-13715601
  misc_feature 1..40: note = Hypo
  source 1..40: mol_type = genomic DNA

SEQ ID NO: 104338 - DNA, 30 bp, Homo sapiens; identical to SEQ ID NO: 70996
  misc_feature 1..30: note = chr10:13725649-13725679
  misc_feature 1..30: note = Hypo
  source 1..30: mol_type = genomic DNA

SEQ ID NO: 104339 - DNA, 149 bp, Homo sapiens; identical to SEQ ID NO: 42529
  misc_feature 1..149: note = chr10:13751257-13751406
  misc_feature 1..149: note = Hypo
  source 1..149: mol_type = genomic DNA

SEQ ID NO: 104340 - DNA, 41 bp, Homo sapiens; identical to SEQ ID NO: 70998
  misc_feature 1..41: note = chr10:13771406-13771447
  misc_feature 1..41: note = Hypo
  source 1..41: mol_type = genomic DNA

SEQ ID NO: 104341 - DNA, 30 bp, Homo sapiens; identical to SEQ ID NO: 71000
  misc_feature 1..30: note = chr10:13854970-13855000
  misc_feature 1..30: note = Hypo
  source 1..30: mol_type = genomic DNA

SEQ ID NO: 104342 - DNA, 161 bp, Homo sapiens; identical to SEQ ID NO: 42530
  misc_feature 1..161: note = chr10:13898478-13898639
  misc_feature 1..161: note = Hypo
  source 1..161: mol_type = genomic DNA

SEQ ID NO: 104343 - DNA, 975 bp, Homo sapiens
  misc_feature 1..975: note = chr10:13933436-13934411
  misc_feature 1..975: note = Hyper
  source 1..975: mol_type = genomic DNA
acagtatgtgccccacgtgggatttgcatttaaaaactgtaacatacgcgaaataaacgactccaggcccccagtaaagaagcagcggcgcgtcccttttccccggcccagcgtgaaaacacggaaggcgaagggctgccgtcagtcgcctccctgccaccgcgaccgggaaacaaagacacattaccttttattttttgcgcttccaagggatccgaggaacttctggctgcaagcggctggtaccccggaacgggcgtcccattcgcccgggcgaaggcccttggcctactaggcggccttggcgcccgcagctggcgagcccccgccccgtccccgccgccgcccccgccgcgggccctcggcgtcagcccatagcccgctcgcgcctctcgcgccgagcctggcccggcgccagtgagccccgccgccggcccgcccctcgcccgcgcccggcccgccgcatggtgcgcccagcgcgccccgagccagtccccggcgcgctgctaggtcgggtgctaggcggccaccgcgcgccaccgccgccgccaccgcccgccgcccgatcctggacaacaatgcgcgcccccgcccccccagaaagccagggacgcccccagtcgccgccagagctggctcggcttcccagcccctctccgtggcacccgcaggcgagacaaagttcgctcccggtgaggctgcgcgcgtccaaagcgtgcgggatgcccagcacggaggtccccaagcgggggacccctggctcccccacaaaacccacccaaagccaccgctcgaggccctctcctaccctgagagcccggagacagcagctcccttggctgaaggcacagctcttacccctcgatctagtccaattgtattgaattttaatctcccctcaactcttcaatggaagttgctgcaggataaccgaggcatgtggctattgtcaaggcttcgcgacaatgactggga

SEQ ID NO: 104344 - DNA, 45 bp, Homo sapiens; identical to SEQ ID NO: 71007
  misc_feature 1..45: note = chr10:14000240-14000285
  misc_feature 1..45: note = Hypo
  source 1..45: mol_type = genomic DNA

SEQ ID NO: 104345 - DNA, 23 bp, Homo sapiens
  misc_feature 1..23: note = chr10:14166365-14166388
  misc_feature 1..23: note = Hypo
  source 1..23: mol_type = genomic DNA
aaactgaagctcagacgaattta

SEQ ID NO: 104346 - DNA, 242 bp, Homo sapiens; identical to SEQ ID NO: 71012
  misc_feature 1..242: note = chr10:14215671-14215913
  misc_feature 1..242: note = Hyper
  source 1..242: mol_type = genomic DNA

SEQ ID NO: 104347 - DNA, 106 bp, Homo sapiens; identical to SEQ ID NO: 32899
  misc_feature 1..106: note = chr10:14216190-14216296
  misc_feature 1..106: note = Hyper
  source 1..106: mol_type = genomic DNA

SEQ ID NO: 104348 - DNA, 124 bp, Homo sapiens; identical to SEQ ID NO: 71017
  misc_feature 1..124: note = chr10:14966088-14966212
  misc_feature 1..124: note = Hypo
  source 1..124: mol_type = genomic DNA

SEQ ID NO: 104349 - DNA, 41 bp, Homo sapiens; identical to SEQ ID NO: 71018
  misc_feature 1..41: note = chr10:14996911-14996952
  misc_feature 1..41: note = Hypo
  source 1..41: mol_type = genomic DNA

SEQ ID NO: 104350 - DNA, 101 bp, Homo sapiens; identical to SEQ ID NO: 71019
  misc_feature 1..101: note = chr10:14997192-14997293
  misc_feature 1..101: note = Hypo
  source 1..101: mol_type = genomic DNA

SEQ ID NO: 104351 - DNA, 24 bp, Homo sapiens
  misc_feature 1..24: note = chr10:15000601-15000625
  misc_feature 1..24: note = Hypo
  source 1..24: mol_type = genomic DNA
aacatgtaaattggccgggcgcgg

SEQ ID NO: 104352 - DNA, 120 bp, Homo sapiens; identical to SEQ ID NO: 71021
  misc_feature 1..120: note = chr10:15003045-15003165
  misc_feature 1..120: note = Hypo
  source 1..120: mol_type = genomic DNA

SEQ ID NO: 104353 - DNA, 141 bp, Homo sapiens; identical to SEQ ID NO: 71022
  misc_feature 1..141: note = chr10:15003225-15003366
  misc_feature 1..141: note = Hypo
  source 1..141: mol_type = genomic DNA

SEQ ID NO: 104354 - DNA, 30 bp, Homo sapiens; identical to SEQ ID NO: 71023
  misc_feature 1..30: note = chr10:15009037-15009067
  misc_feature 1..30: note = Hypo
  source 1..30: mol_type = genomic DNA

SEQ ID NO: 104355 - DNA, 19 bp, Homo sapiens
  misc_feature 1..19: note = chr10:15026279-15026298
  misc_feature 1..19: note = Hypo
  source 1..19: mol_type = genomic DNA
tttccgaggagatttcgtc

SEQ ID NO: 104356 - DNA, 23 bp, Homo sapiens
  misc_feature 1..23: note = chr10:15131223-15131246
  misc_feature 1..23: note = Hypo
  source 1..23: mol_type = genomic DNA
taaatatgtattggccgggcgcg

SEQ ID NO: 104357 - DNA, 120 bp, Homo sapiens; identical to SEQ ID NO: 71027
  misc_feature 1..120: note = chr10:15140508-15140628
  misc_feature 1..120: note = Hypo
  source 1..120: mol_type = genomic DNA

SEQ ID NO: 104358 - DNA, 24 bp, Homo sapiens
  misc_feature 1..24: note = chr10:15140868-15140892
  misc_feature 1..24: note = Hypo
  source 1..24: mol_type = genomic DNA
atgagactccgtctcaaaaaaaaa

SEQ ID NO: 104359 - DNA, 30 bp, Homo sapiens; identical to SEQ ID NO: 71029
  misc_feature 1..30: note = chr10:15255450-15255480
  misc_feature 1..30: note = Hypo
  source 1..30: mol_type = genomic DNA

SEQ ID NO: 104360 - DNA, 30 bp, Homo sapiens; identical to SEQ ID NO: 42535
  misc_feature 1..30: note = chr10:15255872-15255902
  misc_feature 1..30: note = Hypo
  source 1..30: mol_type = genomic DNA

SEQ ID NO: 104361 - DNA, 51 bp, Homo sapiens; identical to SEQ ID NO: 71031
  misc_feature 1..51: note = chr10:15412536-15412587
  misc_feature 1..51: note = Hyper
  source 1..51: mol_type = genomic DNA

SEQ ID NO: 104362 - DNA, 30 bp, Homo sapiens; identical to SEQ ID NO: 42536
  misc_feature 1..30: note = chr10:15484112-15484142
  misc_feature 1..30: note = Hypo
  source 1..30: mol_type = genomic DNA

SEQ ID NO: 104363 - DNA, 82 bp, Homo sapiens; identical to SEQ ID NO: 71033
  misc_feature 1..82: note = chr10:15536670-15536752
  misc_feature 1..82: note = Hypo
  source 1..82: mol_type = genomic DNA

SEQ ID NO: 104364 - DNA, 29 bp, Homo sapiens
  misc_feature 1..29: note = chr10:15568455-15568484
  misc_feature 1..29: note = Hypo
  source 1..29: mol_type = genomic DNA
tgagccaccgcacccggcccattataaga

SEQ ID NO: 104365 - DNA, 1187 bp, Homo sapiens
  misc_feature 1..1187: note = chr10:15760927-15762114
  misc_feature 1..1187: note = Hyper
  source 1..1187: mol_type = genomic DNA
tgggcgccacaaaaccgtgcgcatgcaatgcagtctctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggcggtccccagctgcccgtgtcccgggtcggtgcgctcggcgcacccgtggtgacagtgcccggcgtctgctcccacccgcccgcccgcccagccggctcggggggctggcccaggggctctagccctcctccggccgcgggcagggaccagctctctcgcggcgcctcctcgcggctggtctagagccagggactcccgggcggcccagctggtggctggagcgctgggtgcctcttcgggctgcccggatttctattgca

SEQ ID NO: 104366 - DNA, 30 bp, Homo sapiens; identical to SEQ ID NO: 71039
  misc_feature 1..30: note = chr10:15762409-15762439
  misc_feature 1..30: note = Hyper
  source 1..30: mol_type = genomic DNA

SEQ ID NO: 104367 - DNA, 31 bp, Homo sapiens; identical to SEQ ID NO: 71040
  misc_feature 1..31: note = chr10:15783191-15783222
  misc_feature 1..31: note = Hypo
  source 1..31: mol_type = genomic DNA

SEQ ID NO: 104368 - DNA, 28 bp, Homo sapiens
  misc_feature 1..28: note = chr10:15932007-15932035
  misc_feature 1..28: note = Hypo
  source 1..28: mol_type = genomic DNA
ctgtgaaatcacacgatgccaagcatta

SEQ ID NO: 104369 - DNA, 194 bp, Homo sapiens; identical to SEQ ID NO: 71043
  misc_feature 1..194: note = chr10:16086369-16086563
  misc_feature 1..194: note = Hypo
  source 1..194: mol_type = genomic DNA

SEQ ID NO: 104370 - DNA, 30 bp, Homo sapiens; identical to SEQ ID NO: 71045
  misc_feature 1..30: note = chr10:16468573-16468603
  misc_feature 1..30: note = Hypo
  source 1..30: mol_type = genomic DNA

SEQ ID NO: 104371 - DNA, 1994 bp, Homo sapiens
  misc_feature 1..1994: note = chr10:16562050-16564044
  misc_feature 1..1994: note = Hyper
  source 1..1994: mol_type = genomic DNA
ctgccacgcccattccggactcccccaggcctctccactccccagaaagcccgtaagctaccctctgttgcggaggatcccacggccaggggtcgcttcccgcgccgggactccccagcgcacgagctgtccccgggacccagctcccggcttcccgcccctcgagggtcgcgctcgcaggggcgcgcaccgatcgagggtcccagactccggaactgccctctccaggccgcggggcgccctcctgcgcgcacgacccccgcctctccagggtgggacggcgtccccccttgccgtcgctccagggagcccggccgccgcgcccttcctccgcgggctcccacccccatttccggggtctcctccctctcgcccgcaccttcccgcgctccctccccgccctccccgccgcccgcccgcgctcacctggttgtttttgcagagatcagcccacatgctggtgccgtcccctccgcgcatcaggacgtggtaggtgaagaagtagatgcccgggatggagcaggtgaacttgccggtggtggggtcgtagtggtttccgaggttggtgaccacgtcgtcgaacttgagcacctcgtagccttcatgctgccgcttgaggccggcgtagaaggcgatcttgggcaccgtgctgtaggtggcggcgctgatggccccggccgcgttcaggccgggcgccccgggcgggcccggcaggccttggcggcccggctcgcccttctcgcccgggggccccatggggccgggtggcccgggctctccggggggcccgcgcggacccgccttcccgggcctgccggcctcgcctttggggccctggatgaaggtgggcagggactgcatgaggccgcggtcgggcgtggcagcggtgctgggcgccttggtgcccccgtaggggtcgcagaccatgcggcaggtgcccagcatctcgtagtgcgccgacgtgccggccgagctcaccagcaccgggatgaggatcaccagcagcagcaccatcaccacccccagcgccccggcggcgatcaggcgcctcctgctgcccaccagccggctcagcgcggggcgatcctcttgtctgcttttggacagaattttgaaggttgggcggggacctcttcagagccgaaaacaaccccctgcgaaccccaactcccctgggcgtgcgtgcgccggccgctgctgccgactcctgctccccccgcggaggctgcggctggggagggagcgcgggcgcccagtgacttgagccgaagtcccgagcccggggtgggggccgggggaggggtgcgcggggcgccctcgccccccgcgagctccttcgcacctgtggctgcagccggcgccggcgcggccaccgggagggcagagccagccgccgcctcctgagctcgcccgggcagctcacacttttatgccgccgccgcctgcgatcgacttttccgtttttgcagactgcgcctgttcgcaccaactttccgtctgaagttgcctttttctgcctcctcctcctcttctttcgctcgctcagttcgcccgtccgctgccttttttttttattgcctcctttctctcttcctcctttgccaccaccacaactcgaatagacgcgcaccccaaagccccgcgtgggcccgggcgtcccccgggtgcgcccagcggcggcggcggcgggcacggtcggcacggcgaggctcagagctggggcggaggagcgagcgagcagcggcgagcgcctcacggccgggagcggagcgagagagagactgaaggcagaattctgcctgggtaccacctgccaggagaagaggaggctgacaaacgcgcgccggagcaatttataggcacccaaggcacagaggaaggggagccgctttggcatctcattgcagcatctgctctgctcatcccactcagagagagtttggcattactctgacaatgtgggatttttttttttttttcggcctctctttttt

SEQ ID NO: 104372 - DNA, 30 bp, Homo sapiens; identical to SEQ ID NO: 42540
  misc_feature 1..30: note = chr10:16714330-16714360
  misc_feature 1..30: note = Hypo
  source 1..30: mol_type = genomic DNA

SEQ ID NO: 104373 - DNA, 49 bp, Homo sapiens; identical to SEQ ID NO: 71052
  misc_feature 1..49: note = chr10:16715583-16715632
  misc_feature 1..49: note = Hypo
  source 1..49: mol_type = genomic DNA

SEQ ID NO: 104374 - DNA, 96 bp, Homo sapiens; identical to SEQ ID NO: 71053
  misc_feature 1..96: note = chr10:16928712-16928808
  misc_feature 1..96: note = Hypo
  source 1..96: mol_type = genomic DNA

SEQ ID NO: 104375 - DNA, 30 bp, Homo sapiens; identical to SEQ ID NO: 71054
  misc_feature 1..30: note = chr10:17050934-17050964
  misc_feature 1..30: note = Hypo
  source 1..30: mol_type = genomic DNA

SEQ ID NO: 104376 - DNA, 78 bp, Homo sapiens; identical to SEQ ID NO: 71055
  misc_feature 1..78: note = chr10:17079889-17079967
  misc_feature 1..78: note = Hypo
  source 1..78: mol_type = genomic DNA

SEQ ID NO: 104377 - DNA, 211 bp, Homo sapiens
  misc_feature 1..211: note = chr10:17270234-17270445
  misc_feature 1..211: note = Hyper
  source 1..211: mol_type = genomic DNA
gatctgggaggcccacgtatggcgcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccg

SEQ ID NO: 104378 - DNA, 1580 bp, Homo sapiens
  misc_feature 1..1580: note = chr10:17270653-17272233
  misc_feature 1..1580: note = Hyper
  source 1..1580: mol_type = genomic DNA
cccccaacatctctccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacag

SEQ ID NO: 104379 - DNA, 29 bp, Homo sapiens
  misc_feature 1..29: note = chr10:17272601-17272630
  misc_feature 1..29: note = Hyper
  source 1..29: mol_type = genomic DNA
cctggcggtttcctcgttcccctttggtt

SEQ ID NO: 104380 - DNA, 38 bp, Homo sapiens; identical to SEQ ID NO: 71064
  misc_feature 1..38: note = chr10:17347136-17347174
  misc_feature 1..38: note = Hypo
  source 1..38: mol_type = genomic DNA

SEQ ID NO: 104381 - DNA, 96 bp, Homo sapiens; identical to SEQ ID NO: 15356
  misc_feature 1..96: note = chr10:17429165-17429261
  misc_feature 1..96: note = Hypo
  source 1..96: mol_type = genomic DNA

SEQ ID NO: 104382 - DNA, 96 bp, Homo sapiens; identical to SEQ ID NO: 15357
  misc_feature 1..96: note = chr10:17429561-17429657
  misc_feature 1..96: note = Hypo
  source 1..96: mol_type = genomic DNA

SEQ ID NO: 104383 - DNA, 288 bp, Homo sapiens
  misc_feature 1..288: note = chr10:17495392-17495680
  misc_feature 1..288: note = Hyper
  source 1..288: mol_type = genomic DNA
gcccccccccaaccccgcgccctcttcaaacacacgcacactcttacactcactcgcgccgtcccagcctgcctactcccaacgagtccaagccggtgcagccgcgccccatgcccggctcgcagctcccgagccccagtccgcccgcgctgggcgccgctgtacctgttagtggcgcgcggtaccgcggtcgccgggctccggagcgtcctcagcgctgcgggggtgccgtgggtggcctccctgctttcctccaccagaatcctgcacagccggggagaaaactta

SEQ ID NO: 104384 - DNA, 842 bp, Homo sapiens
  misc_feature 1..842: note = chr10:17496002-17496844
  misc_feature 1..842: note = Hyper
  source 1..842: mol_type = genomic DNA
actccactctcaggccgtcgccgcccgtgggctgctccccgccgcggccaaaagtctccgcgcccgaggggaagcgatgggcggcttgggggtccgggggcgccaggcggggcgcgcggcgcggggcgcggccggcgggtgggtgggttacctggcgcggccgggcgcgtctgccgggcaccagagcaggcgcagcagcagcagcagcagcaggctggcgagcagggcgagcagtgcgccccccggccgcatcctgagccacaggcgccgccgccaccgctgctgccggggcgaagcacagcccgggcggccccgactcgcggctcccgccgccgccgccaccgccgccgtggccgcagccccgcgcacccacagcgttcacaggcggcagcgaggggcgcccgcagcccacccggcagagtctccgcggcgggcggagaagaagccgcgttcgggctcgccccgggctcccggccccggcccgcggagcgccgcgatcggctggcagatgacgattcgccgagctcgccgcctgtcctcccggaggcgctcggagctgctgcgggctccggtcgccgctgccactgctgctgccgccgccgccgcgcggggtcacctgaaggttggggcgcggaagctcaactccgtgctgattgggctccaagttttctgcgccctcgcctcgtcccgagtgcccgcgaatcccccggacgcccacgcagaccacccagccacaccacaactctgcctgcggagagaggagaggagaaaaaggggccgcttcaaaaactttcaaaactgtgcagtcgcttggctggatcctcccacgcatgaagaaagct

SEQ ID NO: 104385 - DNA, 43 bp, Homo sapiens; identical to SEQ ID NO: 71071
  misc_feature 1..43: note = chr10:17505922-17505965
  misc_feature 1..43: note = Hypo
  source 1..43: mol_type = genomic DNA

SEQ ID NO: 104386 - DNA, 18 bp, Homo sapiens
  misc_feature 1..18: note = chr10:17531563-17531581
  misc_feature 1..18: note = Hypo
  source 1..18: mol_type = genomic DNA
gagagaagtcttggccgg

SEQ ID NO: 104387 - DNA, 95 bp, Homo sapiens; identical to SEQ ID NO: 42544
  misc_feature 1..95: note = chr10:17579985-17580080
  misc_feature 1..95: note = Hypo
  source 1..95: mol_type = genomic DNA

SEQ ID NO: 104388 - DNA, 183 bp, Homo sapiens; identical to SEQ ID NO: 71080
  misc_feature 1..183: note = chr10:18349201-18349384
  misc_feature 1..183: note = Hypo
  source 1..183: mol_type = genomic DNA

SEQ ID NO: 104389 - DNA, 38 bp, Homo sapiens; identical to SEQ ID NO: 71081
  misc_feature 1..38: note = chr10:18363159-18363197
  misc_feature 1..38: note = Hypo
  source 1..38: mol_type = genomic DNA

SEQ ID NO: 104390 - DNA, 30 bp, Homo sapiens; identical to SEQ ID NO: 71082
  misc_feature 1..30: note = chr10:18393639-18393669
  misc_feature 1..30: note = Hypo
  source 1..30: mol_type = genomic DNA

SEQ ID NO: 104391 - DNA, 1066 bp, Homo sapiens
  misc_feature 1..1066: note = chr10:18429181-18430247
  misc_feature 1..1066: note = Hyper
  source 1..1066: mol_type = genomic DNA
gcgcagcggctgagtcggagcccacgcggcgcgcgcctcccgcgaggaacttttcggcttgtaggctgcttgtcactctcgctttccgacgcgcctccccctggctcgcgctcccggagttccctcccctcctggcgaggacctttcccggcgcccgcggctccgatccccgccgcgctgcgcccgctctcccggccccggctgccccgctgagggctcccctctcccaggcaccgcagccgcgcccccgcgtcccgcctcccgagcggctcgcttcgcccgatgccccggccccgtcccgcgcactgagcgcctggcagcagggcgccgagtcccggggcgctgcggggcgctgcgccgagaacggccgggcctgagccctgggcggcccccagagccgatcagagcgcggggaggcgggggcgaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacaggtagcgagagcgcggcgccttctccttcctttgtgagccgccgggcagggcaccgacctcgggttctcccggcgcctccactgcagggatctctagcctcgcacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatcgtgagtccgggtgggcgggagggggcccgcttcccgcagcgctttctacgatgccgactctcctggccacgctccgagccggggtgggcgtgggtgtgaggat

SEQ ID NO: 104392 - DNA, 122 bp, Homo sapiens; identical to SEQ ID NO: 71087
  misc_feature 1..122: note = chr10:18672520-18672642
  misc_feature 1..122: note = Hypo
  source 1..122: mol_type = genomic DNA

SEQ ID NO: 104393 - DNA, 30 bp, Homo sapiens; identical to SEQ ID NO: 71089
  misc_feature 1..30: note = chr10:18950336-18950366
  misc_feature 1..30: note = Hypo
  source 1..30: mol_type = genomic DNA

SEQ ID NO: 104394 - DNA, 39 bp, Homo sapiens; identical to SEQ ID NO: 71090
  misc_feature 1..39: note = chr10:18979783-18979822
  misc_feature 1..39: note = Hypo
  source 1..39: mol_type = genomic DNA

SEQ ID NO: 104395 - DNA, 30 bp, Homo sapiens; identical to SEQ ID NO: 71092
  misc_feature 1..30: note = chr10:19907854-19907884
  misc_feature 1..30: note = Hypo
  source 1..30: mol_type = genomic DNA

SEQ ID NO: 104396 - DNA, 76 bp, Homo sapiens; identical to SEQ ID NO: 71094
  misc_feature 1..76: note = chr10:20056020-20056096
  misc_feature 1..76: note = Hypo
  source 1..76: mol_type = genomic DNA

SEQ ID NO: 104397 - DNA, 152 bp, Homo sapiens; identical to SEQ ID NO: 71096
  misc_feature 1..152: note = chr10:20069005-20069157
  misc_feature 1..152: note = Hypo
  source 1..152: mol_type = genomic DNA

SEQ ID NO: 104398 - DNA, 54 bp, Homo sapiens; identical to SEQ ID NO: 71097
  misc_feature 1..54: note = chr10:20104308-20104362
  misc_feature 1..54: note = Hyper
  source 1..54: mol_type = genomic DNA

SEQ ID NO: 104399 - DNA, 237 bp, Homo sapiens; identical to SEQ ID NO: 71098
  misc_feature 1..237: note = chr10:20105418-20105655
  misc_feature 1..237: note = Hyper
  source 1..237: mol_type = genomic DNA

SEQ ID NO: 104400 - DNA, 243 bp, Homo sapiens; identical to SEQ ID NO: 71099
  misc_feature 1..243: note = chr10:20106451-20106694
  misc_feature 1..243: note = Hyper
  source 1..243: mol_type = genomic DNA

SEQ ID NO: 104401 - DNA, 32 bp, Homo sapiens; identical to SEQ ID NO: 71100
  misc_feature 1..32: note = chr10:20106927-20106959
  misc_feature 1..32: note = Hyper
  source 1..32: mol_type = genomic DNA

SEQ ID NO: 104402 - DNA, 30 bp, Homo sapiens; identical to SEQ ID NO: 71101
  misc_feature 1..30: note = chr10:20754862-20754892
  misc_feature 1..30: note = Hypo
  source 1..30: mol_type = genomic DNA

SEQ ID NO: 104403 - DNA, 336 bp, Homo sapiens; identical to SEQ ID NO: 71103
  misc_feature 1..336: note = chr10:21461963-21462299
  misc_feature 1..336: note = Hyper
  source 1..336: mol_type = genomic DNA

SEQ ID NO: 104404 - DNA, 53 bp, Homo sapiens; identical to SEQ ID NO: 71104
  misc_feature 1..53: note = chr10:21462618-21462671
  misc_feature 1..53: note = Hyper
  source 1..53: mol_type = genomic DNA

SEQ ID NO: 104405 - DNA, 60 bp, Homo sapiens; identical to SEQ ID NO: 71105
  misc_feature 1..60: note = chr10:21463573-21463633
  misc_feature 1..60: note = Hyper
  source 1..60: mol_type = genomic DNA

SEQ ID NO: 104406 - DNA, 359 bp, Homo sapiens
  misc_feature 1..359: note = chr10:21783399-21783758
  misc_feature 1..359: note = Hyper
  source 1..359: mol_type = genomic DNA
gaaagcaatcgtgagcgcggatcagtttctgtctttcccagaaagcgggctttttattgaggggaaacttagctgggaaaagtcagctcgtacgtttgttttggtttttcgtctatttgcttcccaatttaaaagtggccgcctaggcgacaggcctgcggttttcacagtgtaaaacggatcagagggaaagctccagcccctctcgactttcgcttgcggtttgcaacccctggggtgggtctgaccccgcgcggcacttgcccaggcgagcttccctcgtcgcggcccgacccgcgcgcggactcggcttccccaggtcaggacccactaggtgggccgctcggccccaagcctgg

SEQ ID NO: 104407 - DNA, 67 bp, Homo sapiens; identical to SEQ ID NO: 71107
  misc_feature 1..67: note = chr10:21784179-21784246
  misc_feature 1..67: note = Hyper
  source 1..67: mol_type = genomic DNA

SEQ ID NO: 104408 - DNA, 97 bp, Homo sapiens; identical to SEQ ID NO: 71108
  misc_feature 1..97: note = chr10:21789041-21789138
  misc_feature 1..97: note = Hyper
  source 1..97: mol_type = genomic DNA

SEQ ID NO: 104409 - DNA, 269 bp, Homo sapiens; identical to SEQ ID NO: 71109
  misc_feature 1..269: note = chr10:21805094-21805363
  misc_feature 1..269: note = Hyper
  source 1..269: mol_type = genomic DNA

SEQ ID NO: 104410 - DNA, 124 bp, Homo sapiens; identical to SEQ ID NO: 71110
  misc_feature 1..124: note = chr10:21810083-21810207
  misc_feature 1..124: note = Hypo
  source 1..124: mol_type = genomic DNA

SEQ ID NO: 104411 - DNA, 137 bp, Homo sapiens; identical to SEQ ID NO: 42546
  misc_feature 1..137: note = chr10:22033212-22033349
  misc_feature 1..137: note = Hypo
  source 1..137: mol_type = genomic DNA

SEQ ID NO: 104412 - DNA, 30 bp, Homo sapiens; identical to SEQ ID NO: 71112
  misc_feature 1..30: note = chr10:22040753-22040783
  misc_feature 1..30: note = Hypo
  source 1..30: mol_type = genomic DNA

SEQ ID NO: 104413 - DNA, 40 bp, Homo sapiens; identical to SEQ ID NO: 71113
  misc_feature 1..40: note = chr10:22047461-22047501
  misc_feature 1..40: note = Hypo
  source 1..40: mol_type = genomic DNA

SEQ ID NO: 104414 - DNA, 41 bp, Homo sapiens; identical to SEQ ID NO: 42547
  misc_feature 1..41: note = chr10:22450029-22450070
  misc_feature 1..41: note = Hypo
  source 1..41: mol_type = genomic DNA

SEQ ID NO: 104415 - DNA, 97 bp, Homo sapiens; identical to SEQ ID NO: 71115
  misc_feature 1..97: note = chr10:22465341-22465438
  misc_feature 1..97: note = Hypo
  source 1..97: mol_type = genomic DNA

SEQ ID NO: 104416 - DNA, 439 bp, Homo sapiens; identical to SEQ ID NO: 71116
  misc_feature 1..439: note = chr10:22518011-22518450
  misc_feature 1..439: note = Hyper
  source 1..439: mol_type = genomic DNA

SEQ ID NO: 104417 - DNA, 18 bp, Homo sapiens
  misc_feature 1..18: note = chr10:22518510-22518528
  misc_feature 1..18: note = Hyper
  source 1..18: mol_type = genomic DNA
cttcggtgtcattttccc

SEQ ID NO: 104418 - DNA, 1871 bp, Homo sapiens
  misc_feature 1..1871: note = chr10:22540725-22542596
  misc_feature 1..1871: note = Hyper
  source 1..1871: mol_type = genomic DNA
gagcctcctcctgggcgggcgacgctcggctgatgggaccgggccgcgcaagcctcggatgcagccgggtggggggcaccaggcgctaggcgaaggagcgcaggaccaaaggagatgcttggctcctaagataacacctttaaaaagaagaagaagaaagaaagaaaaacaaacaaacaaactcgatacttagcctcacgatccttgccaccccctccctgctccgccacccacacacaaaataaagtgagccgggcgggggagtgcgcgccctgaaagggaacaagaagcaaggcgcctgtgacacaaaatggagaaagaggaaccgggagtggaaaggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcctcgggacgccagtccgggaggcggccggaactccggttttcgcggttctcagcgatattaggcgcggccagtgtctgaaagctcctcggggttacgtcctggggcgactggaggcggctcacgactcagaaagtcggggcttctcgccccggatccccaccgctggcgtctgtcgaatccccacctcggtcctcgggtagaggcgcaagcgcgccccaagaccattctcttcgcgcccacccccgttattcttcactttcacttgacatcgttcttcactcaaggttaggtcctcgctagtgccagagaagcccctgggtccccagtgccctcagccccgcagcgtagggagcagccggcccgggagataaggaggccacagccatggaggccccaggcccggagtccccgcgccgtcgggttttgagccgcgcggctggccaggaccgccggctccttctctgtcccggtcctccgctcgcagccccgcagaggtgacggtacctggaggctggaagcgacggtttcctcgggccggtggagggaaacatgtcagggtcacagcgaaggaaaccgagacccacaggggtccccgggcgtccgggacgcgtcgctggttttgctcctagaaggaaaggccttcccgcttttgttccaccggctcaccaggtcctcccttcctggccaactctaacctcagctttgtgcgtgtcacccggccccgggataatcggatcctcccagac

SEQ ID NO: 104419 - DNA, 25 bp, Homo sapiens
  misc_feature 1..25: note = chr10:22566939-22566964
  misc_feature 1..25: note = Hypo
  source 1..25: mol_type = genomic DNA
tagcatggttgttaacggtggaggg

SEQ ID NO: 104420 - DNA, 84 bp, Homo sapiens; identical to SEQ ID NO: 71122
  misc_feature 1..84: note = chr10:22567324-22567408
  misc_feature 1..84: note = Hypo
  source 1..84: mol_type = genomic DNA

SEQ ID NO: 104421 - DNA, 2081 bp, Homo sapiens
  misc_feature 1..2081: note = chr10:22624022-22626103
  misc_feature 1..2081: note = Hyper
  source 1..2081: mol_type = genomic DNA
gaggaggggtggctgcgcggcgggaatctcaagatctgggcaaaggctcgcgtctcgggacgcgaagtcgacgccaaaatgggtccccggacaaggcgaccctgggagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaagggacgacttgggaaaagggactggggaaacagcggagaagtgaaagcggcctaaaatgggcgacggcgggcgagtcctctttatcagtgcagcaggctgccggagccgccatttggtggcggatctcggtagttcagtagcacgttgtgctgaacgtcacaactggcttgtctacgtggcatcgtcatttcttaaccgcggttttacgaaatgcaaatttccccctggccttcctcctccgcggccgtcgacccccctcggcgctccgggtggacggctccggggcgcggctcgtccctcgggtggtgcagcccccgcggcccgagacccggggagggccgggggtactttctgcgaggcgccttccccgcggcttctgcccgcgccaaagcctggtggaatccagcgcagacctaaagcacgcttgacaccccgatttttcgagactaggacgactctctgagccagcagctttcctctccctctcggggagaatctcatttccttggggtggtgagggtgacgggcactgtcttttggccccgcgtgtccgttccccggtctcccgcctcacccctctgcgaggtgaggaggggaaacggcgagcttaggcctggcgggaaggagcctacccgacgagagggctccgcggggagggtcggttggaatcccgccctagcgcctcctgctctgcccggtccccaccggggacggggaatgccagtcatttctgttgagtgctagcagggccggtgtcaccacctcgggtggccgaggcttcgaggttttcatgaaaagcccccgaagcgtgaggcgcccgcccagtggagaacaaagggccgagggccgaaggcgaggcgaggcagcgcgcgcggctcccttggctcgacctagctgggagtcgggggcgcgggcagggctcactcccggcctagaaactggagcccgccacccccgccccgcaggcgaccgcagggatcccattcttggagcccgagctgccatgttgccttcgcggaggccgccagtcacttgacgcttccgagacagcgaagcccccaacctgagagcccttcggccgtctttgccgcacagctgcagtcaaggcccggagggactgcgggacgcgggcgggagcgagagccctgtgggctgccaagccggcgcggccgcgccgcggcagccgcttcccttgccaccttcgttccaggggctgcggggctgcgcgctcggcagaggctcggttgccagtagcaaccacacgacggcgatttgcagccagggccgccgccgcagccgctggtacctctgcctcctcctacacctcgggctcgagcatttgaaaccctgggggttgccttcggtgacatctcccgcccccacctccagtcctcagtctccaaaatcctcagctctgctcaaaagccagcgcccccggctgggccctgcccccaccgcagacaataggagcggctgggagcgcacagggcggcgcgcgccgcgagcagcgggcacctgagcccccaaatccgggcgcgtcgctgagtctcagccccaggtgccctcttcgcggagttgatcagcaattctttttcagtggccaattagaaagcttttcttgacatcagaaataagggtggtgccaaagaaagaagtcaaacgcccactccctttctaataacatcgacacaaagaagagctcatggttgcgtctgcgcttggtaacagtggctttcctctgggttagagccacaggcacaagcacccgctgctatctttcttcttcgcctaccatgaata

SEQ ID NO: 104422 - DNA, 791 bp, Homo sapiens
  misc_feature 1..791: note = chr10:22633985-22634776
  misc_feature 1..791: note = Hyper
  source 1..791: mol_type = genomic DNA
cattcatgtgttgatcggattgtacaatgtgacgtgtgagatttctcgggaccgtcgaagctcagacaactccagggctgcaatttactcgtctggctgccctcgaaccaggctcccttggcgcgtggggctctcccggcgcttggtcccgacccgcgccgcagtcaggataccacggcaatctggggtcgctttgtaaggagctccgacctccgggcagtgcagggatactcgacggcgcgcgatgtcccggcggctccgcgagcctggcgcgctgagagccccagcagtccgagtcctcgagctcgggcgtcttcgcgccgccgccccgctcagtgcgcccaggcaccgcggccgtgacgtcacgcccgggactggccgttgcagcaagacggccgcgttccggttccggtaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaaggtagggccgaggcgggcaggtgccctaactagctggcgccgaggagacccgggtgcggtgggctccaccgactctctctcccgcagtgttcgagcaataccagaaggccaggacccagttcgtgcagatggtggcggagctggcgactagaccccaaaacatcgagacgctgcagaacgcgggtgagcccggagcccgaacccccgtcgcc

SEQ ID NO: 104423 - DNA, 125 bp, Homo sapiens; identical to SEQ ID NO: 71132
  misc_feature 1..125: note = chr10:22725790-22725915
  misc_feature 1..125: note = Hyper
  source 1..125: mol_type = genomic DNA

SEQ ID NO: 104424 - DNA, 1336 bp, Homo sapiens
  misc_feature 1..1336: note = chr10:22764573-22765909
  misc_feature 1..1336: note = Hyper
  source 1..1336: mol_type = genomic DNA
tgcgtaaataatactcgattaccatgccacctacatctttttgttaaaaatgcctttatgaaggctataatccttatcaaattaaaccctgcggatcccccttttaatacacagggagtcctcctcatttatgggcgtcggcgctaagcagctctggaaacgggcagacccagctgtgcagcgatgtccagtgtcgccgcatctgccccgcggggtgcagcatgagtcttcctttgtggcgtgcggctccatcggaacgcgcgttgcgacgacaaattccttttttcccccccgcagttaacagttctggggcagaggctggtggagaggtccagagcccactcagaccgagatgaagatgaggaaaagcatgagcaggaagaggctggcggctgcggcggccacagggaagagctcggtgcgcggcgcagcctcccgcgaccgcgactcctgggctgcgtcgaggagccgcgttgccataggaaccgtagcggcgccccagtgaaaccctgcgttcggacaggagaagctaaccgcggccgcccactcccacccgcgcttcctccccgcccccaccggccgtgcgcgaaaagcagagatccgagaaccgcgtgcggtacaaacggcaaaagcttcgcgcgcattttccgggagttgagcgcgcggccgcaggccgggaacctaccgctctcaggctcccagcccgggcgctacgaccctgtgggcgccgcctgtgcagcccctccttccagcccgctcgggcgcatcccccaggccgggccagcgacgcgggcaccgggagcccctcccgccggtccgggctttggcccacacccggggaccgcggagtgggaaaggaaccaaagcgcggcgcctggccgaccgcggacgaaattcgaggccggagggcgttttcttttttgcaaaattgccccaaagccagggccgcatgtacctactgtctcctttgccccacatgctccaagaaaataagacacattctaccccgagtcctaattattgggccatttccttaacgcgcggtctgtccccgtgggcagaaacatactgcgagatgcagtttgggtaattaacaaagagacgagacctaactgggcttccgaaatgctggatactgcggccgggtcgccccgcattcgggcatcgcgcggttcccggccttcgggacgttccggcccggccggactttgaccgctggcgtaattaggagaaacgcagaaggcggacgctccccaatttccccatcgagccttctcctcccgagtctgcgaagcccctggctcaggagacaccggctccgcgcctgggcctgcaa

SEQ ID NO: 104425 - DNA, 137 bp, Homo sapiens; identical to SEQ ID NO: 71134
  misc_feature 1..137: note = chr10:22823423-22823560
  misc_feature 1..137: note = Hypo
  source 1..137: mol_type = genomic DNA

SEQ ID NO: 104426 - DNA, 48 bp, Homo sapiens; identical to SEQ ID NO: 71136
  misc_feature 1..48: note = chr10:22831077-22831125
  misc_feature 1..48: note = Hypo
  source 1..48: mol_type = genomic DNA

SEQ ID NO: 104427 - DNA, 102 bp, Homo sapiens; identical to SEQ ID NO: 71137
  misc_feature 1..102: note = chr10:22832580-22832682
  misc_feature 1..102: note = Hypo
  source 1..102: mol_type = genomic DNA

SEQ ID NO: 104428 - DNA, 64 bp, Homo sapiens; identical to SEQ ID NO: 71138
  misc_feature 1..64: note = chr10:22833946-22834010
  misc_feature 1..64: note = Hypo
  source 1..64: mol_type = genomic DNA

SEQ ID NO: 104429 - DNA, 30 bp, Homo sapiens; identical to SEQ ID NO: 71139
  misc_feature 1..30: note = chr10:22869695-22869725
  misc_feature 1..30: note = Hypo
  source 1..30: mol_type = genomic DNA

SEQ ID NO: 104430 - DNA, 138 bp, Homo sapiens; identical to SEQ ID NO: 71140
  misc_feature 1..138: note = chr10:22869936-22870074
  misc_feature 1..138: note = Hypo
  source 1..138: mol_type = genomic DNA

SEQ ID NO: 104431 - DNA, 34 bp, Homo sapiens; identical to SEQ ID NO: 71141
  misc_feature 1..34: note = chr10:22949402-22949436
  misc_feature 1..34: note = Hypo
  source 1..34: mol_type = genomic DNA

SEQ ID NO: 104432 - DNA, 78 bp, Homo sapiens; identical to SEQ ID NO: 71142
  misc_feature 1..78: note = chr10:23001906-23001984
  misc_feature 1..78: note = Hyper
  source 1..78: mol_type = genomic DNA

SEQ ID NO: 104433 - DNA, 30 bp, Homo sapiens; identical to SEQ ID NO: 71143
  misc_feature 1..30: note = chr10:23002198-23002228
  misc_feature 1..30: note = Hyper
  source 1..30: mol_type = genomic DNA

SEQ ID NO: 104434 - DNA, 305 bp, Homo sapiens
  misc_feature 1..305: note = chr10:23216825-23217130
  misc_feature 1..305: note = Hyper
  source 1..305: mol_type = genomic DNA
ctggattcaggtaatcgcggacgcacttggctcctcccgcactggccgctgccctcggcgggacaatgggcgccctagcagccccgagcgttcccagggcgcaggcgcggcgcggcgtggcgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 104435 - DNA, 242 bp, Homo sapiens; identical to SEQ ID NO: 71146
  misc_feature 1..242: note = chr10:23460221-23460463
  misc_feature 1..242: note = Hyper
  source 1..242: mol_type = genomic DNA

SEQ ID NO: 104436 - DNA, 2936 bp, Homo sapiens
  misc_feature 1..2936: note = chr10:23461141-23464077
  misc_feature 1..2936: note = Hyper
  source 1..2936: mol_type = genomic DNA
taccaactgtcaccacgatccgcagttcttcgcccctccctctgtcccaattatctagaaacaaaaagagtagaaaatcgaaaatgagatggaggtcggcaggggtgtgaggccacggatggctgctgcttccttgcttccttcttttgaagccagaatcgactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccagagtctgggctgtgcagagcgcagagccccagcttccccagctccctcctggattaatgcttggtgccagggagaagcgcagggctctttccgcctcctccccaagtgcacccgggcgcgcttccatctgattagaatgtttcttccatcttattagaatgacagtagctttcaagtcattcattatgagaagaattttagtcttaaaagaaaaaagggagtcccactgtaattgtgagttgtaataaatgcaaacttctggtgccttcctctgcagcatggaagacagtaaaaaatgtgtctcgtccaaacgcaccccctctccaagcccattgtgaagtcagtcgccaacaaaggggacgtgtgaatattcaacaccgactctttcacttgttttttccggaatccctgagtcgactcaccccctctcctttttttttttttttaaatgggcgaatacctgtttaagttttaaaagcacatggaaattgcccgcgagcgaccatataatttgatttgccaggcaatctgcagagcgatcgcacgtcatttataatgttcattgagcattttgcctaattgtgtctgtctctgaaagggcagcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggccgctgttcacttctcgctgcgccgcgggttctgtagaagcgcaagaatggggctgattattccggtgcccacatgccgcccccacacgcccccacccccgtccggcgcaagacttcccttggccaaaagaggcgtttaattagttctggggccgcggagagccagcgtggccgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaaggcggcgaatggctgcctagccgccgcccctactagtgacactcggccgccagcccccgcccaggatgtgcacatctgctggcagcactggcccgggtggcagtcaccgggccacccactccacaggtacaaccgcacccaatccaacctggaactcggagggctgtgcgcgccgagctgggatcgcgccccagcgagccgggcctttggctgcgccagggcccaggccgagtcatcccgccgctcgcgtcgccgcgaggcgggacaccgtgtgatacctttgccgtgggctgggcgtcggccgcggggcggagagcgggtgtcccacctcgcctcatcatttgatttccgccagcgtctgaggacggcgcacccaattcgttccactcgctgcgctctgtgaaccagcggcgggcagggcgggggaggccgggctgggggagggcagggtggtcccaatcccccgcccccgccccgccggcctcgcggagcacaagtgttgggattcccacgggcaggcgtgctctgcggctggaggcccgagcgcccagggcccaggagacgtggcggacacagaggggtttgtaggcacggtgacctccgtgctcctgctctgaaagggcctgaaaggagcggtttatggtgcattaccagtcaagggctcaggtaccagcgccttgtgtcgggaacccgggcggccgcccgtgctgcaggtgtctgctatacaaacgccccgggagggggagggcaggccgccggattgggggccggggaggggcctccggcctggcctgctcctgccactcgcgcggtttcgctcttgctcctctgcagccatagcagccagccaggggtgcagacggagatcctagctgccgggacagaaaaagctgcaggggcctggctgcccagtcccgatttggtttcaagactaacggcagcaggaggtcacaggaggcttgaacctctccggggagacaaccgctgtgccggggaagaaacatt

SEQ ID NO: 104437 - DNA, 2592 bp, Homo sapiens
  misc_feature 1..2592: note = chr10:23479876-23482468
  misc_feature 1..2592: note = Hyper
  source 1..2592: mol_type = genomic DNA
ttggaatttgagaggcgtctgaatacccaacagaagcctctagtgagacaagtgcctgaaaaaggaagcggcccaggaggacgactcctttcagtcctctgtagagagaatacgcacgatggctgcgcttctgaactctcccggggtggaagctgcagcctggcttttaaccggaattgcccagaccttgaaagtgtttctttgttgctcttaaaaagaggaattcacgttgcatcgcagtctgtgataaagtctgtcttggggcagagctgcatacgttttgtgttttttttttttttcagaaaagaaaggtcgagaaagaaaaaaacaagtcattcagggatggtccctgtggccagtcggaaaggtgagagactcgggctttgaaaacgattcacattctgccctttaacttcaatgccttccctccggactgcgccggagcagacgattcaatggactccttttgtatccagtttattgctcagaatccctagggtctagatttgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagtgggagtgggcccggatcaccttccaatgacacccgcatatactctgcaaactgtgcaaaagcccttgaaaagtccagagatgggacagaagcccccagcagaacccaggccggagccccgcgcacctcggataagggggtggcggaatgcacccacctggtccctgagggcagcacccttagattgcccaggctgccgcggaggaggacgatcgccgcgcgggctccgctctcgccgtctgggccaccggcgcgcacccctaggaacttctctggccgcgtgtagacgcggcgcgcggctgccccagtcccagggcggaaggagccggcgctgctcagcgcgcgcgggtacgcagcgggcaccgcgggacgcaggtgcccctggagccgcacgcggggcaggtacagaatccagtatgcagaggcagaggagagggaagagagcggtgcgaggagccccgggccgcgcgaccccgccttttcctcgccccaggagctcccaaagggagcaaaacgccccccacccccgcccaccgccgcgcctccgggccccctcgccgccggcacaccgcgctctgattggctggcgcgatgggtccctggcacgcgcctatggatgttgttataagaatcctcgcgtgccggccctcagctccaggaagtccgccacagccctccccagcgcagcgcgagcgcgggccagagcgcagcggccgcgggcactccagggaggcccgggggcgggcagcccggcggccgcctagctgcccccagccagggccccgggagggaggggctcggacgggccttagaaactcaccaagaactaacacgcgcagcccggcagtcccgctgcccactgcggcggcgagcatggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggcggcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccatcggggcacccgtaagtgcttccgcttcccagctcagggagaaggggtcgggcactcgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccagacttgcagc

SEQ ID NO: 104438 - DNA, 1052 bp, Homo sapiens; identical to SEQ ID NO: 71158
  misc_feature 1..1052: note = chr10:23483566-23484618
  misc_feature 1..1052: note = Hyper
  source 1..1052: mol_type = genomic DNA

SEQ ID NO: 104439 - DNA, 30 bp, Homo sapiens; identical to SEQ ID NO: 71159
  misc_feature 1..30: note = chr10:23484874-23484904
  misc_feature 1..30: note = Hyper
  source 1..30: mol_type = genomic DNA

SEQ ID NO: 104440 - DNA, 207 bp, Homo sapiens; identical to SEQ ID NO: 71160
  misc_feature 1..207: note = chr10:23486207-23486414
  misc_feature 1..207: note = Hyper
  source 1..207: mol_type = genomic DNA

SEQ ID NO: 104441 - DNA, 2313 bp, Homo sapiens
  misc_feature 1..2313: note = chr10:23487742-23490055
  misc_feature 1..2313: note = Hyper
  source 1..2313: mol_type = genomic DNA
gcattactttcaagccgaacaaaggccagggccggggggaggcgggggaagggctcggctgtaatgaagcgcctctaaggcggaggtgctgccgtggaggctgaggcggcggcggagcgcgctgctgcgtttgtgcgcaagtgactctcctgtgccacacacaaaaggcctccctcttcccaccttctgccgcctttcagccctccggctcctgccgagcccgctcctgggactctgggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtggagtcggacgagtgtccccggaggcccgcctagcccttgctcccaggggcattcgggactcctgtgctgcctgtcttcgcttgaggctggaagtggctgcccgacgccttgctctccgcagttctgctatctttgcgcatggaagtctccaagaggggctccaggaagcagcgagcagggaggggagcgaacggccaaaaggagatccggggatgggaccccaggcttcttcggaggaggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 104442 - DNA, 76 bp, Homo sapiens; identical to SEQ ID NO: 71163
  misc_feature 1..76: note = chr10:23491161-23491237
  misc_feature 1..76: note = Hyper
  source 1..76: mol_type = genomic DNA

SEQ ID NO: 104443 - DNA, 79 bp, Homo sapiens
  misc_feature 1..79: note = chr10:23632945-23633024
  misc_feature 1..79: note = Hyper
  source 1..79: mol_type = genomic DNA
cgcctcccgcggagccgctcgctctcctgagtcggagtcgggaacccggcgtccgttgccatggcgactcccaggtaac

SEQ ID NO: 104444 - DNA, 123 bp, Homo sapiens; identical to SEQ ID NO: 32958
  misc_feature 1..123: note = chr10:23633374-23633497
  misc_feature 1..123: note = Hyper
  source 1..123: mol_type = genomic DNA

SEQ ID NO: 104445 - DNA, 29 bp, Homo sapiens
  misc_feature 1..29: note = chr10:23708959-23708988
  misc_feature 1..29: note = Hypo
  source 1..29: mol_type = genomic DNA
tacaaatgggccaggcgcggtggctcaca

SEQ ID NO: 104446 - DNA, 2603 bp, Homo sapiens
  misc_feature 1..2603: note = chr10:23982384-23984987
  misc_feature 1..2603: note = Hyper
  source 1..2603: mol_type = genomic DNA
ctcgcagttaaaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaaggcatcctgtgcagcctccaactttggggaaagagaatgcccaactcccgctctccaactacccgtactgccttcttccttttcctgcggtcgcctccaaactctgcttccctggtatccccgccccgacctggaagcgagcgcccccggctgctcgcggcagcccctcggcgcccgtttgcagggagcgagctctggctcctcacaggatccagacgcggttcccatccgtccccagccctgcagggcacacgcgcgcgtgcacacgcacgcgcttacactccagctcacactcgcgcgtcctcactccctgcaccccaccctccgcgccgctcctccgcggggtggggggtggtgggggtgacgtcaggactgcagtccagaagagagcggctggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgctacggttgatgttgggcgcctttggaagctggtcattaattcttgtcatcgggaggtttcgcggagggcgacagcgcccgggagcagggtgacccccacagcggccggccttccggctggctgccctccccgctcgccgctctccccgcgccgctgcgggtcctccgagaccccggactgtcctgagctgcttcgagggcgggcgagaccctgt

SEQ ID NO: 104447 - DNA, 145 bp, Homo sapiens; identical to SEQ ID NO: 71171
  misc_feature 1..145: note = chr10:24440378-24440523
  misc_feature 1..145: note = Hypo
  source 1..145: mol_type = genomic DNA

SEQ ID NO: 104448 - DNA, 44 bp, Homo sapiens; identical to SEQ ID NO: 71172
  misc_feature 1..44: note = chr10:24497697-24497741
  misc_feature 1..44: note = Hyper
  source 1..44: mol_type = genomic DNA

SEQ ID NO: 104449 - DNA, 30 bp, Homo sapiens; identical to SEQ ID NO: 71173
  misc_feature 1..30: note = chr10:24498138-24498168
  misc_feature 1..30: note = Hyper
  source 1..30: mol_type = genomic DNA

SEQ ID NO: 104450 - DNA, 104 bp, Homo sapiens; identical to SEQ ID NO: 71175
  misc_feature 1..104: note = chr10:24841749-24841853
  misc_feature 1..104: note = Hypo
  source 1..104: mol_type = genomic DNA

SEQ ID NO: 104451 - DNA, 24 bp, Homo sapiens
  misc_feature 1..24: note = chr10:24842550-24842574
  misc_feature 1..24: note = Hypo
  source 1..24: mol_type = genomic DNA
caggaaagggccaggcgaggtggc

SEQ ID NO: 104452 - DNA, 30 bp, Homo sapiens; identical to SEQ ID NO: 71177
  misc_feature 1..30: note = chr10:24860681-24860711
  misc_feature 1..30: note = Hypo
  source 1..30: mol_type = genomic DNA

SEQ ID NO: 104453 - DNA, 42 bp, Homo sapiens; identical to SEQ ID NO: 71178
  misc_feature 1..42: note = chr10:24908420-24908462
  misc_feature 1..42: note = Hypo
  source 1..42: mol_type = genomic DNA

SEQ ID NO: 104454 - DNA, 42 bp, Homo sapiens; identical to SEQ ID NO: 42555
  misc_feature 1..42: note = chr10:24988521-24988563
  misc_feature 1..42: note = Hypo
  source 1..42: mol_type = genomic DNA

SEQ ID NO: 104455 - DNA, 51 bp, Homo sapiens; identical to SEQ ID NO: 71180
  misc_feature 1..51: note = chr10:25241140-25241191
  misc_feature 1..51: note = Hyper
  source 1..51: mol_type = genomic DNA

SEQ ID NO: 104456 - DNA, 274 bp, Homo sapiens; identical to SEQ ID NO: 71181
  misc_feature 1..274: note = chr10:25241730-25242004
  misc_feature 1..274: note = Hyper
  source 1..274: mol_type = genomic DNA

SEQ ID NO: 104457 - DNA, 42 bp, Homo sapiens; identical to SEQ ID NO: 71182
  misc_feature 1..42: note = chr10:25408449-25408491
  misc_feature 1..42: note = Hypo
  source 1..42: mol_type = genomic DNA

SEQ ID NO: 104458 - DNA, 452 bp, Homo sapiens; identical to SEQ ID NO: 71183
  misc_feature 1..452: note = chr10:25463441-25463893
  misc_feature 1..452: note = Hyper
  source 1..452: mol_type = genomic DNA

SEQ ID NO: 104459 - DNA, 299 bp, Homo sapiens; identical to SEQ ID NO: 71184
  misc_feature 1..299: note = chr10:25464520-25464819
  misc_feature 1..299: note = Hyper
  source 1..299: mol_type = genomic DNA

SEQ ID NO: 104460 - DNA, 499 bp, Homo sapiens
  misc_feature 1..499: note = chr10:25465101-25465600
  misc_feature 1..499: note = Hyper
  source 1..499: mol_type = genomic DNA
gcgcaaggacgggctcggcggggacaagagccacttcaagtggtctccgccttatctggagtgcgagaacgggagttacaagcccgggtggctggttactctttcctctgccatctacgggttgcagcctaacctggtcccggaattcaggtagggagggccggggggcaggggggaaggcaaaagcgaagctttccttccggtcttgtgggtgggtgcacgtgtgaggaaggaacccttggctgtgacgcgaacgcttctcaccctcagagtagagacccgggctgagggacaccccacgcgggcgcgggtgcttgggggcaagaagcgccccacgcccgtcagcttccggcgctcggcgaaagccattcattctctcggaccagtttccccgcactgggcgagggacaggcagcccttggcaggacggagacacccccgctgctctgtgcttccctccaattgtccggagagcagggaggggcgttccccaccgggg

SEQ ID NO: 104461 - DNA, 67 bp, Homo sapiens; identical to SEQ ID NO: 71187
  misc_feature 1..67: note = chr10:25465877-25465944
  misc_feature 1..67: note = Hyper
  source 1..67: mol_type = genomic DNA

SEQ ID NO: 104462 - DNA, 148 bp, Homo sapiens; identical to SEQ ID NO: 42556
  misc_feature 1..148: note = chr10:25592447-25592595
  misc_feature 1..148: note = Hypo
  source 1..148: mol_type = genomic DNA

SEQ ID NO: 104463 - DNA, 183 bp, Homo sapiens; identical to SEQ ID NO: 32968
  misc_feature 1..183: note = chr10:26055811-26055994
  misc_feature 1..183: note = Hyper
  source 1..183: mol_type = genomic DNA

SEQ ID NO: 104464 - DNA, 32 bp, Homo sapiens; identical to SEQ ID NO: 42557
  misc_feature 1..32: note = chr10:26127993-26128025
  misc_feature 1..32: note = Hypo
  source 1..32: mol_type = genomic DNA

SEQ ID NO: 104465 - DNA, 30 bp, Homo sapiens; identical to SEQ ID NO: 42558
  misc_feature 1..30: note = chr10:26211012-26211042
  misc_feature 1..30: note = Hypo
  source 1..30: mol_type = genomic DNA

SEQ ID NO: 104466 - DNA, 1105 bp, Homo sapiens
  misc_feature 1..1105: note = chr10:26222992-26224097
  misc_feature 1..1105: note = Hyper
  source 1..1105: mol_type = genomic DNA
cgaggatgtggatggcgcggatggcgcggcctccacctgcgggcagtggagagagcggcgagaggaagaatattccccgcgagccgggataaggggccccttcggctcggttgacccaggtcagatcctcccgccgaccttcggcccgccctctacaggcggcccagttcttcccctgctcggctgcccctgcccgcccctcgagggagcgcccgtagccagcgcccccgtaaagaaataaggaggcgcccggcttcccgcccaggtacgtgtcgggacagcgcaggggactggcttggggcggcggtgggtagcggcgcccgcgcggcgctggaaacggccccgcttccttggaccccggggcttgcagggcgggcccggggctctctgagcgcgaggctgccgcgaccgcccgcccgcccaggtcagatccggaggacctgtgtgtttgtcggggcctggggtgagagaggggactcgaggggagaagtagagcgggaaaccaagagggggaatgtgaggcttgaacgagctggatgggagagctcgaggggaggagagggatgaacttgagggggaaacgggggcgggggtgaactcgagggggagccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttctcagaacaagcaggtcggtggagctgggctccctgcaaccccaaatgcatccgtaaaggagtttta

SEQ ID NO: 104467 - DNA, 30 bp, Homo sapiens; identical to SEQ ID NO: 71196
  misc_feature 1..30: note = chr10:26494015-26494045
  misc_feature 1..30: note = Hypo
  source 1..30: mol_type = genomic DNA

SEQ ID NO: 104468 - DNA, 652 bp, Homo sapiens
  misc_feature 1..652: note = chr10:26500510-26501162
  misc_feature 1..652: note = Hyper
  source 1..652: mol_type = genomic DNA
aagctttagttagcacgtatctaaacaccattaccaggctccaccagcccctctgctcctcagcttagaggagtttttaaaacctgttgagaattatcgcagatacgtttggccattatccagtcgtttcgattgtgcctttcctaaatgtccgcggttggcagaacgtgggaggaagaggacccgcctaactcggggtaggtggggacgcgctgctcactgtggtgaggttgacacttgggccctgggtttcacttgcaggtgctgggcggcggagagccccgagaaggaggaggagagagagccagcagccaacccctacgacttcaggaggctcctgcgcaaaacctcccagcgccggcgcctcgtccagcagtcctaaccgttcaacgaggcagtcaccgccgtcggaaggcgctggagcctgcggggcagcaggggccaagcaggcactctggggctggcaccagcaggcactgaagctgcggccctgatctccgcagaggctgcctgctgcgctcggccctcaagtgcccgggccggccttcgtgctccgaaacaagagacctgggagccctcgggaaacctcccccgacgctctctctcggaactcccgcaccctcctttctcaccagcccgccagttgtggcaa

SEQ ID NO: 104469 - DNA, 143 bp, Homo sapiens; identical to SEQ ID NO: 71199
  misc_feature 1..143: note = chr10:26501446-26501589
  misc_feature 1..143: note = Hyper
  source 1..143: mol_type = genomic DNA

SEQ ID NO: 104470 - DNA, 3737 bp, Homo sapiens
  misc_feature 1..3737: note = chr10:26503693-26507430
  misc_feature 1..3737: note = Hyper
  source 1..3737: mol_type = genomic DNA
tgagccctgagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagccgcctcgggaagccgacctcagccctttcctctctctccctccctccgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaacgagggccctgcaggcgatgccttctttcctactcggatttgtaaagccgagattgcttagttggaaaccctgttctcccctcccaggcgcacacagatcccccttacacgcaagcagcgggcgcttccacgcctccgcgggccaaggtcaccaaatgccctgattccatcccccacccgccatcaatcctgccgactctggccgctctgcctcattctcttccaagaagtttccattcgttttatttttttttccccagcccgaggtcctcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggcccgggccgccagcctcccgcttgccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccggggcggccaaggtcggcccgcggggtccaagcagtcttctcacctccgcatcccagtcagcggagtcggggtttcctggctgcgggtaggcgggagcgagggagccgggcccggcggaggattgacgaggcccgcgttcggtgtccttacccagccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacg

SEQ ID NO: 104471 - DNA, 36 bp, Homo sapiens; identical to SEQ ID NO: 71208
  misc_feature 1..36: note = chr10:26634123-26634159
  misc_feature 1..36: note = Hypo
  source 1..36: mol_type = genomic DNA

SEQ ID NO: 104472 - DNA, 30 bp, Homo sapiens; identical to SEQ ID NO: 71209
  misc_feature 1..30: note = chr10:26634775-26634805
  misc_feature 1..30: note = Hypo
  source 1..30: mol_type = genomic DNA

SEQ ID NO: 104473 - DNA, 139 bp, Homo sapiens; identical to SEQ ID NO: 71210
  misc_feature 1..139: note = chr10:26638399-26638538
  misc_feature 1..139: note = Hypo
  source 1..139: mol_type = genomic DNA

SEQ ID NO: 104474 - DNA, 32 bp, Homo sapiens; identical to SEQ ID NO: 71211
  misc_feature 1..32: note = chr10:26676768-26676800
  misc_feature 1..32: note = Hypo
  source 1..32: mol_type = genomic DNA

SEQ ID NO: 104475 - DNA, 430 bp, Homo sapiens
  misc_feature 1..430: note = chr10:26680701-26681131
  misc_feature 1..430: note = Hyper
  source 1..430: mol_type = genomic DNA
acctgctggaaagctcgcagcagggcccgctcccggtcctgggcaggcccaggcgcgtcaagacgccgcggctacctctgcggagcgcggccgctcggccaccagccccttcccgccccccgagctccgcggcactggagtccccgggcggtgccatgcgtccctggagcgcacgacactttcgggccctggggaccccgggaggccgggatctggcctggggtggagggcgaggccagtcggcccccacctgctcaccgggcagactgtacccgggcaacggctccccgcagctccggctttttgcctgaagccccctgcaggcaaattccgcgtcgcgcgggcccgcgggcgcgctgcagtctccgagccccaggaagcagagacccaggtaggcaaagccaccgcctggccgcgtcagctcatgtgg

SEQ ID NO: 104476 - DNA, 26 bp, Homo sapiens
  misc_feature 1..26: note = chr10:26699638-26699664
  misc_feature 1..26: note = Hypo
  source 1..26: mol_type = genomic DNA
atgcacctgtcgtcccggctactagg

SEQ ID NO: 104477 - DNA, 85 bp, Homo sapiens; identical to SEQ ID NO: 71215
  misc_feature 1..85: note = chr10:26699784-26699869
  misc_feature 1..85: note = Hypo
  source 1..85: mol_type = genomic DNA

SEQ ID NO: 104478 - DNA, 201 bp, Homo sapiens; identical to SEQ ID NO: 71216
  misc_feature 1..201: note = chr10:26710933-26711134
  misc_feature 1..201: note = Hypo
  source 1..201: mol_type = genomic DNA

SEQ ID NO: 104479 - DNA, 30 bp, Homo sapiens; identical to SEQ ID NO: 71217
  misc_feature 1..30: note = chr10:26716901-26716931
  misc_feature 1..30: note = Hypo
  source 1..30: mol_type = genomic DNA

SEQ ID NO: 104480 - DNA, 30 bp, Homo sapiens; identical to SEQ ID NO: 42560
  misc_feature 1..30: note = chr10:26720842-26720872
  misc_feature 1..30: note = Hypo
  source 1..30: mol_type = genomic DNA

SEQ ID NO: 104481 - DNA, 1032 bp, Homo sapiens
  misc_feature 1..1032: note = chr10:26727076-26728108
  misc_feature 1..1032: note = Hyper
  source 1..1032: mol_type = genomic DNA
tcctccacccccacccgagagacagctgaactccggccgggacgcgcgtgttgccagtccagccctgcaccgcgtcccctgagggcgggctgcaggcggccgggaagccttgcacaaccggcccaaaagaggaagcccagaaagtgctgaagtaaacactttgggagaccgttgcaacataaagcggcctctcagtctttggtggaaccatcactaggccccaatcccttagtccctcttgcgtcgaggctgcaaaatggttccattcgccaggagacgctcctgagagaagggcgcgcgcggcacaggtagggggaggcgcaacgtttcccagaattaaaataaaataaaataaaataaaataaaaatcccttcaaggtggttgtgtagtaggggtgggatgggggagagaaaatcaggcgcagactcgatgagttggagaaagcagcccctaactcggagtcctttacgcatatgtttgtctgtcccactgtctctaaccaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgaggtaagtggcgctcccagtcccgggagccctgggagcgccagcacgggcccctcggggctgtcaggaacccgtttgtcaagcccgtcgggtccgacgccgggggcagctccaggatctggcctcgtgaacgcgtgcccccaggcgtggccctcgagcgcagcgggtccccagggtcccctccgctgatctccactctggacccggctcgcgagggtgggggtgtgagggtttggggttcgggtttgctttttcccgagctattgcaacagatttgacagatttcctgcccaggaaattgctgcaaggtcaaacggggaactgctatg

SEQ ID NO: 104482 - DNA, 162 bp, Homo sapiens; identical to SEQ ID NO: 71221
  misc_feature 1..162: note = chr10:26733284-26733446
  misc_feature 1..162: note = Hypo
  source 1..162: mol_type = genomic DNA

SEQ ID NO: 104483 - DNA, 30 bp, Homo sapiens; identical to SEQ ID NO: 15362
  misc_feature 1..30: note = chr10:26739045-26739075
  misc_feature 1..30: note = Hypo
  source 1..30: mol_type = genomic DNA

SEQ ID NO: 104484 - DNA, 30 bp, Homo sapiens; identical to SEQ ID NO: 71223
  misc_feature 1..30: note = chr10:26746969-26746999
  misc_feature 1..30: note = Hypo
  source 1..30: mol_type = genomic DNA

SEQ ID NO: 104485 - DNA, 93 bp, Homo sapiens; identical to SEQ ID NO: 71224
  misc_feature 1..93: note = chr10:26775009-26775102
  misc_feature 1..93: note = Hypo
  source 1..93: mol_type = genomic DNA

SEQ ID NO: 104486 - DNA, 23 bp, Homo sapiens
  misc_feature 1..23: note = chr10:26783462-26783485
  misc_feature 1..23: note = Hypo
  source 1..23: mol_type = genomic DNA
aaaccaattctagaccgggcaca

SEQ ID NO: 104487 - DNA, 21 bp, Homo sapiens
  misc_feature 1..21: note = chr10:26791280-26791301
  misc_feature 1..21: note = Hypo
  source 1..21: mol_type = genomic DNA
gtctcttgggccaggcgtggt

SEQ ID NO: 104488 - DNA, 39 bp, Homo sapiens; identical to SEQ ID NO: 42564
  misc_feature 1..39: note = chr10:26801561-26801600
  misc_feature 1..39: note = Hypo
  source 1..39: mol_type = genomic DNA

SEQ ID NO: 104489 - DNA, 99 bp, Homo sapiens; identical to SEQ ID NO: 42565
  misc_feature 1..99: note = chr10:26801660-26801759
  misc_feature 1..99: note = Hypo
  source 1..99: mol_type = genomic DNA

SEQ ID NO: 104490 - DNA, 30 bp, Homo sapiens; identical to SEQ ID NO: 71229
  misc_feature 1..30: note = chr10:26816959-26816989
  misc_feature 1..30: note = Hypo
  source 1..30: mol_type = genomic DNA

SEQ ID NO: 104491 - DNA, 81 bp, Homo sapiens; identical to SEQ ID NO: 71230
  misc_feature 1..81: note = chr10:26832035-26832116
  misc_feature 1..81: note = Hypo
  source 1..81: mol_type = genomic DNA

SEQ ID NO: 104492 - DNA, 207 bp, Homo sapiens; identical to SEQ ID NO: 71231
  misc_feature 1..207: note = chr10:26854203-26854410
  misc_feature 1..207: note = Hypo
  source 1..207: mol_type = genomic DNA

SEQ ID NO: 104493 - DNA, 30 bp, Homo sapiens; identical to SEQ ID NO: 71232
  misc_feature 1..30: note = chr10:26871319-26871349
  misc_feature 1..30: note = Hypo
  source 1..30: mol_type = genomic DNA

SEQ ID NO: 104494 - DNA, 60 bp, Homo sapiens; identical to SEQ ID NO: 71233
  misc_feature 1..60: note = chr10:26873385-26873445
  misc_feature 1..60: note = Hypo
  source 1..60: mol_type = genomic DNA

SEQ ID NO: 104495 - DNA, 197 bp, Homo sapiens; identical to SEQ ID NO: 71234
  misc_feature 1..197: note = chr10:26877695-26877892
  misc_feature 1..197: note = Hypo
  source 1..197: mol_type = genomic DNA

SEQ ID NO: 104496 - DNA, 161 bp, Homo sapiens; identical to SEQ ID NO: 71235
  misc_feature 1..161: note = chr10:26902350-26902511
  misc_feature 1..161: note = Hypo
  source 1..161: mol_type = genomic DNA

SEQ ID NO: 104497 - DNA, 24 bp, Homo sapiens
  misc_feature 1..24: note = chr10:26907325-26907349
  misc_feature 1..24: note = Hypo
  source 1..24: mol_type = genomic DNA
caccgcacccggcccaaaaatatg

SEQ ID NO: 104498 - DNA, 45 bp, Homo sapiens; identical to SEQ ID NO: 42570
  misc_feature 1..45: note = chr10:26942249-26942294
  misc_feature 1..45: note = Hypo
  source 1..45: mol_type = genomic DNA

SEQ ID NO: 104499 - DNA, 30 bp, Homo sapiens; identical to SEQ ID NO: 71238
  misc_feature 1..30: note = chr10:26964475-26964505
  misc_feature 1..30: note = Hypo
  source 1..30: mol_type = genomic DNA

SEQ ID NO: 104500 - DNA, 22 bp, Homo sapiens
  misc_feature 1..22: note = chr10:27004609-27004631
  misc_feature 1..22: note = Hypo
  source 1..22: mol_type = genomic DNA
gccaccgcgcctgggcactcct

SEQ ID NO: 104501 - DNA, 15 bp, Homo sapiens
  misc_feature 1..15: note = chr10:27542296-27542311
  misc_feature 1..15: note = Hypo
  source 1..15: mol_type = genomic DNA
cgcagttggactcat

SEQ ID NO: 104502 - DNA, 1030 bp, Homo sapiens
  misc_feature 1..1030: note = chr10:27547520-27548550
  misc_feature 1..1030: note = Hyper
  source 1..1030: mol_type = genomic DNA
ctgctaacttgtccccgaccccacaactgctcacgaccttcgtgaaggtcaacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctccttcgcccttgcagctcggcctcccgctcccaacgtggtgttcgccgtcacttcccacctcgtccctttaccgaatccattcttggaaacttagggtctcagctctgacgcccccttcttgtaacgagtctggtgggggccgtcatcccacactaggcttagctttgattttacttagggccctgttcatgccagttctaaaagttcgattttctgtaggt

SEQ ID NO: 104503 - DNA, 17 bp, Homo sapiens
  misc_feature 1..17: note = chr10:27794496-27794513
  misc_feature 1..17: note = Hypo
  source 1..17: mol_type = genomic DNA
atttattttttgagacg

SEQ ID NO: 104504 - DNA, 42 bp, Homo sapiens; identical to SEQ ID NO: 71247
  misc_feature 1..42: note = chr10:27846677-27846719
  misc_feature 1..42: note = Hypo
  source 1..42: mol_type = genomic DNA

SEQ ID NO: 104505 - DNA, 640 bp, Homo sapiens; identical to SEQ ID NO: 71248
  misc_feature 1..640: note = chr10:28030465-28031105
  misc_feature 1..640: note = Hyper
  source 1..640: mol_type = genomic DNA

SEQ ID NO: 104506 - DNA, 324 bp, Homo sapiens; identical to SEQ ID NO: 32990
  misc_feature 1..324: note = chr10:28031314-28031638
  misc_feature 1..324: note = Hyper
  source 1..324: mol_type = genomic DNA

SEQ ID NO: 104507 - DNA, 881 bp, Homo sapiens; identical to SEQ ID NO: 32991
  misc_feature 1..881: note = chr10:28031863-28032744
  misc_feature 1..881: note = Hyper
  source 1..881: mol_type = genomic DNA

SEQ ID NO: 104508 - DNA, 2884 bp, Homo sapiens
  misc_feature 1..2884: note = chr10:28032952-28035836
  misc_feature 1..2884: note = Hyper
  source 1..2884: mol_type = genomic DNA
gatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcatacacacacacacacacacacacacacacacacaccctttgcctcgccaagcgcccacactcgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgcgacgacgtgtttttcctagcgaagtcatcacgaggttagccacctcggacacttccccggcagccccaagcccacgcagagatcgcagacacagacacccggcgcgctgtaggtctgcaggcagcaggctcagaggcaagcgatggcaaaggtccgagcgctgtcctgtcgcaaggggtccgggggcgtgtgaaccacacttgctgaccctcccaggactcccgcgcgcggccacccgcgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccagaccttggagggaagttgggggaagggcgggagagcaccggcgcccagggcgcaggggccagagcgagcctggcgttccgccgcagccggctgagactcggcgacgcgggggctgtacctgtggctgcggggccgacggccggctgcagggcggctggctctcccgcctcgagactaggcgcactcccatccccgccgcatgttctccacgcgggctccagcgcgctcaccaccgccaccgccgtcgtctcggctttatttacccagcccggcgcgcgccgcccgggaacaggaatagcgaggccttctcatgtttcctgactgccggtcccagccggcgaacatcctgcgggcgcggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtgcccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatactttgcttcctaacattaccgcaaatataagtagcgaaagcggcggtttaggtgcaactgcaagctcagagcttctggcagcccagaagatccccaaggtgccaacacgaagctgcctgcgctctcgccgaaggccctgtggtcctagcgaactttcgccctttttaaagaacaaacttagatttccccccaccaagcttaaagaaatagcgccatttgtccttt

SEQ ID NO: 104509 - DNA, 30 bp, Homo sapiens; identical to SEQ ID NO: 71255
  misc_feature 1..30: note = chr10:28036088-28036118
  misc_feature 1..30: note = Hyper
  source 1..30: mol_type = genomic DNA

SEQ ID NO: 104510 - DNA, 137 bp, Homo sapiens; identical to SEQ ID NO: 71256
  misc_feature 1..137: note = chr10:28258201-28258338
  misc_feature 1..137: note = Hypo
  source 1..137: mol_type = genomic DNA

SEQ ID NO: 104511 - DNA, 39 bp, Homo sapiens
  misc_feature 1..39: note = chr10:28287341-28287380
  misc_feature 1..39: note = Hyper
  source 1..39: mol_type = genomic DNA
ggacggcgaaaaccacgctgggagcgggaggcagagctg

SEQ ID NO: 104512 - DNA, 429 bp, Homo sapiens; identical to SEQ ID NO: 71258
  misc_feature 1..429: note = chr10:28287777-28288206
  misc_feature 1..429: note = Hyper
  source 1..429: mol_type = genomic DNA

SEQ ID NO: 104513 - DNA, 30 bp, Homo sapiens; identical to SEQ ID NO: 71259
  misc_feature 1..30: note = chr10:28504430-28504460
  misc_feature 1..30: note = Hypo
  source 1..30: mol_type = genomic DNA

SEQ ID NO: 104514 - DNA, 32 bp, Homo sapiens; identical to SEQ ID NO: 71260
  misc_feature 1..32: note = chr10:28559044-28559076
  misc_feature 1..32: note = Hypo
  source 1..32: mol_type = genomic DNA

SEQ ID NO: 104515 - DNA, 22 bp, Homo sapiens
  misc_feature 1..22: note = chr10:28791009-28791031
  misc_feature 1..22: note = Hypo
  source 1..22: mol_type = genomic DNA
gccaccacgccctgccagtatg

SEQ ID NO: 104516 - DNA, 256 bp, Homo sapiens; identical to SEQ ID NO: 71263
  misc_feature 1..256: note = chr10:28850452-28850708
  misc_feature 1..256: note = Hypo
  source 1..256: mol_type = genomic DNA

SEQ ID NO: 104517 - DNA, 706 bp, Homo sapiens
  misc_feature 1..706: note = chr10:28957423-28958129
  misc_feature 1..706: note = Hyper
  source 1..706: mol_type = genomic DNA
actcccgggctcccacgcggtttatttttaagacgctggtttaaatttctcgagttacggggggaaggggttgcggtgggagcgagactgagaaccacagcgcgaacaggggcgcattggtaccaggatcggtacagggatgtctccagttcctatagactctagcctcggggggagtctgtccagactacaagtgtctgtgcccctgttttattttgagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcactcgctctcggctcccgatcgctctcccagcctcgccctcccctcagtatcgatctttttggatgttctccctgcctaaaacggatgctaatatctcttcgattgaaccgaaatggcgctgcggctgctacttttc

SEQ ID NO: 104518 - DNA, 192 bp, Homo sapiens; identical to SEQ ID NO: 71266
  misc_feature 1..192: note = chr10:28965689-28965881
  misc_feature 1..192: note = Hyper
  source 1..192: mol_type = genomic DNA

SEQ ID NO: 104519 - DNA, 30 bp, Homo sapiens; identical to SEQ ID NO: 71267
  misc_feature 1..30: note = chr10:28967236-28967266
  misc_feature 1..30: note = Hyper
  source 1..30: mol_type = genomic DNA

SEQ ID NO: 104520 - DNA, 146 bp, Homo sapiens; identical to SEQ ID NO: 71268
  misc_feature 1..146: note = chr10:29011016-29011162
  misc_feature 1..146: note = Hyper
  source 1..146: mol_type = genomic DNA

SEQ ID NO: 104521 - DNA, 133 bp, Homo sapiens; identical to SEQ ID NO: 71269
  misc_feature 1..133: note = chr10:29011504-29011637
  misc_feature 1..133: note = Hyper
  source 1..133: mol_type = genomic DNA

SEQ ID NO: 104522 - DNA, 202 bp, Homo sapiens; identical to SEQ ID NO: 71271
  misc_feature 1..202: note = chr10:29164926-29165128
  misc_feature 1..202: note = Hypo
  source 1..202: mol_type = genomic DNA

SEQ ID NO: 104523 - DNA, 38 bp, Homo sapiens; identical to SEQ ID NO: 71273
  misc_feature 1..38: note = chr10:29300117-29300155
  misc_feature 1..38: note = Hypo
  source 1..38: mol_type = genomic DNA

SEQ ID NO: 104524 - DNA, 28 bp, Homo sapiens
  misc_feature 1..28: note = chr10:29718763-29718791
  misc_feature 1..28: note = Hypo
  source 1..28: mol_type = genomic DNA
aaatatggtagtggccgggcatggtggc

SEQ ID NO: 104525 - DNA, 204 bp, Homo sapiens
  misc_feature 1..204: note = chr10:30025527-30025731
  misc_feature 1..204: note = Hyper
  source 1..204: mol_type = genomic DNA
gagagaggacatctccgagaccttcccgggggtgcgcccacactcacgcgcccacactcgcgtccccaccttcccccccgtctcacctccgcgcgctcctgcagagcccgactgcgcccgccctcctcgcccacctgccgggcccgggccgggggtgcacactagcgcggggccttggtggtgcggcaccgtcccctgcccaag

SEQ ID NO: 104526 - DNA, 218 bp, Homo sapiens
  misc_feature 1..218: note = chr10:30025952-30026170
  misc_feature 1..218: note = Hyper
  source 1..218: mol_type = genomic DNA
ggccggcggggccggcgccacccaccccctcggcgcgcgcccggcccagggacgcgcccacgcgcacgcgcccagcggctcagggctccctggctctcaccggctctgctgcccggaggcagccgcttaccctggagccctgagaggcccctttgagtctccagaccttccagggataaataaaatctggcgacctgtgccaacgctgtgggccagtt

SEQ ID NO: 104527 - DNA, 30 bp, Homo sapiens; identical to SEQ ID NO: 71279
  misc_feature 1..30: note = chr10:30198419-30198449
  misc_feature 1..30: note = Hypo
  source 1..30: mol_type = genomic DNA

SEQ ID NO: 104528 - DNA, 121 bp, Homo sapiens; identical to SEQ ID NO: 71280
  misc_feature 1..121: note = chr10:30259002-30259123
  misc_feature 1..121: note = Hypo
  source 1..121: mol_type = genomic DNA

SEQ ID NO: 104529 - DNA, 882 bp, Homo sapiens
  misc_feature 1..882: note = chr10:30347841-30348723
  misc_feature 1..882: note = Hyper
  source 1..882: mol_type = genomic DNA
gagcgggagcggggccgcggcgggagccccccaccgtcccgggcagtccagacggccggggcagcgtgggaactgggacctcggggacccagcgcggcggctgtcagctctggggtgaggtccgcgagatctgggcgcgagggcgcgggaggggttggtggacacaggctggggagggcgacttcgagaggggagtgagtgaccccggccccccaggccctccgcgcgccgaggggcgacgcgagcgctaacgccagccgcggcccgcggtgcccgccccgggacccccgcgctccgagcggggcacctgaggggaggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagcggctccctcatgccgcctcgcgccgccaccgccgccgctccggccggccggggaccagcgcgacccgccccgcctgcagccgccgaggccgagcatgcccggagaaccgccgtccgccccgcccaccgcccgggcccgccccgcccaccgcccggggctgcctcctctgcgctgagggcggtatccaggccacgagcttcctaggcttttggggtccgcctgcgtgggtcgcgcagaaggcacaagtgagctgaccaccattccctcttttcttgtcacttgggtttgggccacgtcaaccctgtgga

SEQ ID NO: 104530 - DNA, 30 bp, Homo sapiens; identical to SEQ ID NO: 71282
  misc_feature 1..30: note = chr10:30509201-30509231
  misc_feature 1..30: note = Hyper
  source 1..30: mol_type = genomic DNA

SEQ ID NO: 104531 - DNA, 30 bp, Homo sapiens; identical to SEQ ID NO: 71284
  misc_feature 1..30: note = chr10:30736669-30736699
  misc_feature 1..30: note = Hypo
  source 1..30: mol_type = genomic DNA

SEQ ID NO: 104532 - DNA, 32 bp, Homo sapiens; identical to SEQ ID NO: 42573
  misc_feature 1..32: note = chr10:31006068-31006100
  misc_feature 1..32: note = Hypo
  source 1..32: mol_type = genomic DNA

SEQ ID NO: 104533 - DNA, 213 bp, Homo sapiens; identical to SEQ ID NO: 71286
  misc_feature 1..213: note = chr10:31073224-31073437
  misc_feature 1..213: note = Hyper
  source 1..213: mol_type = genomic DNA

SEQ ID NO: 104534 - DNA, 38 bp, Homo sapiens; identical to SEQ ID NO: 71287
  misc_feature 1..38: note = chr10:31073843-31073881
  misc_feature 1..38: note = Hyper
  source 1..38: mol_type = genomic DNA

SEQ ID NO: 104535 - DNA, 101 bp, Homo sapiens; identical to SEQ ID NO: 71288
  misc_feature 1..101: note = chr10:31074105-31074206
  misc_feature 1..101: note = Hyper
  source 1..101: mol_type = genomic DNA

SEQ ID NO: 104536 - DNA, 144 bp, Homo sapiens; identical to SEQ ID NO: 71291
  misc_feature 1..144: note = chr10:31152656-31152800
  misc_feature 1..144: note = Hypo
  source 1..144: mol_type = genomic DNA

SEQ ID NO: 104537 - DNA, 30 bp, Homo sapiens; identical to SEQ ID NO: 71292
  misc_feature 1..30: note = chr10:31167819-31167849
  misc_feature 1..30: note = Hypo
  source 1..30: mol_type = genomic DNA

SEQ ID NO: 104538 - DNA, 285 bp, Homo sapiens; identical to SEQ ID NO: 71294
  misc_feature 1..285: note = chr10:31422831-31423116
  misc_feature 1..285: note = Hyper
  source 1..285: mol_type = genomic DNA

SEQ ID NO: 104539 - DNA, 672 bp, Homo sapiens; identical to SEQ ID NO: 71295
  misc_feature 1..672: note = chr10:31608744-31609416
  misc_feature 1..672: note = Hyper
  source 1..672: mol_type = genomic DNA

SEQ ID NO: 104540 - DNA, 439 bp, Homo sapiens; identical to SEQ ID NO: 71296
  misc_feature 1..439: note = chr10:31609668-31610107
  misc_feature 1..439: note = Hyper
  source 1..439: mol_type = genomic DNA

SEQ ID NO: 104541 - DNA, 220 bp, Homo sapiens; identical to SEQ ID NO: 71298
  misc_feature 1..220: note = chr10:31769214-31769434
  misc_feature 1..220: note = Hypo
  source 1..220: mol_type = genomic DNA

SEQ ID NO: 104542 - DNA, 154 bp, Homo sapiens; identical to SEQ ID NO: 71299
  misc_feature 1..154: note = chr10:31874052-31874206
  misc_feature 1..154: note = Hypo
  source 1..154: mol_type = genomic DNA

SEQ ID NO: 104543 - DNA, 384 bp, Homo sapiens; identical to SEQ ID NO: 71300
  misc_feature 1..384: note = chr10:31892881-31893265
  misc_feature 1..384: note = Hypo
  source 1..384: mol_type = genomic DNA

SEQ ID NO: 104544 - DNA, 98 bp, Homo sapiens; identical to SEQ ID NO: 71301
  misc_feature 1..98: note = chr10:31951749-31951847
  misc_feature 1..98: note = Hypo
  source 1..98: mol_type = genomic DNA

SEQ ID NO: 104545 - DNA, 16 bp, Homo sapiens
  misc_feature 1..16: note = chr10:32171091-32171107
  misc_feature 1..16: note = Hypo
  source 1..16: mol_type = genomic DNA
tcggcctcccaaagtg

SEQ ID NO: 104546 - DNA, 39 bp, Homo sapiens; identical to SEQ ID NO: 71304
  misc_feature 1..39: note = chr10:32176855-32176894
  misc_feature 1..39: note = Hypo
  source 1..39: mol_type = genomic DNA

SEQ ID NO: 104547 - DNA, 198 bp, Homo sapiens; identical to SEQ ID NO: 71305
  misc_feature 1..198: note = chr10:32499001-32499199
  misc_feature 1..198: note = Hypo
  source 1..198: mol_type = genomic DNA

SEQ ID NO: 104548 - DNA, 30 bp, Homo sapiens; identical to SEQ ID NO: 71306
  misc_feature 1..30: note = chr10:32621991-32622021
  misc_feature 1..30: note = Hypo
  source 1..30: mol_type = genomic DNA

SEQ ID NO: 104549 - DNA, 30 bp, Homo sapiens; identical to SEQ ID NO: 42577
  misc_feature 1..30: note = chr10:32638913-32638943
  misc_feature 1..30: note = Hypo
  source 1..30: mol_type = genomic DNA

SEQ ID NO: 104550 - DNA, 153 bp, Homo sapiens; identical to SEQ ID NO: 71308
  misc_feature 1..153: note = chr10:32670730-32670883
  misc_feature 1..153: note = Hypo
  source 1..153: mol_type = genomic DNA

SEQ ID NO: 104551 - DNA, 42 bp, Homo sapiens; identical to SEQ ID NO: 71309
  misc_feature 1..42: note = chr10:32736495-32736537
  misc_feature 1..42: note = Hypo
  source 1..42: mol_type = genomic DNA

SEQ ID NO: 104552 - DNA, 193 bp, Homo sapiens; identical to SEQ ID NO: 71313
  misc_feature 1..193: note = chr10:33233331-33233524
  misc_feature 1..193: note = Hypo
  source 1..193: mol_type = genomic DNA

SEQ ID NO: 104553 - DNA, 47 bp, Homo sapiens; identical to SEQ ID NO: 33011
  misc_feature 1..47: note = chr10:33622724-33622771
  misc_feature 1..47: note = Hyper
  source 1..47: mol_type = genomic DNA

SEQ ID NO: 104554 - DNA, 206 bp, Homo sapiens; identical to SEQ ID NO: 71319
  misc_feature 1..206: note = chr10:33623014-33623220
  misc_feature 1..206: note = Hyper
  source 1..206: mol_type = genomic DNA

SEQ ID NO: 104555 - DNA, 394 bp, Homo sapiens; identical to SEQ ID NO: 71320
  misc_feature 1..394: note = chr10:33624053-33624447
  misc_feature 1..394: note = Hyper
  source 1..394: mol_type = genomic DNA

SEQ ID NO: 104556 - DNA, 143 bp, Homo sapiens; identical to SEQ ID NO: 71321
  misc_feature 1..143: note = chr10:33624698-33624841
  misc_feature 1..143: note = Hyper
  source 1..143: mol_type = genomic DNA

SEQ ID NO: 104557 - DNA, 582 bp, Homo sapiens; identical to SEQ ID NO: 71322
  misc_feature 1..582: note = chr10:33625288-33625870
  misc_feature 1..582: note = Hyper
  source 1..582: mol_type = genomic DNA

SEQ ID NO: 104558 - DNA, 59 bp, Homo sapiens; identical to SEQ ID NO: 71323
  misc_feature 1..59: note = chr10:34001866-34001925
  misc_feature 1..59: note = Hypo
  source 1..59: mol_type = genomic DNA

SEQ ID NO: 104559 - DNA, 32 bp, Homo sapiens; identical to SEQ ID NO: 71326
  misc_feature 1..32: note = chr10:35103047-35103079
  misc_feature 1..32: note = Hyper
  source 1..32: mol_type = genomic DNA

SEQ ID NO: 104560 - DNA, 52 bp, Homo sapiens; identical to SEQ ID NO: 71327
  misc_feature 1..52: note = chr10:35103482-35103534
  misc_feature 1..52: note = Hyper
  source 1..52: mol_type = genomic DNA

SEQ ID NO: 104561 - DNA, 39 bp, Homo sapiens; identical to SEQ ID NO: 71328
  misc_feature 1..39: note = chr10:35104078-35104117
  misc_feature 1..39: note = Hyper
  source 1..39: mol_type = genomic DNA

SEQ ID NO: 104562 - DNA, 353 bp, Homo sapiens; identical to SEQ ID NO: 71329
  misc_feature 1..353: note = chr10:35104860-35105213
  misc_feature 1..353: note = Hyper
  source 1..353: mol_type = genomic DNA

SEQ ID NO: 104563 - DNA, 38 bp, Homo sapiens; identical to SEQ ID NO: 71330
  misc_feature 1..38: note = chr10:35152333-35152371
  misc_feature 1..38: note = Hypo
  source 1..38: mol_type = genomic DNA

SEQ ID NO: 104564 - DNA, 38 bp, Homo sapiens; identical to SEQ ID NO: 71331
  misc_feature 1..38: note = chr10:35207255-35207293
  misc_feature 1..38: note = Hypo
  source 1..38: mol_type = genomic DNA

SEQ ID NO: 104565 - DNA, 1470 bp, Homo sapiens
  misc_feature 1..1470: note = chr10:35929088-35930558
  misc_feature 1..1470: note = Hyper
  source 1..1470: mol_type = genomic DNA
caggaaccatgtgagcgacaagatcacccaccagatggagctggccatgccgaagaagtagaccagcaagaagaccacggtgcacagcgcggggccggtggtctcgtagcgcacgtgctgctccaccgcgcccagctcctcgtactcgccgcgcccgcccgggccgcccgcgcccgcgcccgccgcgcccgcgcccgccgccgcgccgcccgcgcccccagcgccccccgcgcccggcgcgccaccgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggagccgcgccgccgccagggggccgcgccttcccgccaccgccgccgccgcgagctgggggcgccgccgcgtccccgccgccaccgcccctgccgccgccgcggtgcgggggcctggcccccggcgggcggccgtggccgctgcccgaaggcggctgctcgccgggcggcggcggcggcaggcggcgcggcgggctgggcgcggcggtggttaggtcggtgcggttgtagtccatgcacagcgtgtcagggttgccttgctcgggcagccggtcgcagcgcatgcggtcgggccaggcgaagccgtactggcgcatgagcggcgcgcagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaacaggtaaccccactccatgctgtgcgcctcggcccggtgccctcgccctccaggcggcgcgcagaggggtgccggggggggggcccacgagagagccgcagacgggtacagcgggtgatctggggtctcccttatgcttcgcccgggaggggggtctgccgataatctaaccccttctaggggcgcgtccgcagcggcgcggcccgcagcctgggcagg

SEQ ID NO: 104566 - DNA, 35 bp, Homo sapiens; identical to SEQ ID NO: 71333
  misc_feature 1..35: note = chr10:35931026-35931061
  misc_feature 1..35: note = Hyper
  source 1..35: mol_type = genomic DNA

SEQ ID NO: 104567 - DNA, 30 bp, Homo sapiens; identical to SEQ ID NO: 71334
  misc_feature 1..30: note = chr10:35931404-35931434
  misc_feature 1..30: note = Hyper
  source 1..30: mol_type = genomic DNA

SEQ ID NO: 104568 - DNA, 242 bp, Homo sapiens; identical to SEQ ID NO: 71335
  misc_feature 1..242: note = chr10:35931778-35932020
  misc_feature 1..242: note = Hyper
  source 1..242: mol_type = genomic DNA

SEQ ID NO: 104569 - DNA, 30 bp, Homo sapiens; identical to SEQ ID NO: 71336
  misc_feature 1..30: note = chr10:35989914-35989944
  misc_feature 1..30: note = Hypo
  source 1..30: mol_type = genomic DNA

SEQ ID NO: 104570 - DNA, 30 bp, Homo sapiens; identical to SEQ ID NO: 71337
  misc_feature 1..30: note = chr10:36211085-36211115
  misc_feature 1..30: note = Hypo
  source 1..30: mol_type = genomic DNA

SEQ ID NO: 104571 - DNA, 301 bp, Homo sapiens; identical to SEQ ID NO: 71341
  misc_feature 1..301: note = chr10:37106743-37107044
  misc_feature 1..301: note = Hypo
  source 1..301: mol_type = genomic DNA

SEQ ID NO: 104572 - DNA, 94 bp, Homo sapiens; identical to SEQ ID NO: 71342
  misc_feature 1..94: note = chr10:37923450-37923544
  misc_feature 1..94: note = Hypo
  source 1..94: mol_type = genomic DNA

SEQ ID NO: 104573 - DNA, 94 bp, Homo sapiens; identical to SEQ ID NO: 71343
  misc_feature 1..94: note = chr10:37923604-37923698
  misc_feature 1..94: note = Hypo
  source 1..94: mol_type = genomic DNA

SEQ ID NO: 104574 - DNA, 35 bp, Homo sapiens; identical to SEQ ID NO: 71344
  misc_feature 1..35: note = chr10:38078895-38078930
  misc_feature 1..35: note = Hypo
  source 1..35: mol_type = genomic DNA

SEQ ID NO: 104575 - DNA, 23 bp, Homo sapiens
  misc_feature 1..23: note = chr10:38301640-38301663
  misc_feature 1..23: note = Hypo
  source 1..23: mol_type = genomic DNA
tgaggcaccgtgtctggccaaga

SEQ ID NO: 104576 - DNA, 249 bp, Homo sapiens; identical to SEQ ID NO: 71346
  misc_feature 1..249: note = chr10:38445833-38446082
  misc_feature 1..249: note = Hypo
  source 1..249: mol_type = genomic DNA

SEQ ID NO: 104577 - DNA, 30 bp, Homo sapiens; identical to SEQ ID NO: 71348
  misc_feature 1..30: note = chr10:38690543-38690573
  misc_feature 1..30: note = Hypo
  source 1..30: mol_type = genomic DNA

SEQ ID NO: 104578 - DNA, 54 bp, Homo sapiens; identical to SEQ ID NO: 71351
  misc_feature 1..54: note = chr10:42777495-42777549
  misc_feature 1..54: note = Hypo
  source 1..54: mol_type = genomic DNA

SEQ ID NO: 104579 - DNA, 19 bp, Homo sapiens
  misc_feature 1..19: note = chr10:42862078-42862097
  misc_feature 1..19: note = Hypo
  source 1..19: mol_type = genomic DNA
ttcctcactgcctctcgta

SEQ ID NO: 104580 - DNA, 59 bp, Homo sapiens; identical to SEQ ID NO: 71353
  misc_feature 1..59: note = chr10:43046988-43047047
  misc_feature 1..59: note = Hypo
  source 1..59: mol_type = genomic DNA

SEQ ID NO: 104581 - DNA, 30 bp, Homo sapiens; identical to SEQ ID NO: 71354
  misc_feature 1..30: note = chr10:43187000-43187030
  misc_feature 1..30: note = Hypo
  source 1..30: mol_type = genomic DNA

SEQ ID NO: 104582 - DNA, 2388 bp, Homo sapiens
  misc_feature 1..2388: note = chr10:43248537-43250925
  misc_feature 1..2388: note = Hyper
  source 1..2388: mol_type = genomic DNA
tggctgctccagcctcgaggccgcaggtcaccgcgcgggccccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcctcctcctccaggcggcgcttgtgagtcaatggaaaagtccttggcgaactgagcagccgcctagtatatctctgaagcctcctgcggagacttcacggcttgtcccaggagcttctacaacagcctggcattgagagtagagttgtaatattttccgccagtttttcccagcccggccccgaagcgtctgatcttaaagtccacgtatcagactccggggggcgtccctgcaagagcgccaggtccccgacacccaccagggaatgaatctgcgcccaggtccccgacacccgccagggaatgaatctccgtcccaggagaagggcgtggcgaggggagaagcaacaaccacaggacccgtgacagtggccaagccttagaggccccgcatgcctgccaggcgcccgagcccacgcagtccaggtttccccatccgggcgggaaccagctgtttcccctgcacgggcgagggcgctggggtcacctccgccgacgccaggcgtgagctccagaacccgctcccaaccgcccggtcccgtgagcgcggggagcctggctctcgcctgacaataaagaaatcatcacggacagaaggaaagaggagcgaggctgggaagggagcggctttaatccggggtccgcccccttcaattctccagcgcagcggccccgaaagtggggtggggacggggattgaggctgagctcgcttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatccgagtcccgccgccctccggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtcccaggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacccgggacatccaggtgggatcggccaccgctcaggcgctgtcccaggcgaacgccgccaggggcaggctcagcaccgcccaggccgccggctcggtgagcgcagagaggggcccccggtttatgccaaacgcgtgtcttctccaac

SEQ ID NO: 104583 - DNA, 36 bp, Homo sapiens; identical to SEQ ID NO: 42584
  misc_feature 1..36: note = chr10:43265217-43265253
  misc_feature 1..36: note = Hypo
  source 1..36: mol_type = genomic DNA

SEQ ID NO: 104584 - DNA, 30 bp, Homo sapiens; identical to SEQ ID NO: 71359
  misc_feature 1..30: note = chr10:43265495-43265525
  misc_feature 1..30: note = Hypo
  source 1..30: mol_type = genomic DNA

SEQ ID NO: 104585 - DNA, 30 bp, Homo sapiens; identical to SEQ ID NO: 71360
  misc_feature 1..30: note = chr10:43332265-43332295
  misc_feature 1..30: note = Hyper
  source 1..30: mol_type = genomic DNA

SEQ ID NO: 104586 - DNA, 252 bp, Homo sapiens
  misc_feature 1..252: note = chr10:43332534-43332786
  misc_feature 1..252: note = Hyper
  source 1..252: mol_type = genomic DNA
cagcgcggctccccacggcgtgcaggacccgggactgtcgcgccgcgcccggggacgcacaggaggtgggaccccggagcgaagcccctgcagcgtcccgggctggacgtggccctgcacccccggctgctgggcgggccggggcatgtacgagatcgcgcgctttacaaactgtcggtcgttctgggaaagttaaagaacgcgctgcagctacttcacctgctgctgaaaggagcccgggcagggctggtc

SEQ ID NO: 104587 - DNA, 178 bp, Homo sapiens; identical to SEQ ID NO: 71363
  misc_feature 1..178: note = chr10:43361545-43361723
  misc_feature 1..178: note = Hyper
  source 1..178: mol_type = genomic DNA

SEQ ID NO: 104588 - DNA, 350 bp, Homo sapiens; identical to SEQ ID NO: 71364
  misc_feature 1..350: note = chr10:43361980-43362330
  misc_feature 1..350: note = Hyper
  source 1..350: mol_type = genomic DNA

SEQ ID NO: 104589 - DNA, 30 bp, Homo sapiens; identical to SEQ ID NO: 71365
  misc_feature 1..30: note = chr10:43364192-43364222
  misc_feature 1..30: note = Hypo
  source 1..30: mol_type = genomic DNA

SEQ ID NO: 104590 - DNA, 385 bp, Homo sapiens
  misc_feature 1..385: note = chr10:43393461-43393846
  misc_feature 1..385: note = Hyper
  source 1..385: mol_type = genomic DNA
attttcacctttcatcgcaagggtcttcgcggcagaacgtggccgtccccacagccgtcgggggtttcgggttggatcccgcgttcgctccgctgcttggcctgcgcttcagcctctagcgacccagcgggggcgcgacttccgagccgcctccgcctcccgcctctaccgcggggccggggcgaccccaggtctgcacggccgaccgctgcgtccagagagatggggccgagcctccctgcggagcagaaccgtgggacggagggcggtgggctccgcagggagggggcgcagtccgggacagaccccagcacaggctccttccaccctcccgggacagctccgaaatcccagccctacgccggagctgcggtttgcaaagcgc

SEQ ID NO: 104591 - DNA, 264 bp, Homo sapiens
  misc_feature 1..264: note = chr10:43428369-43428633
  misc_feature 1..264: note = Hyper
  source 1..264: mol_type = genomic DNA
cctgctgaggaaagccggtgcctcctgctccccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgccgtgtccagatgtggctgggtcttggtgtccccgctgcgctcgtccctcctgccac

SEQ ID NO: 104592 - DNA, 544 bp, Homo sapiens
  misc_feature 1..544: note = chr10:43428894-43429438
  misc_feature 1..544: note = Hyper
  source 1..544: mol_type = genomic DNA
ggagggcaggatgcccgcccggggcggaagagccgagggcaggccctggggcggggcgctgggctatggagaccacgctcctccgcccagtcctgtctgtccgaagcgacgcggcagggcacaggcgtccgcagaacccgccaagcgcgggacgggcctctgctcctggctccgccggccttcccaggccccgggagccaggaaggtctgaatggagtgatgcgcctggacttttgttcggaaatcccgcgtggagggcggcctagcggggagaggctggaaacaggcgaggaggagcagggccgcggttgtacgggacaacgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcct

SEQ ID NO: 104593 - DNA, 30 bp, Homo sapiens; identical to SEQ ID NO: 71371
  misc_feature 1..30: note = chr10:43479981-43480011
  misc_feature 1..30: note = Hypo
  source 1..30: mol_type = genomic DNA

SEQ ID NO: 104594 - DNA, 1032 bp, Homo sapiens; identical to SEQ ID NO: 71372
  misc_feature 1..1032: note = chr10:43571966-43572998
  misc_feature 1..1032: note = Hyper
  source 1..1032: mol_type = genomic DNA

SEQ ID NO: 104595 - DNA, 52 bp, Homo sapiens; identical to SEQ ID NO: 71373
  misc_feature 1..52: note = chr10:43573249-43573301
  misc_feature 1..52: note = Hyper
  source 1..52: mol_type = genomic DNA

SEQ ID NO: 104596 - DNA, 47 bp, Homo sapiens; identical to SEQ ID NO: 71374
  misc_feature 1..47: note = chr10:43600276-43600323
  misc_feature 1..47: note = Hyper
  source 1..47: mol_type = genomic DNA

SEQ ID NO: 104597 - DNA, 97 bp, Homo sapiens
  misc_feature 1..97: note = chr10:43600534-43600631
  misc_feature 1..97: note = Hyper
  source 1..97: mol_type = genomic DNA
tgatggtgcccttcccggtgaccgtgtacgacgaggacgactcggcgcccaccttccccgcgggcgtcgacaccgccagcgccgtggtggagttcaa

SEQ ID NO: 104598 - DNA, 186 bp, Homo sapiens; identical to SEQ ID NO: 71376
  misc_feature 1..186: note = chr10:43615366-43615552
  misc_feature 1..186: note = Hypo
  source 1..186: mol_type = genomic DNA

SEQ ID NO: 104599 - DNA, 109 bp, Homo sapiens; identical to SEQ ID NO: 33035
  misc_feature 1..109: note = chr10:43697887-43697996
  misc_feature 1..109: note = Hyper
  source 1..109: mol_type = genomic DNA

SEQ ID NO: 104600 - DNA, 77 bp, Homo sapiens; identical to SEQ ID NO: 71378
  misc_feature 1..77: note = chr10:43698279-43698356
  misc_feature 1..77: note = Hyper
  source 1..77: mol_type = genomic DNA

SEQ ID NO: 104601 - DNA, 902 bp, Homo sapiens; identical to SEQ ID NO: 71379
  misc_feature 1..902: note = chr10:43724462-43725364
  misc_feature 1..902: note = Hyper
  source 1..902: mol_type = genomic DNA

SEQ ID NO: 104602 - DNA, 574 bp, Homo sapiens
  misc_feature 1..574: note = chr10:43762179-43762753
  misc_feature 1..574: note = Hyper
  source 1..574: mol_type = genomic DNA
gagggaccccgggcccgcgcacgccgcgccctgcccgcgccggcgaccggagggcacggccccaggcgcgggcgggggccccgaggcactgagggtccgcggccgctgcctacctcggtccgggccagcgtcgctcccgcgccgccctcgcgccgcagtcgggccccgagcagcgcgcggccggcgccggcggcggctcatgctcggcgcccgggcccgcggcacccgcccacccgcggccgcccccgcgctgcgccagctgcgggcagagcagctccctccgcagccggcgccggggagcgcgagcgagcgagcgaacgagcgagcgcggagcgagcgccgagcgggcacggagcgggcgcgagagcgcggggagcgggggagcgggcgggcgcgggacgcggagggaggagggtgcggggcaaaggtgcagggggaggtagggcgcgggacggggctcgagcagagggcactgggacagggcgggcgccgggagagggcggccaggctttcatttaaaaaggataaggcatcacgcctgtaatcccagcactttgggaggccgagacgggcg

SEQ ID NO: 104603 - DNA, 69 bp, Homo sapiens; identical to SEQ ID NO: 71382
  misc_feature 1..69: note = chr10:43778482-43778551
  misc_feature 1..69: note = Hyper
  source 1..69: mol_type = genomic DNA

SEQ ID NO: 104604 - DNA, 45 bp, Homo sapiens; identical to SEQ ID NO: 71383
  misc_feature 1..45: note = chr10:43800413-43800458
  misc_feature 1..45: note = Hyper
  source 1..45: mol_type = genomic DNA

SEQ ID NO: 104605 - DNA, 30 bp, Homo sapiens; identical to SEQ ID NO: 33040
  misc_feature 1..30: note = chr10:43818377-43818407
  misc_feature 1..30: note = Hyper
  source 1..30: mol_type = genomic DNA

SEQ ID NO: 104606 - DNA, 275 bp, Homo sapiens; identical to SEQ ID NO: 71385
  misc_feature 1..275: note = chr10:43857593-43857868
  misc_feature 1..275: note = Hyper
  source 1..275: mol_type = genomic DNA

SEQ ID NO: 104607 - DNA, 151 bp, Homo sapiens; identical to SEQ ID NO: 71386
  misc_feature 1..151: note = chr10:43858289-43858440
  misc_feature 1..151: note = Hypo
  source 1..151: mol_type = genomic DNA

SEQ ID NO: 104608 - DNA, 196 bp, Homo sapiens; identical to SEQ ID NO: 71387
  misc_feature 1..196: note = chr10:43892774-43892970
  misc_feature 1..196: note = Hyper
  source 1..196: mol_type = genomic DNA

SEQ ID NO: 104609 - DNA, 45 bp, Homo sapiens; identical to SEQ ID NO: 42587
  misc_feature 1..45: note = chr10:43905839-43905884
  misc_feature 1..45: note = Hypo
  source 1..45: mol_type = genomic DNA

SEQ ID NO: 104610 - DNA, 44 bp, Homo sapiens; identical to SEQ ID NO: 42588
  misc_feature 1..44: note = chr10:43906064-43906108
  misc_feature 1..44: note = Hypo
  source 1..44: mol_type = genomic DNA

SEQ ID NO: 104611 - DNA, 30 bp, Homo sapiens; identical to SEQ ID NO: 71390
  misc_feature 1..30: note = chr10:43915503-43915533
  misc_feature 1..30: note = Hypo
  source 1..30: mol_type = genomic DNA

SEQ ID NO: 104612 - DNA, 41 bp, Homo sapiens; identical to SEQ ID NO: 71391
  misc_feature 1..41: note = chr10:44069791-44069832
  misc_feature 1..41: note = Hyper
  source 1..41: mol_type = genomic DNA

SEQ ID NO: 104613 - DNA, 30 bp, Homo sapiens
  misc_feature 1..30: note = chr10:44185028-44185058
  misc_feature 1..30: note = Hyper
  source 1..30: mol_type = genomic DNA
gggggtgagggcgtgcgacacagcgtcaga

SEQ ID NO: 104614 - DNA, 703 bp, Homo sapiens; identical to SEQ ID NO: 33043
  misc_feature 1..703: note = chr10:44185340-44186043
  misc_feature 1..703: note = Hyper
  source 1..703: mol_type = genomic DNA

SEQ ID NO: 104615 - DNA, 156 bp, Homo sapiens; identical to SEQ ID NO: 71393
  misc_feature 1..156: note = chr10:44197833-44197989
  misc_feature 1..156: note = Hypo
  source 1..156: mol_type = genomic DNA

SEQ ID NO: 104616 - DNA, 30 bp, Homo sapiens; identical to SEQ ID NO: 42590
  misc_feature 1..30: note = chr10:44433895-44433925
  misc_feature 1..30: note = Hypo
  source 1..30: mol_type = genomic DNA

SEQ ID NO: 104617 - DNA, 30 bp, Homo sapiens; identical to SEQ ID NO: 71395
  misc_feature 1..30: note = chr10:44441910-44441940
  misc_feature 1..30: note = Hypo
  source 1..30: mol_type = genomic DNA

SEQ ID NO: 104618 - DNA, 595 bp, Homo sapiens; identical to SEQ ID NO: 71396
  misc_feature 1..595: note = chr10:44500784-44501379
  misc_feature 1..595: note = Hypo
  source 1..595: mol_type = genomic DNA

SEQ ID NO: 104619 - DNA, 220 bp, Homo sapiens; identical to SEQ ID NO: 71397
  misc_feature 1..220: note = chr10:44547194-44547414
  misc_feature 1..220: note = Hypo
  source 1..220: mol_type = genomic DNA

SEQ ID NO: 104620 - DNA, 38 bp, Homo sapiens; identical to SEQ ID NO: 42593
  misc_feature 1..38: note = chr10:44594208-44594246
  misc_feature 1..38: note = Hypo
  source 1..38: mol_type = genomic DNA

SEQ ID NO: 104621 - DNA, 30 bp, Homo sapiens; identical to SEQ ID NO: 33044
  misc_feature 1..30: note = chr10:44788550-44788580
  misc_feature 1..30: note = Hyper
  source 1..30: mol_type = genomic DNA

SEQ ID NO: 104622 - DNA, 315 bp, Homo sapiens; identical to SEQ ID NO: 71400
  misc_feature 1..315: note = chr10:44806359-44806674
  misc_feature 1..315: note = Hyper
  source 1..315: mol_type = genomic DNA

SEQ ID NO: 104623 - DNA, 34 bp, Homo sapiens; identical to SEQ ID NO: 42594
  misc_feature 1..34: note = chr10:44869035-44869069
  misc_feature 1..34: note = Hypo
  source 1..34: mol_type = genomic DNA

SEQ ID NO: 104624 - DNA, 245 bp, Homo sapiens; identical to SEQ ID NO: 71402
  misc_feature 1..245: note = chr10:44879151-44879396
  misc_feature 1..245: note = Hyper
  source 1..245: mol_type = genomic DNA

SEQ ID NO: 104625 - DNA, 1207 bp, Homo sapiens
  misc_feature 1..1207: note = chr10:44879823-44881030
  misc_feature 1..1207: note = Hyper
  source 1..1207: mol_type = genomic DNA
cctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggcggtgggaggcgcgcgccgggcgctttagaggggagagccaggcggggcggggcggggcgcgcggtgaggggcgggcccggagccgagtgctggccgtggccggggtctctgacgcgcgactccctcggcggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgct

SEQ ID NO: 104626 - DNA, 65 bp, Homo sapiens; identical to SEQ ID NO: 71407
  misc_feature 1..65: note = chr10:44882297-44882362
  misc_feature 1..65: note = Hyper
  source 1..65: mol_type = genomic DNA

SEQ ID NO: 104627 - DNA, 85 bp, Homo sapiens; identical to SEQ ID NO: 71408
  misc_feature 1..85: note = chr10:45374177-45374262
  misc_feature 1..85: note = Hyper
  source 1..85: mol_type = genomic DNA

SEQ ID NO: 104628 - DNA, 96 bp, Homo sapiens; identical to SEQ ID NO: 71409
  misc_feature 1..96: note = chr10:45565093-45565189
  misc_feature 1..96: note = Hypo
  source 1..96: mol_type = genomic DNA

SEQ ID NO: 104629 - DNA, 150 bp, Homo sapiens; identical to SEQ ID NO: 71410
  misc_feature 1..150: note = chr10:45568859-45569009
  misc_feature 1..150: note = Hypo
  source 1..150: mol_type = genomic DNA

SEQ ID NO: 104630 - DNA, 30 bp, Homo sapiens; identical to SEQ ID NO: 71412
  misc_feature 1..30: note = chr10:46009559-46009589
  misc_feature 1..30: note = Hypo
  source 1..30: mol_type = genomic DNA

SEQ ID NO: 104631 - DNA, 67 bp, Homo sapiens; identical to SEQ ID NO: 71413
  misc_feature 1..67: note = chr10:46009822-46009889
  misc_feature 1..67: note = Hypo
  source 1..67: mol_type = genomic DNA

SEQ ID NO: 104632 - DNA, 30 bp, Homo sapiens; identical to SEQ ID NO: 71414
  misc_feature 1..30: note = chr10:46092104-46092134
  misc_feature 1..30: note = Hypo
  source 1..30: mol_type = genomic DNA

SEQ ID NO: 104633 - DNA, 21 bp, Homo sapiens
  misc_feature 1..21: note = chr10:46098319-46098340
  misc_feature 1..21: note = Hypo
  source 1..21: mol_type = genomic DNA
acagagcgaggctccatctca

SEQ ID NO: 104634 - DNA, 28 bp, Homo sapiens
  misc_feature 1..28: note = chr10:46221028-46221056
  misc_feature 1..28: note = Hypo
  source 1..28: mol_type = genomic DNA
acaaacaaacaaacgacaacaaaaaaaa

SEQ ID NO: 104635 - DNA, 181 bp, Homo sapiens; identical to SEQ ID NO: 71420
  misc_feature 1..181: note = chr10:49393615-49393796
  misc_feature 1..181: note = Hypo
  source 1..181: mol_type = genomic DNA

SEQ ID NO: 104636 - DNA, 30 bp, Homo sapiens; identical to SEQ ID NO: 42598
  misc_feature 1..30: note = chr10:49541963-49541993
  misc_feature 1..30: note = Hypo
  source 1..30: mol_type = genomic DNA

SEQ ID NO: 104637 - DNA, 154 bp, Homo sapiens; identical to SEQ ID NO: 71422
  misc_feature 1..154: note = chr10:49652940-49653094
  misc_feature 1..154: note = Hypo
  source 1..154: mol_type = genomic DNA

SEQ ID NO: 104638 - DNA, 407 bp, Homo sapiens; identical to SEQ ID NO: 71423
  misc_feature 1..407: note = chr10:49731394-49731801
  misc_feature 1..407: note = Hyper
  source 1..407: mol_type = genomic DNA

SEQ ID NO: 104639 - DNA, 607 bp, Homo sapiens
  misc_feature 1..607: note = chr10:49732002-49732609
  misc_feature 1..607: note = Hyper
  source 1..607: mol_type = genomic DNA
cggccctggacaccccgtggcgagtccccgaggcggggctggcagcctctggcggcggccgcagggagcggggcgcacgtgcgcgccggagttacctttgggcgctcgcaggtgtcccctccagtccttgcagcagcacagccccatggcagccgcccgcggccccgccgctcggctcctctccccgcctgccgcctgcgccccggggcggcgcggccgaggtccggcccacgggcagtgcccagctgggcgcagggtgcgcgggaccgccggcccgcggctcccgggccctcacactccaccgcggccccgcgcagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgcctccctgggagccaagcaggggtggggggccacaccggcctggcctccccgcgcagaatgggaaga

SEQ ID NO: 104640 - DNA, 187 bp, Homo sapiens; identical to SEQ ID NO: 71427
  misc_feature 1..187: note = chr10:49857079-49857266
  misc_feature 1..187: note = Hypo
  source 1..187: mol_type = genomic DNA

SEQ ID NO: 104641 - DNA, 30 bp, Homo sapiens; identical to SEQ ID NO: 15370
  misc_feature 1..30: note = chr10:49929928-49929958
  misc_feature 1..30: note = Hypo
  source 1..30: mol_type = genomic DNA

SEQ ID NO: 104642 - DNA, 30 bp, Homo sapiens; identical to SEQ ID NO: 71429
  misc_feature 1..30: note = chr10:49939380-49939410
  misc_feature 1..30: note = Hypo
  source 1..30: mol_type = genomic DNA

SEQ ID NO: 104643 - DNA, 20 bp, Homo sapiens
  misc_feature 1..20: note = chr10:50007560-50007580
  misc_feature 1..20: note = Hypo
  source 1..20: mol_type = genomic DNA
gctgtaatcccagcacgaag

SEQ ID NO: 104644 - DNA, 34 bp, Homo sapiens; identical to SEQ ID NO: 71431
  misc_feature 1..34: note = chr10:50078993-50079027
  misc_feature 1..34: note = Hypo
  source 1..34: mol_type = genomic DNA

SEQ ID NO: 104645 - DNA, 30 bp, Homo sapiens; identical to SEQ ID NO: 71432
  misc_feature 1..30: note = chr10:50088696-50088726
  misc_feature 1..30: note = Hypo
  source 1..30: mol_type = genomic DNA

SEQ ID NO: 104646 - DNA, 30 bp, Homo sapiens; identical to SEQ ID NO: 42602
  misc_feature 1..30: note = chr10:50105263-50105293
  misc_feature 1..30: note = Hypo
  source 1..30: mol_type = genomic DNA

SEQ ID NO: 104647 - DNA, 30 bp, Homo sapiens; identical to SEQ ID NO: 71434
  misc_feature 1..30: note = chr10:50121842-50121872
  misc_feature 1..30: note = Hypo
  source 1..30: mol_type = genomic DNA

SEQ ID NO: 104648 - DNA, 30 bp, Homo sapiens; identical to SEQ ID NO: 71435
  misc_feature 1..30: note = chr10:50160854-50160884
  misc_feature 1..30: note = Hypo
  source 1..30: mol_type = genomic DNA

SEQ ID NO: 104649 - DNA, 30 bp, Homo sapiens; identical to SEQ ID NO: 71436
  misc_feature 1..30: note = chr10:50300840-50300870
  misc_feature 1..30: note = Hypo
  source 1..30: mol_type = genomic DNA

SEQ ID NO: 104650 - DNA, 591 bp, Homo sapiens
  misc_feature 1..591: note = chr10:50323255-50323846
  misc_feature 1..591: note = Hyper
  source 1..591: mol_type = genomic DNA
cgcgctcacgggaggcgtcctctgaaccttggggaggcgccgctgcgcccgccagaccctcggcgagcccaccggagcgcgctggcgacagtgacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcaccgggcgcgggagccgccgcgcgatcggttcgctccaggatctgtggcgtctcctttcaacagccccatttcccagatgagaaaactgagtttctgcaaggtgatcgctggtgactcacagaacacacagctgcagtgcgaccggcggtcctctgcccac

SEQ ID NO: 104651 - DNA, 30 bp, Homo sapiens; identical to SEQ ID NO: 71439
  misc_feature 1..30: note = chr10:50340253-50340283
  misc_feature 1..30: note = Hypo
  source 1..30: mol_type = genomic DNA

SEQ ID NO: 104652 - DNA, 108 bp, Homo sapiens; identical to SEQ ID NO: 71440
  misc_feature 1..108: note = chr10:50373584-50373692
  misc_feature 1..108: note = Hypo
  source 1..108: mol_type = genomic DNA

SEQ ID NO: 104653 - DNA, 30 bp, Homo sapiens; identical to SEQ ID NO: 71441
  misc_feature 1..30: note = chr10:50376617-50376647
  misc_feature 1..30: note = Hypo
  source 1..30: mol_type = genomic DNA

SEQ ID NO: 104654 - DNA, 41 bp, Homo sapiens; identical to SEQ ID NO: 71442
  misc_feature 1..41: note = chr10:50460235-50460276
  misc_feature 1..41: note = Hypo
  source 1..41: mol_type = genomic DNA

SEQ ID NO: 104655 - DNA, 302 bp, Homo sapiens; identical to SEQ ID NO: 71443
  misc_feature 1..302: note = chr10:50507426-50507728
  misc_feature 1..302: note = Hypo
  source 1..302: mol_type = genomic DNA

SEQ ID NO: 104656 - DNA, 420 bp, Homo sapiens; identical to SEQ ID NO: 71444
  misc_feature 1..420: note = chr10:50603003-50603423
  misc_feature 1..420: note = Hyper
  source 1..420: mol_type = genomic DNA

SEQ ID NO: 104657 - DNA, 1141 bp, Homo sapiens; identical to SEQ ID NO: 71445
  misc_feature 1..1141: note = chr10:50603748-50604889
  misc_feature 1..1141: note = Hyper
  source 1..1141: mol_type = genomic DNA

SEQ ID NO: 104658 - DNA, 1620 bp, Homo sapiens; identical to SEQ ID NO: 33059
  misc_feature 1..1620: note = chr10:50605142-50606762
  misc_feature 1..1620: note = Hyper
  source 1..1620: mol_type = genomic DNA

SEQ ID NO: 104659 - DNA, 85 bp, Homo sapiens; identical to SEQ ID NO: 71447
  misc_feature 1..85: note = chr10:50607131-50607216
  misc_feature 1..85: note = Hyper
  source 1..85: mol_type = genomic DNA

SEQ ID NO: 104660 - DNA, 86 bp, Homo sapiens; identical to SEQ ID NO: 71448
  misc_feature 1..86: note = chr10:50748356-50748442
  misc_feature 1..86: note = Hypo
  source 1..86: mol_type = genomic DNA

SEQ ID NO: 104661 - DNA, 277 bp, Homo sapiens; identical to SEQ ID NO: 71449
  misc_feature 1..277: note = chr10:50815067-50815344
  misc_feature 1..277: note = Hyper
  source 1..277: mol_type = genomic DNA

SEQ ID NO: 104662 - DNA, 2219 bp, Homo sapiens
  misc_feature 1..2219: note = chr10:50817061-50819280
  misc_feature 1..2219: note = Hyper
  source 1..2219: mol_type = genomic DNA
acctccaacctcagccgccctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggcaacttctgccctcagtccccacaagctcccggccgcgattcgcggccgagaaattctgcggaggggccggtgggtcagagccaggccaggcagttgctgagccttcccctcccctcctggcgggagtgtgtgtgcaaggggccagggggcggagtcggagaaagggttgggggtgtccgtgtccagcgctcctccggacgcggctccacaatccagctgcgagaacagatggacgcagcggcggctcacctcgggggcttcctgctcgctgtgcgccgaggtccaggctgaagcggagatcgcaagcctctggctcccgcctctcccaaggggcctcgaggaaccggctgccgcgcccccttccccaagaggagaagagcgggcgctgaccccgcgagtcctagaaccgcgggcggggggcaggcagggggcggggggcagagggccagctaccggcgcggaacgcccatcccaggggctggttcaagacttccacaccgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccgggacgctgggccatgagctccgcggccacctgaggcacaggggagtctgctcggccaggacagcctccccgaagtcccgtgccctcgcctctgcactgcgggacgccagcgctcggccctggcggaggcgtcctcggaagagcatcggggtgggggcatggaatccgcggaacctgcgggccaggcccgggcggcggccaccaagctgtcggaggctgtgggcgcggcgctgcaggagccccggcggcagaggcgcctggtgcttgttatcgtgtgcgtggcgctgttactggacaacatgctgtacatggtcatcgtgcccatagtgcccgactacatcgcccacatgcgcgggggcggcgagggccccacccggactcccgaggtgtgggagcccaccctgccgctgcccactccggccaatgccagcgcctacacggccaacacctcggcgtccccgacagctgcgtggccagcgggctcagcccttcggccccgctaccctacggagagcgaagacgtgaagatcggggtgctgtttgcttccaaggctatcctgcagctgctagtgaaccccttgagcgggcccttcatcgaccgcatgagctacgacgtgccgctgctgatcggcctgggcgtcatgttcgcctc

SEQ ID NO: 104663 - DNA, 461 bp, Homo sapiens
  misc_feature 1..461: note = chr10:50819484-50819945
  misc_feature 1..461: note = Hyper
  source 1..461: mol_type = genomic DNA
catcctctatgagttcgccggcaagcgcgtgcccttcttggtgctagctgccgtgtcgctctttgacgcgctgttgctgctggcagtggccaaacccttctcggcggctgcacgggctcgggccaacctgccagtgggcactcccatccaccgcctcatgctagacccctacattgccgtggtggccggcgcgctcaccacctgtaacattcccctcgccttcctcgaacccaccattgccacgtggatgaagcatacgatggcggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctccttcgcgccgctagtggtctcac

SEQ ID NO: 104664 - DNA, 422 bp, Homo sapiens; identical to SEQ ID NO: 71455
  misc_feature 1..422: note = chr10:50820239-50820661
  misc_feature 1..422: note = Hyper
  source 1..422: mol_type = genomic DNA

SEQ ID NO: 104665 - DNA, 197 bp, Homo sapiens; identical to SEQ ID NO: 71456
  misc_feature 1..197: note = chr10:50821052-50821249
  misc_feature 1..197: note = Hyper
  source 1..197: mol_type = genomic DNA

SEQ ID NO: 104666 - DNA, 229 bp, Homo sapiens; identical to SEQ ID NO: 33067
  misc_feature 1..229: note = chr10:50821472-50821701
  misc_feature 1..229: note = Hyper
  source 1..229: mol_type = genomic DNA

SEQ ID NO: 104667 - DNA, 750 bp, Homo sapiens; identical to SEQ ID NO: 71458
  misc_feature 1..750: note = chr10:50822142-50822892
  misc_feature 1..750: note = Hyper
  source 1..750: mol_type = genomic DNA

SEQ ID NO: 104668 - DNA, 380 bp, Homo sapiens
  misc_feature 1..380: note = chr10:50887456-50887836
  misc_feature 1..380: note = Hyper
  source 1..380: mol_type = genomic DNA
gattcaaccagataacgcagggaaaatgcttcgcacgccgcctgacacgaacttactgtgcctggctgctgctgttatttatcactaacacttgccacaccagctcaaacgcgcgtatttgcggaccaggcgctgagggtcacgtgagcagcttggggccgggaggatcccctagcgccaccccggccccgcccggcgcgtagcgacgcccacgcgcccgggccggaagagaggttgcttagcagcgtgtgtttctcccttgcctctgcggcggcggaggcctggcgatgcccaagaacgcagtggtcatcctgcgctatgggccctacagcgcggcaggcctaccggtggagcaccacaccttccgcctgcagggcctg

SEQ ID NO: 104669 - DNA, 30 bp, Homo sapiens; identical to SEQ ID NO: 71462
  misc_feature 1..30: note = chr10:50966548-50966578
  misc_feature 1..30: note = Hypo
  source 1..30: mol_type = genomic DNA

SEQ ID NO: 104670 - DNA, 516 bp, Homo sapiens; identical to SEQ ID NO: 33073
  misc_feature 1..516: note = chr10:50969896-50970412
  misc_feature 1..516: note = Hyper
  source 1..516: mol_type = genomic DNA

SEQ ID NO: 104671 - DNA, 161 bp, Homo sapiens; identical to SEQ ID NO: 71464
  misc_feature 1..161: note = chr10:50976356-50976517
  misc_feature 1..161: note = Hyper
  source 1..161: mol_type = genomic DNA

SEQ ID NO: 104672 - DNA, 357 bp, Homo sapiens
  misc_feature 1..357: note = chr10:50976747-50977104
  misc_feature 1..357: note = Hyper
  source 1..357: mol_type = genomic DNA
ccggcggtgtctgtccgagcgcagacagaagccgcgcgagggaacgcggggtcgtgtcctggggcggcggggaggggctgggagggcgggtgtgcaggggcctgggctgcccgccggctaggggcggccaccttggccggagatccgacgcgcggggactcccggtccgcgctcctccagcaggccggatccgcgcggcagtcctgggctccgctcctcatcctcctgccgcggccgcgccccgctggggaaggtgcgaggtgcggcggacgaggacgattcttgacgctgagcctgtgggccaggcccgcgcccaccacaggaatctctcccgggaaagcccggaaagatgccagc

SEQ ID NO: 104673 - DNA, 741 bp, Homo sapiens
  misc_feature 1..741: note = chr10:52177735-52178476
  misc_feature 1..741: note = Hyper
  source 1..741: mol_type = genomic DNA
aattggcactgattgcggtattttaatcggttcacaccgtctgttagtgtattctaatgaaccacagcatctccggagcaacacttacggtctctcgtccccggaggcagtgtctcctggaaagttcctggggcaccaagtttgcgcgcggctcctcgcgctcagggtgcgcgcagccagccctggcgcgggcggaaaggcgagcgcgctgagcggcgcgcagaccccgggcgcggctcttgctgggcgcccgcgccttgatcggtcccggcggtcccgttcccctgcttgccgggccctggtgctaggacagcggcgctgcggagcccggcgtctggagctggcgggcggccggatgcgccgatcctctcccggggggtcaactgcgagctagacgcccagccggacctcagaggctccaagagcggggttggcgggtgtggcccggcagcagagggtttttggaatgcagggtgtggccctctaccacggcaaaaaagaaatgagtcagcccgttcagtcctaaccaataagcatgttcagtgtcggttaaggcggaactttcctttcttgatttataccaagcttagaagcctttcacagccttttctttacgcctttgacaacttcgacacaacttctagaaaagggtaggttgcctttgaaaacgcttgggaaacaaggattaatcttacgaaagatacttcagtggatgtacattagtttcgattagtaaaagtt

SEQ ID NO: 104674 - DNA, 112 bp, Homo sapiens; identical to SEQ ID NO: 71469
  misc_feature 1..112: note = chr10:52419113-52419225
  misc_feature 1..112: note = Hypo
  source 1..112: mol_type = genomic DNA

SEQ ID NO: 104675 - DNA, 214 bp, Homo sapiens; identical to SEQ ID NO: 71471
  misc_feature 1..214: note = chr10:52750888-52751102
  misc_feature 1..214: note = Hyper
  source 1..214: mol_type = genomic DNA

SEQ ID NO: 104676 - DNA, 179 bp, Homo sapiens; identical to SEQ ID NO: 33079
  misc_feature 1..179: note = chr10:52751383-52751562
  misc_feature 1..179: note = Hyper
  source 1..179: mol_type = genomic DNA

SEQ ID NO: 104677 - DNA, 166 bp, Homo sapiens; identical to SEQ ID NO: 71473
  misc_feature 1..166: note = chr10:52751795-52751961
  misc_feature 1..166: note = Hyper
  source 1..166: mol_type = genomic DNA

SEQ ID NO: 104678 - DNA, 513 bp, Homo sapiens; identical to SEQ ID NO: 71474
  misc_feature 1..513: note = chr10:52833568-52834081
  misc_feature 1..513: note = Hyper
  source 1..513: mol_type = genomic DNA

SEQ ID NO: 104679 - DNA, 395 bp, Homo sapiens; identical to SEQ ID NO: 33083
  misc_feature 1..395: note = chr10:52834361-52834756
  misc_feature 1..395: note = Hyper
  source 1..395: mol_type = genomic DNA

SEQ ID NO: 104680 - DNA, 464 bp, Homo sapiens; identical to SEQ ID NO: 71476
  misc_feature 1..464: note = chr10:54068146-54068610
  misc_feature 1..464: note = Hyper
  source 1..464: mol_type = genomic DNA

SEQ ID NO: 104681 - DNA, 833 bp, Homo sapiens; identical to SEQ ID NO: 71477
  misc_feature 1..833: note = chr10:54072904-54073737
  misc_feature 1..833: note = Hyper
  source 1..833: mol_type = genomic DNA

SEQ ID NO: 104682 - DNA, 220 bp, Homo sapiens; identical to SEQ ID NO: 71478
  misc_feature 1..220: note = chr10:54074198-54074418
  misc_feature 1..220: note = Hyper
  source 1..220: mol_type = genomic DNA

SEQ ID NO: 104683 - DNA, 111 bp, Homo sapiens; identical to SEQ ID NO: 71479
  misc_feature 1..111: note = chr10:54074714-54074825
  misc_feature 1..111: note = Hyper
  source 1..111: mol_type = genomic DNA

SEQ ID NO: 104684 - DNA, 203 bp, Homo sapiens; identical to SEQ ID NO: 71480
  misc_feature 1..203: note = chr10:54700730-54700933
  misc_feature 1..203: note = Hypo
  source 1..203: mol_type = genomic DNA

SEQ ID NO: 104685 - DNA, 147 bp, Homo sapiens; identical to SEQ ID NO: 71481
  misc_feature 1..147: note = chr10:54716651-54716798
  misc_feature 1..147: note = Hypo
  source 1..147: mol_type = genomic DNA

SEQ ID NO: 104686 - DNA, 30 bp, Homo sapiens; identical to SEQ ID NO: 71496
  misc_feature 1..30: note = chr10:56782981-56783011
  misc_feature 1..30: note = Hypo
  source 1..30: mol_type = genomic DNA

SEQ ID NO: 104687 - DNA, 1116 bp, Homo sapiens; identical to SEQ ID NO: 71497
  misc_feature 1..1116: note = chr10:57387425-57388541
  misc_feature 1..1116: note = Hyper
  source 1..1116: mol_type = genomic DNA

SEQ ID NO: 104688 - DNA, 1016 bp, Homo sapiens
  misc_feature 1..1016: note = chr10:57389660-57390676
  misc_feature 1..1016: note = Hyper
  source 1..1016: mol_type = genomic DNA
cacttggtgtgtgtgcgctggcgcgtttatgttgggaaggttgatcactaagagagcttacaaatatctgtaggctctcctgtgtaacctccttctcttcctagccagggccattcaccggtaggctctcaggcgccacttctagagcatcctctgatgttggtcctgaactgggagagtctgaccaaacttgacgaagaggactgtcaaaaggcgttagaaacttcggaaactggcaacagttacggcatttttgctctgcgaagaatacgcccagaaggttcagaaagaagtcgggagtggggatggggagaaaaacattgaagggctatggaaaagcgtcaataacataaactgactttaatttttcttcatagaaatgtttccggtgaaattttctaagaaatcaggggacagttaatttgcttggttgacgctcacactccttgctctcactaagtctcaggtcttccaagcctagcactctgtcaaaatgctttcgggttgagggggagggctttcctggattccgcgaccacaacccaccaccccaaaccccacttcccatgtccttgatttttgaggctttttgggagggcatgatttcagggaacattactcttggccagctcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactct

SEQ ID NO: 104689 - DNA, 227 bp, Homo sapiens; identical to SEQ ID NO: 71501
  misc_feature 1..227: note = chr10:57391133-57391360
  misc_feature 1..227: note = Hyper
  source 1..227: mol_type = genomic DNA

SEQ ID NO: 104690 - DNA, 30 bp, Homo sapiens; identical to SEQ ID NO: 71502
  misc_feature 1..30: note = chr10:57478909-57478939
  misc_feature 1..30: note = Hypo
  source 1..30: mol_type = genomic DNA

SEQ ID NO: 104691 - DNA, 17 bp, Homo sapiens
  misc_feature 1..17: note = chr10:57918195-57918212
  misc_feature 1..17: note = Hypo
  source 1..17: mol_type = genomic DNA
atttgaatgtaaggccg

SEQ ID NO: 104692 - DNA, 30 bp, Homo sapiens; identical to SEQ ID NO: 71505
  misc_feature 1..30: note = chr10:58168698-58168728
  misc_feature 1..30: note = Hypo
  source 1..30: mol_type = genomic DNA

SEQ ID NO: 104693 - DNA, 109 bp, Homo sapiens; identical to SEQ ID NO: 33091
  misc_feature 1..109: note = chr10:60272038-60272147
  misc_feature 1..109: note = Hyper
  source 1..109: mol_type = genomic DNA

SEQ ID NO: 104694 - DNA, 758 bp, Homo sapiens
  misc_feature 1..758: note = chr10:60272555-60273313
  misc_feature 1..758: note = Hyper
  source 1..758: mol_type = genomic DNA
gcgcggctgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggccggcgagcggaggcggcagcgcaggcagagcggcggcggcagcgggagcccgagcgctgcgcgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgt

SEQ ID NO: 104695 - DNA, 30 bp, Homo sapiens; identical to SEQ ID NO: 71517
  misc_feature 1..30: note = chr10:60273557-60273587
  misc_feature 1..30: note = Hyper
  source 1..30: mol_type = genomic DNA

SEQ ID NO: 104696 - DNA, 170 bp, Homo sapiens; identical to SEQ ID NO: 71522
  misc_feature 1..170: note = chr10:60935826-60935996
  misc_feature 1..170: note = Hyper
  source 1..170: mol_type = genomic DNA

SEQ ID NO: 104697 - DNA, 794 bp, Homo sapiens
  misc_feature 1..794: note = chr10:60936309-60937103
  misc_feature 1..794: note = Hyper
  source 1..794: mol_type = genomic DNA
aagccctatacatcacgttccccgagagcagcgtcccctccccgccgggagcgcgcgcctcccatcctcgcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggccgggaccgcgaggaaagggacagagttcgcgccgaggcgccggggccactctggctccgccgacgccgctcgccagggcggcagggtcttttgttgtcccctctgtgcaaataaatgcagatgtgggttaccctccgcccaccgccctcccctcaccccagaaacaaaaggaccccggggctcgcgccttggcgcggaaagtagccgtccacaaccgtggcgcccttcgccgccttcgcccgcctggcccggacgagggcgacgttcccgctcgcggctcctgccccgacgaggcgtttccgatctttgccgcagtccggatttcctgggtctctgggcactgaaggggaaatgccctcgggatgtttctagc

SEQ ID NO: 104698 - DNA, 146 bp, Homo sapiens; identical to SEQ ID NO: 71526
  misc_feature 1..146: note = chr10:61122490-61122636
  misc_feature 1..146: note = Hyper
  source 1..146: mol_type = genomic DNA

SEQ ID NO: 104699 - DNA, 35 bp, Homo sapiens; identical to SEQ ID NO: 71528
  misc_feature 1..35: note = chr10:61468736-61468771
  misc_feature 1..35: note = Hyper
  source 1..35: mol_type = genomic DNA

SEQ ID NO: 104700 - DNA, 102 bp, Homo sapiens; identical to SEQ ID NO: 71529
  misc_feature 1..102: note = chr10:61469892-61469994
  misc_feature 1..102: note = Hyper
  source 1..102: mol_type = genomic DNA

SEQ ID NO: 104701 - DNA, 30 bp, Homo sapiens; identical to SEQ ID NO: 71532
  misc_feature 1..30: note = chr10:61658400-61658430
  misc_feature 1..30: note = Hypo
  source 1..30: mol_type = genomic DNA

SEQ ID NO: 104702 - DNA, 54 bp, Homo sapiens; identical to SEQ ID NO: 71536
  misc_feature 1..54: note = chr10:62493236-62493290
  misc_feature 1..54: note = Hyper
  source 1..54: mol_type = genomic DNA

SEQ ID NO: 104703 - DNA, 30 bp, Homo sapiens; identical to SEQ ID NO: 33098
  misc_feature 1..30: note = chr10:62702560-62702590
  misc_feature 1..30: note = Hyper
  source 1..30: mol_type = genomic DNA

SEQ ID NO: 104704 - DNA, 100 bp, Homo sapiens; identical to SEQ ID NO: 71539
  misc_feature 1..100: note = chr10:62704183-62704283
  misc_feature 1..100: note = Hyper
  source 1..100: mol_type = genomic DNA

SEQ ID NO: 104705 - DNA, 51 bp, Homo sapiens; identical to SEQ ID NO: 71540
  misc_feature 1..51: note = chr10:62761321-62761372
  misc_feature 1..51: note = Hyper
  source 1..51: mol_type = genomic DNA

SEQ ID NO: 104706 - DNA, 1185 bp, Homo sapiens; identical to SEQ ID NO: 71541
  misc_feature 1..1185: note = chr10:63212027-63213212
  misc_feature 1..1185: note = Hyper
  source 1..1185: mol_type = genomic DNA

SEQ ID NO: 104707 - DNA, 39 bp, Homo sapiens; identical to SEQ ID NO: 71542
  misc_feature 1..39: note = chr10:63656895-63656934
  misc_feature 1..39: note = Hyper
  source 1..39: mol_type = genomic DNA

SEQ ID NO: 104708 - DNA, 18 bp, Homo sapiens
  misc_feature 1..18: note = chr10:63795861-63795879
  misc_feature 1..18: note = Hypo
  source 1..18: mol_type = genomic DNA
gcgcgagccactgcacct

SEQ ID NO: 104709 - DNA, 538 bp, Homo sapiens; identical to SEQ ID NO: 71544
  misc_feature 1..538: note = chr10:64133867-64134405
  misc_feature 1..538: note = Hyper
  source 1..538: mol_type = genomic DNA

SEQ ID NO: 104710 - DNA, 1309 bp, Homo sapiens
  misc_feature 1..1309: note = chr10:64574553-64575862
  misc_feature 1..1309: note = Hyper
  source 1..1309: mol_type = genomic DNA
aaagcctcatccgcccggagcttttctccctcttttttgcctgggggttccacggctgaggcaccaagacaaacaccacccaagaatcgacctatcccagtcagtgccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccccgccttactaaccccctcaacttcgcgggcggcgggcaggtgggggcgcgcctccaggccgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggagacccaactccctcgctacctggagtgtcagaaaagccgttttggagagggg

SEQ ID NO: 104711 - DNA, 401 bp, Homo sapiens
  misc_feature 1..401: note = chr10:64578287-64578688
  misc_feature 1..401: note = Hyper
  source 1..401: mol_type = genomic DNA
gctgcgttcttaccacgtgcgccagcccactccgcctgcgctctggcgggtcccgcggcccccgcgctgaccatgggcaagacgacgcctcggaagggagtccgactcgcatctcgggccctgagtccgaaagaacgggggaaagccgaattatgcaaatgcggatccctgcgatggggctcgggttacggcccccgccggccccttaggtgaggcacccaccggcagcaagcgcgggcgaggcgactgctcgcgcttcgctcctctctgcgcacgtgggcggaccggcaggcgggcgagttgcccgggccgccccgcgactggcgctgctgccaaacccgccggcggtcgccgcgcgccaccccgagggggagctcctggacgcccgagtgcccggccag

SEQ ID NO: 104712 - DNA, 165 bp, Homo sapiens; identical to SEQ ID NO: 71550
  misc_feature 1..165: note = chr10:64812014-64812179
  misc_feature 1..165: note = Hypo
  source 1..165: mol_type = genomic DNA

SEQ ID NO: 104713 - DNA, 30 bp, Homo sapiens; identical to SEQ ID NO: 71562
  misc_feature 1..30: note = chr10:66600483-66600513
  misc_feature 1..30: note = Hypo
  source 1..30: mol_type = genomic DNA

SEQ ID NO: 104714 - DNA, 42 bp, Homo sapiens; identical to SEQ ID NO: 71570
  misc_feature 1..42: note = chr10:69283867-69283909
  misc_feature 1..42: note = Hypo
  source 1..42: mol_type = genomic DNA

SEQ ID NO: 104715 - DNA, 86 bp, Homo sapiens; identical to SEQ ID NO: 71571
  misc_feature 1..86: note = chr10:69310933-69311019
  misc_feature 1..86: note = Hypo
  source 1..86: mol_type = genomic DNA

SEQ ID NO: 104716 - DNA, 37 bp, Homo sapiens; identical to SEQ ID NO: 71572
  misc_feature 1..37: note = chr10:69521314-69521351
  misc_feature 1..37: note = Hypo
  source 1..37: mol_type = genomic DNA

SEQ ID NO: 104717 - DNA, 42 bp, Homo sapiens; identical to SEQ ID NO: 71573
  misc_feature 1..42: note = chr10:69571254-69571296
  misc_feature 1..42: note = Hypo
  source 1..42: mol_type = genomic DNA

SEQ ID NO: 104718 - DNA, 65 bp, Homo sapiens; identical to SEQ ID NO: 71574
  misc_feature 1..65: note = chr10:69578014-69578079
  misc_feature 1..65: note = Hypo
  source 1..65: mol_type = genomic DNA

SEQ ID NO: 104719 - DNA, 30 bp, Homo sapiens; identical to SEQ ID NO: 71577
  misc_feature 1..30: note = chr10:69896480-69896510
  misc_feature 1..30: note = Hypo
  source 1..30: mol_type = genomic DNA

SEQ ID NO: 104720 - DNA, 120 bp, Homo sapiens; identical to SEQ ID NO: 71579
  misc_feature 1..120: note = chr10:70288069-70288189
  misc_feature 1..120: note = Hypo
  source 1..120: mol_type = genomic DNA

SEQ ID NO: 104721 - DNA, 907 bp, Homo sapiens; identical to SEQ ID NO: 71580
  misc_feature 1..907: note = chr10:70320021-70320928
  misc_feature 1..907: note = Hyper
  source 1..907: mol_type = genomic DNA

SEQ ID NO: 104722 - DNA, 35 bp, Homo sapiens; identical to SEQ ID NO: 71581
  misc_feature 1..35: note = chr10:70377573-70377608
  misc_feature 1..35: note = Hypo
  source 1..35: mol_type = genomic DNA

SEQ ID NO: 104723 - DNA, 105 bp, Homo sapiens; identical to SEQ ID NO: 71582
  misc_feature 1..105: note = chr10:70476531-70476636
  misc_feature 1..105: note = Hypo
  source 1..105: mol_type = genomic DNA

SEQ ID NO: 104724 - DNA, 20 bp, Homo sapiens
  misc_feature 1..20: note = chr10:70482667-70482687
  misc_feature 1..20: note = Hypo
  source 1..20: mol_type = genomic DNA
tactccgtctcaaaaaaaca

SEQ ID NO: 104725 - DNA, 18 bp, Homo sapiens
  misc_feature 1..18: note = chr10:70483311-70483329
  misc_feature 1..18: note = Hypo
  source 1..18: mol_type = genomic DNA
taaaagtaaatgggccgg

SEQ ID NO: 104726 - DNA, 42 bp, Homo sapiens; identical to SEQ ID NO: 33108
  misc_feature 1..42: note = chr10:71267763-71267805
  misc_feature 1..42: note = Hyper
  source 1..42: mol_type = genomic DNA

SEQ ID NO: 104727 - DNA, 41 bp, Homo sapiens; identical to SEQ ID NO: 33109
  misc_feature 1..41: note = chr10:71327725-71327766
  misc_feature 1..41: note = Hyper
  source 1..41: mol_type = genomic DNA

SEQ ID NO: 104728 - DNA, 760 bp, Homo sapiens
  misc_feature 1..760: note = chr10:71328773-71329533
  misc_feature 1..760: note = Hyper
  source 1..760: mol_type = genomic DNA
gcattccaatggccccgggacgcttttgtcctccgactgaggccggctgggggtggggtgggatgggggcagggcaccataaatctacctgcttgtgtgccagcgcggcttgactggaaggaggagcaagattcatgtgcggtttttctggaagccagtcttgggctcagacaaaagcagaagaaggggggagagccattcgacgagagggtctttcctgcccgggtttcggacactgttggagtttcagggagcttgggcgcaggcggcgatctcaaagcgcagcaggctccgcagaagaggcgggctccgggcagagaccgctagcagcgcggtttaaaaagccccaggactcaaaacgccgcaagaagtggaaggcggggacggtggtgcagagctagttggacaggccacccctagaaatgtttccgagcccttcttgctcaggggttctttggaaagaggcatggacgaggtttcccactccagcgtgattccacacacttagacggagctcatccagcacggaaccctaaactttgcctccgtgattcaaagaaaccctaaaccctcctccgccttctcctgacttggagagtggggctgactgctccgggggtctaatccgccccaacccaaggtggcggcctagcagccgagttggttaacccgtacgtgtgtgttttaatttgtggggcggaggaccagtctgtgtgtgttgggtgactaatggctccttaatgagcgccctcaaaagcag

SEQ ID NO: 104729 - DNA, 1112 bp, Homo sapiens
  misc_feature 1..1112: note = chr10:71331434-71332546
  misc_feature 1..1112: note = Hyper
  source 1..1112: mol_type = genomic DNA
taaaaaaaaaagatgcgcggtgctccaggcacctgcagcgcagctcacgtttcaggcgcagttcgcagggaggctggggagatgctccctggccgggctagcgctttcccagttcacagcctggtcttccgccccgggagggcaatggctccgaaaagtgcacgaggagaaggcagagggtcgccttcgtggctttaaggcagagtgaggcgccctgaaatcccggacctgattgggagtagagcagatcggcagcgtctttggagcaaggcaaggggagtaagcgctgagagaccaaacattggattgaatcacattggaggaggggtggtaagagactgagaggcagacagacttgagtgagggtagggcgacccaagacggtgggcggctccggccgggtagtgctaccattctagtattctttgaatgagattatggggtggtggcagagaggaggcctaaaatgagcgcactttgcaatgcccacttcgcgcgggcagcagcaagggttgcgtgcgttggcgcggctcggagggccggggaatgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggtgagcttcgcgtcgtctgggaaggtgggcaggacaccgcgcagggcgtccagtgccgagttgaggttgtgcattcgattgcgctcgcggtcgttggccttctttc

SEQ ID NO: 104730 - DNA, 354 bp, Homo sapiens; identical to SEQ ID NO: 71592
  misc_feature 1..354: note = chr10:71332778-71333132
  misc_feature 1..354: note = Hyper
  source 1..354: mol_type = genomic DNA

SEQ ID NO: 104731 - DNA, 96 bp, Homo sapiens; identical to SEQ ID NO: 71593
  misc_feature 1..96: note = chr10:71334295-71334391
  misc_feature 1..96: note = Hyper
  source 1..96: mol_type = genomic DNA

SEQ ID NO: 104732 - DNA, 129 bp, Homo sapiens; identical to SEQ ID NO: 71594
  misc_feature 1..129: note = chr10:71334827-71334956
  misc_feature 1..129: note = Hyper
  source 1..129: mol_type = genomic DNA

SEQ ID NO: 104733 - DNA, 371 bp, Homo sapiens; identical to SEQ ID NO: 71595
  misc_feature 1..371: note = chr10:71336120-71336491
  misc_feature 1..371: note = Hyper
  source 1..371: mol_type = genomic DNA

SEQ ID NO: 104734 - DNA, 30 bp, Homo sapiens; identical to SEQ ID NO: 33118
  misc_feature 1..30: note = chr10:71337383-71337413
  misc_feature 1..30: note = Hyper
  source 1..30: mol_type = genomic DNA

SEQ ID NO: 104735 - DNA, 30 bp, Homo sapiens; identical to SEQ ID NO: 71597
  misc_feature 1..30: note = chr10:71337640-71337670
  misc_feature 1..30: note = Hyper
  source 1..30: mol_type = genomic DNA

SEQ ID NO: 104736 - DNA, 225 bp, Homo sapiens; identical to SEQ ID NO: 71598
  misc_feature 1..225: note = chr10:71338101-71338326
  misc_feature 1..225: note = Hyper
  source 1..225: mol_type = genomic DNA

SEQ ID NO: 104737 - DNA, 100 bp, Homo sapiens; identical to SEQ ID NO: 71599
  misc_feature 1..100: note = chr10:71338575-71338675
  misc_feature 1..100: note = Hyper
  source 1..100: mol_type = genomic DNA

SEQ ID NO: 104738 - DNA, 49 bp, Homo sapiens; identical to SEQ ID NO: 71600
  misc_feature 1..49: note = chr10:71390060-71390109
  misc_feature 1..49: note = Hyper
  source 1..49: mol_type = genomic DNA

SEQ ID NO: 104739 - DNA, 44 bp, Homo sapiens; identical to SEQ ID NO: 71602
  misc_feature 1..44: note = chr10:71561793-71561837
  misc_feature 1..44: note = Hyper
  source 1..44: mol_type = genomic DNA

SEQ ID NO: 104740 - DNA, 687 bp, Homo sapiens; identical to SEQ ID NO: 71603
  misc_feature 1..687: note = chr10:71562106-71562793
  misc_feature 1..687: note = Hyper
  source 1..687: mol_type = genomic DNA

SEQ ID NO: 104741 - DNA, 799 bp, Homo sapiens; identical to SEQ ID NO: 71606
  misc_feature 1..799: note = chr10:71813100-71813899
  misc_feature 1..799: note = Hyper
  source 1..799: mol_type = genomic DNA

SEQ ID NO: 104742 - DNA, 233 bp, Homo sapiens; identical to SEQ ID NO: 71607
  misc_feature 1..233: note = chr10:72015162-72015395
  misc_feature 1..233: note = Hyper
  source 1..233: mol_type = genomic DNA

SEQ ID NO: 104743 - DNA, 426 bp, Homo sapiens
  misc_feature 1..426: note = chr10:72043494-72043920
  misc_feature 1..426: note = Hyper
  source 1..426: mol_type = genomic DNA
cagcgggcagagggacggtctccgggcacttggttgcgggctgcgcccctgcctccgcgctccgcaggtccggtcggtccgggcagaggtgagcagggggcgtgcgctcccaggccccgggccctggccggtttccctcccctcgggctgactggctcccgcgcagcgctgctgcccgcagggctcagccgcccgccgcccctcgcctcccgaccaggggaaggagggggctcgtgaggcgcagtcgtcatggcacccgcgcacctgtgcccgccgagcgagggcgccccgggcccgcctcccgcatggcgctctctccacagagcccgagcgcccctccgaagtaggggacacacccctcctcccactgcagccctggcagcggcgtcccgtaattccccacctctctcccgtgcctcatatgcc

SEQ ID NO: 104744 - DNA, 1485 bp, Homo sapiens
  misc_feature 1..1485: note = chr10:72200018-72201503
  misc_feature 1..1485: note = Hyper
  source 1..1485: mol_type = genomic DNA
agtgaactggaaaagcgctccctcccttctttgccccctcccatccccggccgcttttcggttgaggggccgagcactccagcaaatttctcattgccccgcccccgagggtgtcccctggtctggctggtccccagatgacccttccggagagggtcaccggctgtctgaccccaggcgcgggagcgaagggcccccggcaccaggtcacaaggggcgggcaggcggcaggtcggatcagattagcgtttgtggattgcgccccggccccagggagggccgtctggcccccgcaggcggagggaggcgtgggcggccgcggctgcccaggcggcagaatgtggattgaggcgcggaaggggctccctctccgcagcacccacctgctcgccgcgctgggtgcccagaacgcgctgccaggtcctcgagggcgataccctcagatccctgccgtccttgacacccactcccctgcaaatcatggccccgaacccggggttaagcgagacacttgacacttccccggcgcggctggaggacccaaggctgccacagttcgcgacttcgggacagcccatccctgatctccgggccgtgagcccgaatccccgatgttaccagctcagctgccgatactcccgacgtcacaccccgggacccattcaccctcactcgcagaaagaaaaaaaaatcgccaagaccaaaccattacagtaataccaacgaccgttgactgtggctgtgccgggtactgcgctgagcgtttcgcgcgcattgtcatctcgcgctttccacagtctgataggcgaggtgttatttattacacctatcctacagatgcgcagacccaggctccgggataagcaacttcacaagactggagattagaagctcccacccttccgcgctgcgctccgcgcaatcccaaaccaaaacccagagacaatggtccccgtcgaggacacaccctgaacgctagaatcccttcccgactcggccgtggatacgcccccagccaccaacgctgcaccccgagcctgctgacgcggagacacccgcagagctaggccctgggctcgggacgcccgggcggctgcaaacccggctcggagccgcagcccccaacccacagcacttcccgagtccgctggctggacgcggcggaggcgccccgggggtgcccagcagggcgcggcacgcggcactgcctaccttctgcctgtaggctgcggatgatgtctgccctcggcagcgggtcgcggtagaggctcagcatgtacgccagaggggatggcgacgagggctgcccccgcgtacgcaggagcgcagtggccaccgtcgcagcacccgcctggagtagggcccaccaggcgtgcagaaggaagggcaggcagtgggcgtgcatggtgggctggccaggcctgaaagcagcacctccagcccttatatcctgggcctcagcagccgccccgcccccacctttcc

SEQ ID NO: 104745 - DNA, 150 bp, Homo sapiens; identical to SEQ ID NO: 71621
  misc_feature 1..150: note = chr10:72218318-72218468
  misc_feature 1..150: note = Hyper
  source 1..150: mol_type = genomic DNA

SEQ ID NO: 104746 - DNA, 274 bp, Homo sapiens; identical to SEQ ID NO: 71622
  misc_feature 1..274: note = chr10:72238584-72238858
  misc_feature 1..274: note = Hyper
  source 1..274: mol_type = genomic DNA

SEQ ID NO: 104747 - DNA, 30 bp, Homo sapiens; identical to SEQ ID NO: 71623
  misc_feature 1..30: note = chr10:72297836-72297866
  misc_feature 1..30: note = Hypo
  source 1..30: mol_type = genomic DNA

SEQ ID NO: 104748 - DNA, 748 bp, Homo sapiens
  misc_feature 1..748: note = chr10:72431955-72432703
  misc_feature 1..748: note = Hyper
  source 1..748: mol_type = genomic DNA
agagagcaggccctgcggccaagaaagggggcggagcagccatagaaagcggctttgggccaccactccggggatcccaggcgtctgaggggacaatcggtccgtgcgccaggaacccctgctctgtctccgcgtggcacttccgatccccggccgcaggcagctgcactccccagccgcgcgccccgcccccgggcgcccggcgccccagctccgacccgcgcccggccccgccccgcccagtgtgcccacccccggcccgtcccgccgccccgtcgcccggctcccgcggagtcccggagcgtcactgcgcgggcgggctgaccgaccagccggcagttggcaccgggtgcgctggcgcgtcagtggccccgctctccagccggcagcctcgcgcgcccggagccagcggtccaggcggcggcgccgcgcaggggacccggagcaggcgggagggaagcagctaggcggggaggcggctgaggcggcagcggcggcagccagccggtgctccgacagcccggggcgcaccctagcctcgccgccctcagcctgggacttggggatcgggcgcttgcccagcccgcgtcccagcgcggccacatggctccactccgcgcgctgctgtcctacctgctgcctttgcactgtgcgctctgcgccgccgcgggcagccggaccccaggtgcgtgcgggttgggcgcgcgggggcccgtggggtccggggtgcacgcggtcagggtggccc

SEQ ID NO: 104749 - DNA, 148 bp, Homo sapiens; identical to SEQ ID NO: 71630
  misc_feature 1..148: note = chr10:72470413-72470561
  misc_feature 1..148: note = Hypo
  source 1..148: mol_type = genomic DNA

SEQ ID NO: 104750 - DNA, 175 bp, Homo sapiens; identical to SEQ ID NO: 71631
  misc_feature 1..175: note = chr10:72489751-72489926
  misc_feature 1..175: note = Hypo
  source 1..175: mol_type = genomic DNA

SEQ ID NO: 104751 - DNA, 155 bp, Homo sapiens; identical to SEQ ID NO: 71634
  misc_feature 1..155: note = chr10:72675717-72675872
  misc_feature 1..155: note = Hypo
  source 1..155: mol_type = genomic DNA

SEQ ID NO: 104752 - DNA, 30 bp, Homo sapiens; identical to SEQ ID NO: 71636
  misc_feature 1..30: note = chr10:72785075-72785105
  misc_feature 1..30: note = Hypo
  source 1..30: mol_type = genomic DNA

SEQ ID NO: 104753 - DNA, 30 bp, Homo sapiens; identical to SEQ ID NO: 71637
  misc_feature 1..30: note = chr10:72799450-72799480
  misc_feature 1..30: note = Hypo
  source 1..30: mol_type = genomic DNA

SEQ ID NO: 104754 - DNA, 109 bp, Homo sapiens; identical to SEQ ID NO: 71641
  misc_feature 1..109: note = chr10:72972434-72972543
  misc_feature 1..109: note = Hyper
  source 1..109: mol_type = genomic DNA

SEQ ID NO: 104755 - DNA, 136 bp, Homo sapiens; identical to SEQ ID NO: 71642
  misc_feature 1..136: note = chr10:72972814-72972950
  misc_feature 1..136: note = Hyper
  source 1..136: mol_type = genomic DNA

SEQ ID NO: 104756 - DNA, 159 bp, Homo sapiens; identical to SEQ ID NO: 71643
  misc_feature 1..159: note = chr10:72973223-72973382
  misc_feature 1..159: note = Hyper
  source 1..159: mol_type = genomic DNA

SEQ ID NO: 104757 - DNA, 30 bp, Homo sapiens; identical to SEQ ID NO: 71644
  misc_feature 1..30: note = chr10:72977387-72977417
  misc_feature 1..30: note = Hyper
  source 1..30: mol_type = genomic DNA

SEQ ID NO: 104758 - DNA, 82 bp, Homo sapiens; identical to SEQ ID NO: 71645
  misc_feature 1..82: note = chr10:72977625-72977707
  misc_feature 1..82: note = Hyper
  source 1..82: mol_type = genomic DNA

SEQ ID NO: 104759 - DNA, 212 bp, Homo sapiens
  misc_feature 1..212: note = chr10:73156149-73156361
  misc_feature 1..212: note = Hyper
  source 1..212: mol_type = genomic DNA
aaagccaacagatggcgcgggctcacctaggccgagcgcccgctcgcccgcccgggcttcccgggagcgttacctcgctctgcctgaggcgcggggcggacgagacgctgggggccccatccccctgcgcgcccctctgcgggacggctggcggcctggcggggcactgctctgtctcgcacctggggcctcttccgcgggcttcctccctg

SEQ ID NO: 104760 - DNA, 1317 bp, Homo sapiens
  misc_feature 1..1317: note = chr10:73156640-73157957
  misc_feature 1..1317: note = Hyper
  source 1..1317: mol_type = genomic DNA
gggggccgagcggggcgggggaagcaagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccctggccctagcctcgcgccccgctccgagctccccgacgcgcggcaactttgattcctgggaactcgaattccattcgcgttggccttgggaggacaggcatcccatcccccatccccggtcctgggaccgcgaacatttgggggctttgctctcggcgctacggagagggtccaggtctggggtggagagattttcgagagtggagcgcgttgggatccaatcccctccccttctgagccctgggtccccatttggacagtggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggactctgcctggctttctcggagcgggcacctagagaggctgcctccgtgctgtgagcggagatccgatgccagccgccgccccactgcgacc

SEQ ID NO: 104761 - DNA, 137 bp, Homo sapiens; identical to SEQ ID NO: 71652
  misc_feature 1..137: note = chr10:73429932-73430069
  misc_feature 1..137: note = Hypo
  source 1..137: mol_type = genomic DNA

SEQ ID NO: 104762 - DNA, 123 bp, Homo sapiens; identical to SEQ ID NO: 71653
  misc_feature 1..123: note = chr10:73437184-73437307
  misc_feature 1..123: note = Hypo
  source 1..123: mol_type = genomic DNA

SEQ ID NO: 104763 - DNA, 350 bp, Homo sapiens; identical to SEQ ID NO: 71654
  misc_feature 1..350: note = chr10:73466313-73466663
  misc_feature 1..350: note = Hypo
  source 1..350: mol_type = genomic DNA

SEQ ID NO: 104764 - DNA, 43 bp, Homo sapiens; identical to SEQ ID NO: 71655
  misc_feature 1..43: note = chr10:73468779-73468822
  misc_feature 1..43: note = Hypo
  source 1..43: mol_type = genomic DNA

SEQ ID NO: 104765 - DNA, 30 bp, Homo sapiens; identical to SEQ ID NO: 71657
  misc_feature 1..30: note = chr10:73505195-73505225
  misc_feature 1..30: note = Hypo
  source 1..30: mol_type = genomic DNA

SEQ ID NO: 104766 - DNA, 30 bp, Homo sapiens; identical to SEQ ID NO: 42614
  misc_feature 1..30: note = chr10:73553133-73553163
  misc_feature 1..30: note = Hypo
  source 1..30: mol_type = genomic DNA

SEQ ID NO: 104767 - DNA, 119 bp, Homo sapiens; identical to SEQ ID NO: 71660
  misc_feature 1..119: note = chr10:73723643-73723762
  misc_feature 1..119: note = Hyper
  source 1..119: mol_type = genomic DNA

SEQ ID NO: 104768 - DNA, 514 bp, Homo sapiens; identical to SEQ ID NO: 71661
  misc_feature 1..514: note = chr10:73724102-73724616
  misc_feature 1..514: note = Hyper
  source 1..514: mol_type = genomic DNA

SEQ ID NO: 104769 - DNA, 30 bp, Homo sapiens; identical to SEQ ID NO: 71662
  misc_feature 1..30: note = chr10:73724940-73724970
  misc_feature 1..30: note = Hyper
  source 1..30: mol_type = genomic DNA

SEQ ID NO: 104770 - DNA, 374 bp, Homo sapiens
  misc_feature 1..374: note = chr10:73847007-73847381
  misc_feature 1..374: note = Hyper
  source 1..374: mol_type = genomic DNA
ctgatccacaggtgccggtaaacaaaagtgccgcagctacccccccgcccccaccccgcggagttcggcccaaggttacgccggggttcgggcggcgcccgccgggggcccccaaacccagcttctggactctccccggcttctcaagcccaccgggccgggagccttcctctggctccgagctgctcccctcgctccaggctggattcccccctgaaatgttggtccgggaaaaccagcctgggtcctcgcgcgcccttctgcacggggaccccagcccacccccgtacggacacgccttccaccatctcgcctagaaggctgctgggaccccagacccagagccccggtcacactcccgtcccatgctgtcc

SEQ ID NO: 104771 - DNA, 534 bp, Homo sapiens
  misc_feature 1..534: note = chr10:73847688-73848222
  misc_feature 1..534: note = Hyper
  source 1..534: mol_type = genomic DNA
ggggggtcccagggccgccggcccgggccgcagggacaggggaggggcgctgggctgtgacccccagtactgtttactttccgtgtaattagccggccaggctgcggagcctcgggctgcgacgtgcggcggccgctcccgcagaccccggagctcaatccccgaacccgcaaccccgggtctctgccttggcagccctgcggactcacgtctcggaagcggttccagtgcttgatcttgccgctgtactgcgagatggacgacagccattgctcgtcctccatgaaattgccgggggtctcgccctccttgagccccttggcgtcgccttcggccagggctgccgcggccaggagcagcagcggcagcaccagccgcccgcagcccggggcgcgcatcgtggtctgggttcgacctgggggggtcttgacttctgcagtattttaatgtccttcctcccaccccgctgctggcgaagcgcacgcggctgtcctcagctctcctcccgcggtctgcctccggtgactggcggag

SEQ ID NO: 104772 - DNA, 19 bp, Homo sapiens
  misc_feature 1..19: note = chr10:73975138-73975157
  misc_feature 1..19: note = Hypo
  source 1..19: mol_type = genomic DNA
agagcgagacttcgtctca

SEQ ID NO: 104773 - DNA, 43 bp, Homo sapiens; identical to SEQ ID NO: 71667
  misc_feature 1..43: note = chr10:73976883-73976926
  misc_feature 1..43: note = Hypo
  source 1..43: mol_type = genomic DNA

SEQ ID NO: 104774 - DNA, 30 bp, Homo sapiens; identical to SEQ ID NO: 71669
  misc_feature 1..30: note = chr10:74027842-74027872
  misc_feature 1..30: note = Hypo
  source 1..30: mol_type = genomic DNA

SEQ ID NO: 104775 - DNA, 36 bp, Homo sapiens; identical to SEQ ID NO: 71672
  misc_feature 1..36: note = chr10:74100577-74100613
  misc_feature 1..36: note = Hypo
  source 1..36: mol_type = genomic DNA

SEQ ID NO: 104776 - DNA, 148 bp, Homo sapiens; identical to SEQ ID NO: 71678
  misc_feature 1..148: note = chr10:74451157-74451305
  misc_feature 1..148: note = Hypo
  source 1..148: mol_type = genomic DNA

SEQ ID NO: 104777 - DNA, 23 bp, Homo sapiens
  misc_feature 1..23: note = chr10:75011146-75011169
  misc_feature 1..23: note = Hypo
  source 1..23: mol_type = genomic DNA
tctttgagatggaatcgccctct

SEQ ID NO: 104778 - DNA, 23 bp, Homo sapiens
  misc_feature 1..23: note = chr10:75011409-75011432
  misc_feature 1..23: note = Hypo
  source 1..23: mol_type = genomic DNA
attacaggcgtgagccaccgtgc

SEQ ID NO: 104779 - DNA, 32 bp, Homo sapiens; identical to SEQ ID NO: 71693
  misc_feature 1..32: note = chr10:75118507-75118539
  misc_feature 1..32: note = Hyper
  source 1..32: mol_type = genomic DNA

SEQ ID NO: 104780 - DNA, 153 bp, Homo sapiens; identical to SEQ ID NO: 71694
  misc_feature 1..153: note = chr10:75384262-75384415
  misc_feature 1..153: note = Hypo
  source 1..153: mol_type = genomic DNA

SEQ ID NO: 104781 - DNA, 288 bp, Homo sapiens
  misc_feature 1..288: note = chr10:75407398-75407686
  misc_feature 1..288: note = Hyper
  source 1..288: mol_type = genomic DNA
cagattctgcacccccggcccgaggcttttcatccaggttctgtaccagcgatagcagctcggggttgggcgagttcttcgtctcctcctttcccggccggaacatctgcttccgggtcccccggcgccgggcctcctgcaggatacccgtgcgggcagctggcacagagatgcgctgctcgcgagcgctggggggctcaggagcccctgggcctggggcaggcgcctctgggcgcgcagagggtcgcaaaggcgcagataggaagatagaagcggtggaggtcatgg

SEQ ID NO: 104782 - DNA, 22 bp, Homo sapiens
  misc_feature 1..22: note = chr10:75488953-75488975
  misc_feature 1..22: note = Hypo
  source 1..22: mol_type = genomic DNA
gcaatatctagaggccgggcac

SEQ ID NO: 104783 - DNA, 84 bp, Homo sapiens; identical to SEQ ID NO: 42616
  misc_feature 1..84: note = chr10:75501525-75501609
  misc_feature 1..84: note = Hypo
  source 1..84: mol_type = genomic DNA

SEQ ID NO: 104784 - DNA, 37 bp, Homo sapiens; identical to SEQ ID NO: 71700
  misc_feature 1..37: note = chr10:75633031-75633068
  misc_feature 1..37: note = Hypo
  source 1..37: mol_type = genomic DNA

SEQ ID NO: 104785 - DNA, 30 bp, Homo sapiens; identical to SEQ ID NO: 71701
  misc_feature 1..30: note = chr10:75670725-75670755
  misc_feature 1..30: note = Hyper
  source 1..30: mol_type = genomic DNA

SEQ ID NO: 104786 - DNA, 78 bp, Homo sapiens; identical to SEQ ID NO: 71702
  misc_feature 1..78: note = chr10:75808858-75808936
  misc_feature 1..78: note = Hypo
  source 1..78: mol_type = genomic DNA

SEQ ID NO: 104787 - DNA, 224 bp, Homo sapiens; identical to SEQ ID NO: 71703
  misc_feature 1..224: note = chr10:75832369-75832593
  misc_feature 1..224: note = Hypo
  source 1..224: mol_type = genomic DNA

SEQ ID NO: 104788 - DNA, 30 bp, Homo sapiens; identical to SEQ ID NO: 71704
  misc_feature 1..30: note = chr10:75966942-75966972
  misc_feature 1..30: note = Hypo
  source 1..30: mol_type = genomic DNA

SEQ ID NO: 104789 - DNA, 30 bp, Homo sapiens; identical to SEQ ID NO: 71707
  misc_feature 1..30: note = chr10:76511158-76511188
  misc_feature 1..30: note = Hypo
  source 1..30: mol_type = genomic DNA

SEQ ID NO: 104790 - DNA, 36 bp, Homo sapiens; identical to SEQ ID NO: 42617
  misc_feature 1..36: note = chr10:76784730-76784766
  misc_feature 1..36: note = Hypo
  source 1..36: mol_type = genomic DNA

SEQ ID NO: 104791 - DNA, 33 bp, Homo sapiens; identical to SEQ ID NO: 33144
  misc_feature 1..33: note = chr10:76803629-76803662
  misc_feature 1..33: note = Hyper
  source 1..33: mol_type = genomic DNA

SEQ ID NO: 104792 - DNA, 23 bp, Homo sapiens
  misc_feature 1..23: note = chr10:76997760-76997783
  misc_feature 1..23: note = Hypo
  source 1..23: mol_type = genomic DNA
accgcacccggccaagaatccat

SEQ ID NO: 104793 - DNA, 248 bp, Homo sapiens
  misc_feature 1..248: note = chr10:77022081-77022329
  misc_feature 1..248: note = Hypo
  source 1..248: mol_type = genomic DNA
gggggtattttgtcccgcacataggagaaacaaaaactcactctatttgggaacagggtaattgaatacagatgggaggaggtaaatgaaagaatttagcaaatatctcagtggaatagctaatgggaatgagacagaataggaaattaaaaattattcgaagcagatggaccattctttgagtttttaaaaatttattagggccgcgagaaaatgtgtctgtttattttctgcggccatgaaattaa

SEQ ID NO: 104794 - DNA, 90 bp, Homo sapiens; identical to SEQ ID NO: 71719
  misc_feature 1..90: note = chr10:77159927-77160017
  misc_feature 1..90: note = Hyper
  source 1..90: mol_type = genomic DNA

SEQ ID NO: 104795 - DNA, 374 bp, Homo sapiens; identical to SEQ ID NO: 71720
  misc_feature 1..374: note = chr10:77161032-77161406
  misc_feature 1..374: note = Hyper
  source 1..374: mol_type = genomic DNA

SEQ ID NO: 104796 - DNA, 68 bp, Homo sapiens; identical to SEQ ID NO: 71721
  misc_feature 1..68: note = chr10:77161623-77161691
  misc_feature 1..68: note = Hyper
  source 1..68: mol_type = genomic DNA

SEQ ID NO: 104797 - DNA, 632 bp, Homo sapiens; identical to SEQ ID NO: 71722
  misc_feature 1..632: note = chr10:77162706-77163338
  misc_feature 1..632: note = Hyper
  source 1..632: mol_type = genomic DNA

SEQ ID NO: 104798 - DNA, 64 bp, Homo sapiens; identical to SEQ ID NO: 71723
  misc_feature 1..64: note = chr10:77163662-77163726
  misc_feature 1..64: note = Hyper
  source 1..64: mol_type = genomic DNA

SEQ ID NO: 104799 - DNA, 123 bp, Homo sapiens; identical to SEQ ID NO: 71724
  misc_feature 1..123: note = chr10:77169095-77169218
  misc_feature 1..123: note = Hyper
  source 1..123: mol_type = genomic DNA

SEQ ID NO: 104800 - DNA, 520 bp, Homo sapiens; identical to SEQ ID NO: 33148
  misc_feature 1..520: note = chr10:77191185-77191705
  misc_feature 1..520: note = Hyper
  source 1..520: mol_type = genomic DNA

SEQ ID NO: 104801 - DNA, 30 bp, Homo sapiens; identical to SEQ ID NO: 71729
  misc_feature 1..30: note = chr10:77892448-77892478
  misc_feature 1..30: note = Hypo
  source 1..30: mol_type = genomic DNA

SEQ ID NO: 104802 - DNA, 187 bp, Homo sapiens; identical to SEQ ID NO: 42620
  misc_feature 1..187: note = chr10:77893300-77893487
  misc_feature 1..187: note = Hypo
  source 1..187: mol_type = genomic DNA

SEQ ID NO: 104803 - DNA, 16 bp, Homo sapiens
  misc_feature 1..16: note = chr10:78601007-78601023
  misc_feature 1..16: note = Hypo
  source 1..16: mol_type = genomic DNA
ccgccgatgtacatct

SEQ ID NO: 104804 - DNA, 2025 bp, Homo sapiens; identical to SEQ ID NO: 71732
  misc_feature 1..2025: note = chr10:79396631-79398656
  misc_feature 1..2025: note = Hyper
  source 1..2025: mol_type = genomic DNA

SEQ ID NO: 104805 - DNA, 146 bp, Homo sapiens; identical to SEQ ID NO: 33151
  misc_feature 1..146: note = chr10:79470925-79471071
  misc_feature 1..146: note = Hyper
  source 1..146: mol_type = genomic DNA

SEQ ID NO: 104806 - DNA, 178 bp, Homo sapiens; identical to SEQ ID NO: 71734
  misc_feature 1..178: note = chr10:79491986-79492164
  misc_feature 1..178: note = Hypo
  source 1..178: mol_type = genomic DNA

SEQ ID NO: 104807 - DNA, 30 bp, Homo sapiens; identical to SEQ ID NO: 71735
  misc_feature 1..30: note = chr10:79661214-79661244
  misc_feature 1..30: note = Hypo
  source 1..30: mol_type = genomic DNA

SEQ ID NO: 104808 - DNA, 30 bp, Homo sapiens
  misc_feature 1..30: note = chr10:79937079-79937109
  misc_feature 1..30: note = Hypo
  source 1..30: mol_type = genomic DNA
ttgggctgcttttgacgggggccaccagcc

SEQ ID NO: 104809 - DNA, 197 bp, Homo sapiens; identical to SEQ ID NO: 71739
  misc_feature 1..197: note = chr10:80683494-80683691
  misc_feature 1..197: note = Hypo
  source 1..197: mol_type = genomic DNA

SEQ ID NO: 104810 - DNA, 99 bp, Homo sapiens; identical to SEQ ID NO: 71752
  misc_feature 1..99: note = chr10:80909885-80909984
  misc_feature 1..99: note = Hyper
  source 1..99: mol_type = genomic DNA

SEQ ID NO: 104811 - DNA, 40 bp, Homo sapiens; identical to SEQ ID NO: 71762
  misc_feature 1..40: note = chr10:81024063-81024103
  misc_feature 1..40: note = Hypo
  source 1..40: mol_type = genomic DNA

SEQ ID NO: 104812 - DNA, 30 bp, Homo sapiens; identical to SEQ ID NO: 71763
  misc_feature 1..30: note = chr10:81037768-81037798
  misc_feature 1..30: note = Hypo
  source 1..30: mol_type = genomic DNA

SEQ ID NO: 104813 - DNA, 139 bp, Homo sapiens; identical to SEQ ID NO: 71764
  misc_feature 1..139: note = chr10:81070800-81070939
  misc_feature 1..139: note = Hypo
  source 1..139: mol_type = genomic DNA

SEQ ID NO: 104814 - DNA, 51 bp, Homo sapiens; identical to SEQ ID NO: 71765
  misc_feature 1..51: note = chr10:81206300-81206351
  misc_feature 1..51: note = Hyper
  source 1..51: mol_type = genomic DNA

SEQ ID NO: 104815 - DNA, 30 bp, Homo sapiens; identical to SEQ ID NO: 71766
  misc_feature 1..30: note = chr10:81206959-81206989
  misc_feature 1..30: note = Hypo
  source 1..30: mol_type = genomic DNA

SEQ ID NO: 104816 - DNA, 636 bp, Homo sapiens; identical to SEQ ID NO: 71767
  misc_feature 1..636: note = chr10:81664437-81665073
  misc_feature 1..636: note = Hyper
  source 1..636: mol_type = genomic DNA

SEQ ID NO: 104817 - DNA, 565 bp, Homo sapiens; identical to SEQ ID NO: 71768
  misc_feature 1..565: note = chr10:81741366-81741931
  misc_feature 1..565: note = Hyper
  source 1..565: mol_type = genomic DNA

SEQ ID NO: 104818 - DNA, 409 bp, Homo sapiens; identical to SEQ ID NO: 71769
  misc_feature 1..409: note = chr10:81892268-81892677
  misc_feature 1..409: note = Hyper
  source 1..409: mol_type = genomic DNA

SEQ ID NO: 104819 - DNA, 172 bp, Homo sapiens; identical to SEQ ID NO: 71770
  misc_feature 1..172: note = chr10:81921303-81921475
  misc_feature 1..172: note = Hypo
  source 1..172: mol_type = genomic DNA

SEQ ID NO: 104820 - DNA, 123 bp, Homo sapiens; identical to SEQ ID NO: 71771
  misc_feature 1..123: note = chr10:81930494-81930617
  misc_feature 1..123: note = Hypo
  source 1..123: mol_type = genomic DNA

SEQ ID NO: 104821 - DNA, 25 bp, Homo sapiens
  misc_feature 1..25: note = chr10:81966571-81966596
  misc_feature 1..25: note = Hypo
  source 1..25: mol_type = genomic DNA
aacaagctgctggttcgattttcct

SEQ ID NO: 104822 - DNA, 626 bp, Homo sapiens; identical to SEQ ID NO: 71774
  misc_feature 1..626: note = chr10:82116580-82117206
  misc_feature 1..626: note = Hyper
  source 1..626: mol_type = genomic DNA

SEQ ID NO: 104823 - DNA, 60 bp, Homo sapiens; identical to SEQ ID NO: 71776
  misc_feature 1..60: note = chr10:82168049-82168109
  misc_feature 1..60: note = Hyper
  source 1..60: mol_type = genomic DNA

SEQ ID NO: 104824 - DNA, 239 bp, Homo sapiens; identical to SEQ ID NO: 71777
  misc_feature 1..239: note = chr10:82168477-82168716
  misc_feature 1..239: note = Hyper
  source 1..239: mol_type = genomic DNA

SEQ ID NO: 104825 - DNA, 50 bp, Homo sapiens; identical to SEQ ID NO: 71778
  misc_feature 1..50: note = chr10:82383742-82383792
  misc_feature 1..50: note = Hypo
  source 1..50: mol_type = genomic DNA

SEQ ID NO: 104826 - DNA, 37 bp, Homo sapiens; identical to SEQ ID NO: 71779
  misc_feature 1..37: note = chr10:82573954-82573991
  misc_feature 1..37: note = Hypo
  source 1..37: mol_type = genomic DNA

SEQ ID NO: 104827 - DNA, 30 bp, Homo sapiens; identical to SEQ ID NO: 42625
  misc_feature 1..30: note = chr10:82607464-82607494
  misc_feature 1..30: note = Hypo
  source 1..30: mol_type = genomic DNA

SEQ ID NO: 104828 - DNA, 510 bp, Homo sapiens; identical to SEQ ID NO: 71784
  misc_feature 1..510: note = chr10:83633649-83634159
  misc_feature 1..510: note = Hyper
  source 1..510: mol_type = genomic DNA

SEQ ID NO: 104829 - DNA, 900 bp, Homo sapiens
  misc_feature 1..900: note = chr10:83634918-83635818
  misc_feature 1..900: note = Hyper
  source 1..900: mol_type = genomic DNA
tctcggggggaggggcgtgggggcagggagcggatttgcatgcggccgccgcggccgctgcctgcgcccgagcccgccgccgccgccggagcccgcgcccgcgcccgcgcccggcccgcgcggccccatgcctctgccgcggccctcgggggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctc

SEQ ID NO: 104830 - DNA, 155 bp, Homo sapiens
  misc_feature 1..155: note = chr10:83636233-83636388
  misc_feature 1..155: note = Hyper
  source 1..155: mol_type = genomic DNA
ctgcagacctgctggcgagctgccggatcccgctccagtagagggccagggagggagagagggccttcccgaaggcactgagccccttctccgcccgccggtaggaaggaaagaaagcaaagcacatgcaaattgaccgacgataaaccacaaaa

SEQ ID NO: 104831 - DNA, 76 bp, Homo sapiens; identical to SEQ ID NO: 71794
  misc_feature 1..76: note = chr10:85949225-85949301
  misc_feature 1..76: note = Hypo
  source 1..76: mol_type = genomic DNA

SEQ ID NO: 104832 - DNA, 816 bp, Homo sapiens; identical to SEQ ID NO: 71795
  misc_feature 1..816: note = chr10:85954289-85955105
  misc_feature 1..816: note = Hyper
  source 1..816: mol_type = genomic DNA

SEQ ID NO: 104833 - DNA, 73 bp, Homo sapiens; identical to SEQ ID NO: 71796
  misc_feature 1..73: note = chr10:86304014-86304087
  misc_feature 1..73: note = Hypo
  source 1..73: mol_type = genomic DNA

SEQ ID NO: 104834 - DNA, 82 bp, Homo sapiens; identical to SEQ ID NO: 71797
  misc_feature 1..82: note = chr10:87967280-87967362
  misc_feature 1..82: note = Hypo
  source 1..82: mol_type = genomic DNA

SEQ ID NO: 104835 - DNA, 190 bp, Homo sapiens; identical to SEQ ID NO: 71798
  misc_feature 1..190: note = chr10:88055214-88055404
  misc_feature 1..190: note = Hypo
  source 1..190: mol_type = genomic DNA

SEQ ID NO: 104836 - DNA, 68 bp, Homo sapiens
  misc_feature 1..68: note = chr10:88123140-88123208
  misc_feature 1..68: note = Hyper
  source 1..68: mol_type = genomic DNA
aacctggtggaggagcgctgcagagaagcgccgggctgaggctctgggggccgcggggcgcgaaacgc

SEQ ID NO: 104837 - DNA, 144 bp, Homo sapiens; identical to SEQ ID NO: 71799
  misc_feature 1..144: note = chr10:88124485-88124629
  misc_feature 1..144: note = Hyper
  source 1..144: mol_type = genomic DNA

SEQ ID NO: 104838 - DNA, 2188 bp, Homo sapiens
  misc_feature 1..2188: note = chr10:88125208-88127396
  misc_feature 1..2188: note = Hyper
  source 1..2188: mol_type = genomic DNA
cccactccccctcggcgcgccccctcctcctctgcgctttcatcttctctcccggttctctctctctatccatctcttcccgctcagcatccccctaccccccgctgcccacgcttcttccctcggctcccaccacccagaccgtctgggcccccaagacttggaccacgcaaaactctaggactgtccaggatggggatgcagtcgccacaaccagatacacacgcactcacacatacaccaagggctacacagacacacaccggagaagcaggcagacactgtgtccactctaacaggctgacagacagtcgtgcacgcaccaacacacgctcagatggccccacacaccccaacaccctctcacagtaacaccgacaccgtgccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcactggcatatccaggggagaagccacagcgtcagcgcttccatgtcccccgggcgcgcggctcatccacccgggcccggggcgaggccgagggcagcgcgaagcggggaggcgctggtcccggtgcagtcccgggccgctccccgggagagccgagcccgcccgtgcgtcttcccccgcgcgcccgcccctgcgccctgcgcccgccccagcccagcccagcccagcccagcgcggtcgggctcccgctccggctccggtggcggctgcggcggtgctggcagcttgagcccaggccggcgcggcgggggcggcccgcggctgtggcagcggcgcttcccgcggctagagcggcttcgggggaggctgaggcggtggcggcggcggccgggccggcgtggcggctctgggctggctgtgtgtctgagccccggcgaggagcgaactgcggaggacgccccctcccctccccctccccctcagctccgctccccctcccctccctgcccgcctccctcccctccgcccgcctctctaccacgtgactgcggagcctcagcctcgccgcgcggctctcgcccgctcgcggctcggagggggcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggccgctaactgccctcgaggggctcccgaagcgccctggcgacctcagcagccgcgcgtctcgggtcatgtccccggccgaaacagaccgttcctcgtggagtgggacctggggagcaagaagagagaccggggcggggcgccgggccaggccccaggacagctggggagccagagggggccggccgccgcaagcatctcagagtagagcccgggccgtgggctcgaaccctggctggccgcgcggacctcggcgggcgcccatcccccgctccatgggcagcgcgctcagccgggagtcgggcaagaggctcggactctgaagcccaattcatggccggaaaccagcgcagccgtgaccgcggcgcctggacgtgaggagccttccaagcggccggcgggctcagactccgaccctgcacggagctttcatgtgcgagcccgggcgaagagcccgctcctcgcggccacagcggaacagggctccctccgcctccggtgcctgcctcgggccggccaccaccaaagagagcgttaagctgttgtg

SEQ ID NO: 104839 - DNA, 359 bp, Homo sapiens; identical to SEQ ID NO: 71803
  misc_feature 1..359: note = chr10:88149287-88149646
  misc_feature 1..359: note = Hyper
  source 1..359: mol_type = genomic DNA

SEQ ID NO: 104840 - DNA, 32 bp, Homo sapiens; identical to SEQ ID NO: 71804
  misc_feature 1..32: note = chr10:88280081-88280113
  misc_feature 1..32: note = Hypo
  source 1..32: mol_type = genomic DNA

SEQ ID NO: 104841 - DNA, 30 bp, Homo sapiens; identical to SEQ ID NO: 71805
  misc_feature 1..30: note = chr10:88282807-88282837
  misc_feature 1..30: note = Hypo
  source 1..30: mol_type = genomic DNA

SEQ ID NO: 104842 - DNA, 457 bp, Homo sapiens; identical to SEQ ID NO: 71806
  misc_feature 1..457: note = chr10:88391908-88392365
  misc_feature 1..457: note = Hyper
  source 1..457: mol_type = genomic DNA

SEQ ID NO: 104843 - DNA, 66 bp, Homo sapiens; identical to SEQ ID NO: 71807
  misc_feature 1..66: note = chr10:88414219-88414285
  misc_feature 1..66: note = Hypo
  source 1..66: mol_type = genomic DNA

SEQ ID NO: 104844 - DNA, 70 bp, Homo sapiens; identical to SEQ ID NO: 71808
  misc_feature 1..70: note = chr10:88446786-88446856
  misc_feature 1..70: note = Hypo
  source 1..70: mol_type = genomic DNA

SEQ ID NO: 104845 - DNA, 30 bp, Homo sapiens; identical to SEQ ID NO: 71809
  misc_feature 1..30: note = chr10:88731103-88731133
  misc_feature 1..30: note = Hyper
  source 1..30: mol_type = genomic DNA

SEQ ID NO: 104846 - DNA, 58 bp, Homo sapiens; identical to SEQ ID NO: 71810
  misc_feature 1..58: note = chr10:89419357-89419415
  misc_feature 1..58: note = Hyper
  source 1..58: mol_type = genomic DNA

SEQ ID NO: 104847 - DNA, 145 bp, Homo sapiens; identical to SEQ ID NO: 71811
  misc_feature 1..145: note = chr10:89605836-89605981
  misc_feature 1..145: note = Hypo
  source 1..145: mol_type = genomic DNA

SEQ ID NO: 104848 - DNA, 77 bp, Homo sapiens; identical to SEQ ID NO: 71812
  misc_feature 1..77: note = chr10:89621759-89621836
  misc_feature 1..77: note = Hyper
  source 1..77: mol_type = genomic DNA

SEQ ID NO: 104849 - DNA, 604 bp, Homo sapiens
  misc_feature 1..604: note = chr10:90342630-90343234
  misc_feature 1..604: note = Hyper
  source 1..604: mol_type = genomic DNA
gggccttttcccgggcggcggaagtccccgatcacgtgacgaggcgcgccactcggcgcatgggccgcgctacacggccgctcagggagctgagggtatagcgttttcgccttagactttcttgggtgcaggcccacaccacctcagcagcctgcccggcagtcctcttttcccaggttttggcgtttagacaacccacctgagtcctcagccttgtcccacacagcaaggtacaagggaccggacgtctgcctcctcagcagcgcagcgcacaagcttcctgtcatcccggcgcccacgatcagcacctgcgccatggcgagagggagcagcgatccgcgctgagtctctgcggcggggccgttcggcccgggctttctggaaaggcggccgaaccggcgctagcgctctttggttccgtgctccctgggccgacctgggccctgagctttcctccggccggcctgcagggggcggaaaggaggcggccggagctgagaggcccctccgtccttgaggagcaaacctggggctgcggagaaccggggctgtctgtcttctcgctttgggggccgggcgccctgcccctcgcccagaaaagcct

SEQ ID NO: 104850 - DNA, 1661 bp, Homo sapiens; identical to SEQ ID NO: 71816
  misc_feature 1..1661: note = chr10:90966508-90968169
  misc_feature 1..1661: note = Hyper
  source 1..1661: mol_type = genomic DNA

SEQ ID NO: 104851 - DNA, 1050 bp, Homo sapiens
  misc_feature 1..1050: note = chr10:91294888-91295938
  misc_feature 1..1050: note = Hyper
  source 1..1050: mol_type = genomic DNA
tggtctctattccaccgagaagtctgcatttgaaaaccacaagagatggagatcaaagccgctcgttctccagccacctgcccaaaaactcggccgcagcgcagacccaacccagacagggcaagtgagcacgtgtctccctcccaacccaagctgcgcgccgacgcacccaagttagggtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagcgctctgcagcccgcccagagcgcgcagaccacccccatgccccgcccgccctcctgccacacccgcccccagcccggccccgccgcctcctcacctcgccgggaccactgcagccctggcggtagcgcgcggacatgcccccggggcgcacccgccgagccgcgtccctgcgcagtggccccttcccgggccccaggctgcgcgatccgcgcttcggtggggcggggagcggactgggcggaggcgccggcgaggctggggccgggggcctagctggcaacgccgggagagggaagcgtagcgcggaaaatcccagtgctcggccttcgaaatgcaccggctcattcagccccgccagctccgccggggactctgcctggccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccccgggaagagccatgacccctgacctcggcaagccgaggggagctcggtgttcccaaaaa

SEQ ID NO: 104852 - DNA, 442 bp, Homo sapiens; identical to SEQ ID NO: 71821
  misc_feature 1..442: note = chr10:92617097-92617539
  misc_feature 1..442: note = Hyper
  source 1..442: mol_type = genomic DNA

SEQ ID NO: 104853 - DNA, 30 bp, Homo sapiens; identical to SEQ ID NO: 71822
  misc_feature 1..30: note = chr10:92618047-92618077
  misc_feature 1..30: note = Hyper
  source 1..30: mol_type = genomic DNA

SEQ ID NO: 104854 - DNA, 75 bp, Homo sapiens; identical to SEQ ID NO: 71823
  misc_feature 1..75: note = chr10:92913398-92913473
  misc_feature 1..75: note = Hypo
  source 1..75: mol_type = genomic DNA

SEQ ID NO: 104855 - DNA, 30 bp, Homo sapiens; identical to SEQ ID NO: 71824
  misc_feature 1..30: note = chr10:92993186-92993216
  misc_feature 1..30: note = Hypo
  source 1..30: mol_type = genomic DNA

SEQ ID NO: 104856 - DNA, 56 bp, Homo sapiens; identical to SEQ ID NO: 71825
  misc_feature 1..56: note = chr10:93392900-93392956
  misc_feature 1..56: note = Hyper
  source 1..56: mol_type = genomic DNA

SEQ ID NO: 104857 - DNA, 24 bp, Homo sapiens
  misc_feature 1..24: note = chr10:93628551-93628575
  misc_feature 1..24: note = Hypo
  source 1..24: mol_type = genomic DNA
tttctttttttgagacggagtctc

SEQ ID NO: 104858 - DNA, 24 bp, Homo sapiens
  misc_feature 1..24: note = chr10:93628635-93628659
  misc_feature 1..24: note = Hypo
  source 1..24: mol_type = genomic DNA
ctaggttcacgccattcaaggagg

SEQ ID NO: 104859 - DNA, 625 bp, Homo sapiens
  misc_feature 1..625: note = chr10:93647037-93647662
  misc_feature 1..625: note = Hyper
  source 1..625: mol_type = genomic DNA
gtaacaccccagggccgcgtgaatagcggggaaggtaacgtgactgcggagctcagggccggcccgggaggggcgcgggcctggccagtgggaaggtcggacgccgaggggcgaaatcaccccaccggcatcagaccaccgcctccattcagcggaggaatgtgggcgggcagaggacgcgcggtcccctcgcccggcgttaaccctgtgcgcgccgggagcttcgcccggagcatcgcagcatcgcgcagcgcccggagcccggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcaccgcaccgaggccagaagaaggtagccagcgcccaggcaagcgcttaaaactgcagcctcctccacacctttgcacgtggggaaaccgaagcagaaccctg

SEQ ID NO: 104860 - DNA, 467 bp, Homo sapiens; identical to SEQ ID NO: 71830
  misc_feature 1..467: note = chr10:94180300-94180767
  misc_feature 1..467: note = Hyper
  source 1..467: mol_type = genomic DNA

SEQ ID NO: 104861 - DNA, 41 bp, Homo sapiens; identical to SEQ ID NO: 71831
  misc_feature 1..41: note = chr10:94342632-94342673
  misc_feature 1..41: note = Hypo
  source 1..41: mol_type = genomic DNA

SEQ ID NO: 104862 - DNA, 507 bp, Homo sapiens
  misc_feature 1..507: note = chr10:94448811-94449318
  misc_feature 1..507: note = Hyper
  source 1..507: mol_type = genomic DNA
cttcaatagaaaacacgtgcaaaaccagagagccagactgcgcacagctgcgaccctcaagagccagcagaaaagacacggagcggcccccactggattgaagactgcacagcctctgcccggcgctgtaggacccgggcctccccttgattgctgctcgcagcggcttctgccagcatcctcgcggaagtggcttgagtccgaggcctccaaatgaaaccaggtggagcggccaagagtccgcagcacctgaactccagccatccgaatcccgccgggccgcagctaagggccgccgagcagccctaggaacccagggcactgtcccgctctgagctcgggaaacggccggtgtgacagccagcgccactgttaatccagggagcgcacccaccgaggaggcgtcttaggccagcggcctctgctcccgccgagtcccgctgctccccgcctggaaacagctgctgccaccccgggcccaggcctggacggcgcccccgaatttcg

SEQ ID NO: 104863 - DNA, 1041 bp, Homo sapiens
  misc_feature 1..1041: note = chr10:94449685-94450726
  misc_feature 1..1041: note = Hyper
  source 1..1041: mol_type = genomic DNA
aatgtagcgccgcggcgcgggccagcagctctgcgaggggccggagcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcccgggaggccgagggggcgaagggggcaggcggtagacggctgtggcaaaagcgatggaaaagcagctgtcgggcacgcgcggggacgggaggcgcgcggccggggctgaccgcaccgtgactcagattggttttcctgcaccttgcaggcgtcggggcgcgcgggccggcggtagacctcgcggcgagggcagccgtggaccgcgcgtgttacccggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagacaaattcaggaaacactcgacttctgatagccgggatccgtttttctgatatt

SEQ ID NO: 104864 - DNA, 135 bp, Homo sapiens; identical to SEQ ID NO: 71836
  misc_feature 1..135: note = chr10:94451369-94451504
  misc_feature 1..135: note = Hyper
  source 1..135: mol_type = genomic DNA

SEQ ID NO: 104865 - DNA, 25 bp, Homo sapiens
  misc_feature 1..25: note = chr10:94603312-94603337
  misc_feature 1..25: note = Hypo
  source 1..25: mol_type = genomic DNA
aagcatgcatttggccgggcgcggt

SEQ ID NO: 104866 - DNA, 53 bp, Homo sapiens; identical to SEQ ID NO: 71838
  misc_feature 1..53: note = chr10:94822354-94822407
  misc_feature 1..53: note = Hyper
  source 1..53: mol_type = genomic DNA

SEQ ID NO: 104867 - DNA, 48 bp, Homo sapiens
  misc_feature 1..48: note = chr10:94822816-94822864
  misc_feature 1..48: note = Hyper
  source 1..48: mol_type = genomic DNA
cagacgggacgccctcggcgcaccccgcgcgtccgtcacctctgctgg

SEQ ID NO: 104868 - DNA, 38 bp, Homo sapiens; identical to SEQ ID NO: 71839
  misc_feature 1..38: note = chr10:94826099-94826137
  misc_feature 1..38: note = Hyper
  source 1..38: mol_type = genomic DNA

SEQ ID NO: 104869 - DNA, 904 bp, Homo sapiens
  misc_feature 1..904: note = chr10:94828028-94828932
  misc_feature 1..904: note = Hyper
  source 1..904: mol_type = genomic DNA
cgtttccaggtgcctcgtggtcaggctgatctcctcgcctctctgcagggctaccagatccccaagggctggagcgtgatgtatagcatccgggacacgcacgagacggctgcggtgtaccgcagccctcccgaaggcttcgatccagagcgcttcggcgcagcgcgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaacccttgtaaggaagcgggcacgccgtgggcgcaaccct

SEQ ID NO: 104870 - DNA, 778 bp, Homo sapiens
  misc_feature 1..778: note = chr10:94831610-94832388
  misc_feature 1..778: note = Hyper
  source 1..778: mol_type = genomic DNA
ttgagctgaacttggcgaggtggccccgcagagttcactcggatgtcacggtccggcctgcaggggtcacaggcgggtcaggcccgaggattgggaatgggccccaggtcacgtccccattcgtcggctttgcacaccggccggaggcgctgtccagaaaggggcggacccgggatttctgagaattacctccagcgcgattggcctggcttcctgcagtggccagaggttggttcgccgtgtttacagccaccaaatcgtttgccggagactgaaaccctgcccagagcctctgaaacactgggcaggttatggggaaacgctgaccccccgaaacactccctgtggcggcgactctggcttggagagtcgctaggattgtgcgggtccctccgacctctgcagatatttcctgatacctccgggtttggggactaccgcgagaagggcaacgcatttaaactctcaggagcagagttttccacctccaagggacgccttccaaggcgtgcggcgtgcttctgccagagacagtgttcagttttaaacaaatgcaggtcattctgtttcattttcggcgccgcaggtgcgttcagcgcccaaacccaggtagcgtgtgaccctgactggtcccgagccgggaagctccggcaggtggagagcagagagagcaggtgcgcgtcccgcagcgtctgagctccgggcattggcagctcagtagcagctgattgtagatgggcaaagtacagaagacttcccagtacggatcccttcaccc

SEQ ID NO: 104871 - DNA, 30 bp, Homo sapiens; identical to SEQ ID NO: 71844
  misc_feature 1..30: note = chr10:94832671-94832701
  misc_feature 1..30: note = Hyper
  source 1..30: mol_type = genomic DNA

SEQ ID NO: 104872 - DNA, 623 bp, Homo sapiens; identical to SEQ ID NO: 71845
  misc_feature 1..623: note = chr10:94833026-94833649
  misc_feature 1..623: note = Hyper
  source 1..623: mol_type = genomic DNA

SEQ ID NO: 104873 - DNA, 969 bp, Homo sapiens; identical to SEQ ID NO: 71846
  misc_feature 1..969: note = chr10:94834033-94835002
  misc_feature 1..969: note = Hyper
  source 1..969: mol_type = genomic DNA

SEQ ID NO: 104874 - DNA, 30 bp, Homo sapiens; identical to SEQ ID NO: 71847
  misc_feature 1..30: note = chr10:95257302-95257332
  misc_feature 1..30: note = Hypo
  source 1..30: mol_type = genomic DNA

SEQ ID NO: 104875 - DNA, 81 bp, Homo sapiens; identical to SEQ ID NO: 33196
  misc_feature 1..81: note = chr10:95326983-95327064
  misc_feature 1..81: note = Hyper
  source 1..81: mol_type = genomic DNA

SEQ ID NO: 104876 - DNA, 281 bp, Homo sapiens; identical to SEQ ID NO: 71849
  misc_feature 1..281: note = chr10:95361159-95361440
  misc_feature 1..281: note = Hyper
  source 1..281: mol_type = genomic DNA

SEQ ID NO: 104877 - DNA, 276 bp, Homo sapiens; identical to SEQ ID NO: 71850
  misc_feature 1..276: note = chr10:95753484-95753760
  misc_feature 1..276: note = Hyper
  source 1..276: mol_type = genomic DNA

SEQ ID NO: 104878 - DNA, 82 bp, Homo sapiens; identical to SEQ ID NO: 71851
  misc_feature 1..82: note = chr10:95754132-95754214
  misc_feature 1..82: note = Hyper
  source 1..82: mol_type = genomic DNA

SEQ ID NO: 104879 - DNA, 30 bp, Homo sapiens; identical to SEQ ID NO: 71852
  misc_feature 1..30: note = chr10:96157039-96157069
  misc_feature 1..30: note = Hypo
  source 1..30: mol_type = genomic DNA

SEQ ID NO: 104880 - DNA, 120 bp, Homo sapiens; identical to SEQ ID NO: 15380
  misc_feature 1..120: note = chr10:96304080-96304200
  misc_feature 1..120: note = Hypo
  source 1..120: mol_type = genomic DNA

SEQ ID NO: 104881 - DNA, 30 bp, Homo sapiens; identical to SEQ ID NO: 42632
  misc_feature 1..30: note = chr10:97202907-97202937
  misc_feature 1..30: note = Hypo
  source 1..30: mol_type = genomic DNA

SEQ ID NO: 104882 - DNA, 593 bp, Homo sapiens; identical to SEQ ID NO: 71858
  misc_feature 1..593: note = chr10:98129731-98130324
  misc_feature 1..593: note = Hypo
  source 1..593: mol_type = genomic DNA

SEQ ID NO: 104883 - DNA, 123 bp, Homo sapiens; identical to SEQ ID NO: 71859
  misc_feature 1..123: note = chr10:98272645-98272768
  misc_feature 1..123: note = Hyper
  source 1..123: mol_type = genomic DNA

SEQ ID NO: 104884 - DNA, 30 bp, Homo sapiens; identical to SEQ ID NO: 71860
  misc_feature 1..30: note = chr10:98292766-98292796
  misc_feature 1..30: note = Hypo
  source 1..30: mol_type = genomic DNA

SEQ ID NO: 104885 - DNA, 163 bp, Homo sapiens; identical to SEQ ID NO: 71861
  misc_feature 1..163: note = chr10:98398908-98399071
  misc_feature 1..163: note = Hypo
  source 1..163: mol_type = genomic DNA

SEQ ID NO: 104886 - DNA, 93 bp, Homo sapiens; identical to SEQ ID NO: 71862
  misc_feature 1..93: note = chr10:98528133-98528226
  misc_feature 1..93: note = Hypo
  source 1..93: mol_type = genomic DNA

SEQ ID NO: 104887 - DNA, 78 bp, Homo sapiens; identical to SEQ ID NO: 71863
  misc_feature 1..78: note = chr10:98808749-98808827
  misc_feature 1..78: note = Hypo
  source 1..78: mol_type = genomic DNA

SEQ ID NO: 104888 - DNA, 32 bp, Homo sapiens; identical to SEQ ID NO: 71864
  misc_feature 1..32: note = chr10:98944809-98944841
  misc_feature 1..32: note = Hyper
  source 1..32: mol_type = genomic DNA

SEQ ID NO: 104889 - DNA, 205 bp, Homo sapiens; identical to SEQ ID NO: 71865
  misc_feature 1..205: note = chr10:98945047-98945252
  misc_feature 1..205: note = Hyper
  source 1..205: mol_type = genomic DNA

SEQ ID NO: 104890 - DNA, 274 bp, Homo sapiens; identical to SEQ ID NO: 71866
  misc_feature 1..274: note = chr10:98945472-98945746
  misc_feature 1..274: note = Hyper
  source 1..274: mol_type = genomic DNA

SEQ ID NO: 104891 - DNA, 394 bp, Homo sapiens
  misc_feature 1..394: note = chr10:98945806-98946200
  misc_feature 1..394: note = Hyper
  source 1..394: mol_type = genomic DNA
cccggcagtcatccatcaatcgaaaagcacacatccagggccaggctcctccccgccctcccccgccgcagcccccctctcccgacgaccactcagcggctgcaagccgcctacagtttcaaaggtggaacctccgaggcgccgtcagcgggcacggggctgcgggggatgggagaagagggaagggggtgtgactcgacccgccaagtcctggctgtacacacacacacacacacacacacacacacacacacacacacacggcgaggatgcgcacatttagacgcacgcaccccggcacccgcggccccagctgctagtccagggtgggagggagatcttattttgccgcttggacgccttcccggggagtcagacccgtttccccccatcc

SEQ ID NO: 104892 - DNA, 71 bp, Homo sapiens; identical to SEQ ID NO: 71869
  misc_feature 1..71: note = chr10:98955979-98956050
  misc_feature 1..71: note = Hyper
  source 1..71: mol_type = genomic DNA

SEQ ID NO: 104893 - DNA, 30 bp, Homo sapiens; identical to SEQ ID NO: 71870
  misc_feature 1..30: note = chr10:98986334-98986364
  misc_feature 1..30: note = Hypo
  source 1..30: mol_type = genomic DNA

SEQ ID NO: 104894 - DNA, 78 bp, Homo sapiens; identical to SEQ ID NO: 71871
  misc_feature 1..78: note = chr10:99051344-99051422
  misc_feature 1..78: note = Hypo
  source 1..78: mol_type = genomic DNA

SEQ ID NO: 104895 - DNA, 272 bp, Homo sapiens; identical to SEQ ID NO: 71872
  misc_feature 1..272: note = chr10:99080175-99080447
  misc_feature 1..272: note = Hyper
  source 1..272: mol_type = genomic DNA

SEQ ID NO: 104896 - DNA, 146 bp, Homo sapiens
  misc_feature 1..146: note = chr10:99080838-99080984
  misc_feature 1..146: note = Hyper
  source 1..146: mol_type = genomic DNA
gcacgcactgggttgcgggacagagtagccaggttctgccggtgctcggagaagagcgcagtgttttgcaagtgctggagtctcctgaggacacgcgcgtcgccgccaccgcgggtgtgggaaagcgcggacgtgctgggcggctg

SEQ ID NO: 104897 - DNA, 964 bp, Homo sapiens
  misc_feature 1..964: note = chr10:99531097-99532061
  misc_feature 1..964: note = Hyper
  source 1..964: mol_type = genomic DNA
cggcgatgcagaggtcgttgtccagggggaacttgtggcagtgcagcatctcaggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgcttggccagcagcggcagccagctgctcgcctgctgcttcacttcggccaggctctcgtgctccagcaggttgggcagccgcatgcgcttgtagcccaccgtgtggcagagcggcaggtcggcagggatgtcaaggcactgcggcggcttggagtaggagcggccgtgcagcggctcggcctgccagccatagtagtcgtactcctcgcagcgcgccggcgcccagtgcagcgcccccagcagcagcgccagcgcggccgtccgcacgcccccccccgccgccgccgcccgcatggctgcgccctctccaggtgcgcgccgcgcagccccccgacgctcggtgcccggcggcccaggtgttccggcgtgcgcccccggccctgactctacccagccgccgccgccgccgccgcggaggtcgcccaggtgggtggcagcctgcgctgcgggcgccccgactgatcctggcgcctcccacctcggggctccagcccgggcctcgccgtgcgccccagccaatctccggccgcctggccccagctccaaggcggggaggcagtgggggcggccctcagcccctcccgcaccctgcccgagcgtcccgcccagcgccaggtcttgcgcccctctcccggctcggctcccctgccgcagccctggcctcgcccagcgtttctccccagggctccctgcctccctgggcattttcctcgaccctcgccttctccatccttcctccttatctctctccgccacagcctctcc

SEQ ID NO: 104898 - DNA, 266 bp, Homo sapiens; identical to SEQ ID NO: 71877
  misc_feature 1..266: note = chr10:99789105-99789371
  misc_feature 1..266: note = Hyper
  source 1..266: mol_type = genomic DNA

SEQ ID NO: 104899 - DNA, 1578 bp, Homo sapiens
  misc_feature 1..1578: note = chr10:99789599-99791177
  misc_feature 1..1578: note = Hyper
  source 1..1578: mol_type = genomic DNA
gggaagaccacacctcgtccagcataaggcggctagcagctacgccgcgcgcggggctggctcccggagctctctgccacccagcgctgtgcccgggaactcggcttcccaggggaggaagagccagcccgcggggctcttccccagcctggaagcgtaggcactcggccgaggccagtggcttcccaggcccgggtctcagcctggctgactgggagactctcccgatagcccggcacatccctcctcacccgctccgccccctccaggccccagaggccccctcccctgacagctgacctccagtgcgcccccaacactttctctgccagctgctggctgtcgcccccacacatcagctcccacctctccgccacctccaacccggccgccgcctcacccccagcccgcgggggaggctccgcgcgccaatcgagtccagcgcctcccagcaagttaggagcgaagccgccgccttcgcgatcccagtcttcccgggttcccgggcggcgtccccgccacccttgcgggcggatccgggggggcgcgcagagctggagaaactttctccgccttagggtggggggcaccggtgcagatactcacgccggggtcagcgctcggagccatcctcccgctctcggccccgccgcctaggggcgtgggaagcgggcgctcgctgccgcctctgccgccggcgccgccgcctgcttgctcccagccccggtcccgggctggcctcgagcctcccgccccgacgccgcgcgctcgctttatacaactccactcgagcgcgcccggtcttatgtaaaggctggcggaggcccgcagccaatggcgcggcagctggagccgggggcccggggtggggggcgccggcgcggccaatcgcggccccgagagcccggagagccgggcgtggggagggagcgcctccccgcgctgatttaggagccgggattgcggtggcagcagccggcagccaggctggcccggcgcggcgcggcggccactggggtgggcggcggcgaaggcggcggcgagggcgggcgccccccgcgccccgccactgcgtcgcgtaaccttcaggcggcagcgaggcctggcgaggaggggagagggcgcctggctgggcgctgggggccccaggccggagggaagcgagggtccctcgggaggcagcgcagggaaggaacgcgaagggggaggggagggcggcgagccccaggaccccgcggccacccctgcgcgcaggaccgagggtggaggcgggagcggctgcactgccttcccatttccccccaggatagcgatctggcgtcgccgggccgggccaaagcggccgagcgagccgcgctgatggcgagatttcgactacggagctagagccgagccgatctttatccagcctggggacgtgtccgagcacctcccggggactgctcagtatggagagcagggctccgcgacggcccccgcaggcggggagcgggcgagcgcagctcggagatcaggcgcgcagaggcccaggcggctgcgggcagcgccgcttctaccccaccccgtccccaccagcag

SEQ ID NO: 104900 - DNA, 52 bp, Homo sapiens; identical to SEQ ID NO: 70103
  misc_feature 1..52: note = chr10:100027893-100027945
  misc_feature 1..52: note = Hyper
  source 1..52: mol_type = genomic DNA

SEQ ID NO: 104901 - DNA, 30 bp, Homo sapiens; identical to SEQ ID NO: 70104
  misc_feature 1..30: note = chr10:100171013-100171043
  misc_feature 1..30: note = Hypo
  source 1..30: mol_type = genomic DNA

SEQ ID NO: 104902 - DNA, 84 bp, Homo sapiens; identical to SEQ ID NO: 70105
  misc_feature 1..84: note = chr10:100217160-100217244
  misc_feature 1..84: note = Hypo
  source 1..84: mol_type = genomic DNA

SEQ ID NO: 104903 - DNA, 45 bp, Homo sapiens; identical to SEQ ID NO: 70106
  misc_feature 1..45: note = chr10:100504665-100504710
  misc_feature 1..45: note = Hypo
  source 1..45: mol_type = genomic DNA

SEQ ID NO: 104904 - DNA, 39 bp, Homo sapiens; identical to SEQ ID NO: 70107
  misc_feature 1..39: note = chr10:100991943-100991982
  misc_feature 1..39: note = Hyper
  source 1..39: mol_type = genomic DNA

SEQ ID NO: 104905 - DNA, 698 bp, Homo sapiens
  misc_feature 1..698: note = chr10:100992042-100992740
  misc_feature 1..698: note = Hyper
  source 1..698: mol_type = genomic DNA
cacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagtcggtccttttgcccccgaagcgcagaaaggcgggcgaaagtccccgggccagggtcaccaagcgcttggagctgcagaggaagagaataagagaggaaaggttcccaggacaggacgagagcgcgtggggcacggagaagggccctcttcctactccctgagggcgacctggccggggctagaggctctgtgcctgccccagccggcagtccacgctggcccttggccgctgccctgcgccccagcccgccctcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccgggcggagacgcgctaggcgcgcctacctctggcttccgaccgttgccaaaaacttgtatgctgaaagccggcattgcctccgcagccccaggggc

SEQ ID NO: 104906 - DNA, 1208 bp, Homo sapiens
  misc_feature 1..1208: note = chr10:100993487-100994695
  misc_feature 1..1208: note = Hyper
  source 1..1208: mol_type = genomic DNA
tgtaaccagaatggtcgtttggcagaagtctccgggaccgcactccaggacaggcacagtcagggcgtcgcgtgggcctactgtggcaaaggagacgtccgcgcgaatccggtcctggggaaagggcagttccaacaacctttcatccagaagcctgcacagccaatgcgaatgcgccccgccaggacttcttccccgaaaatctgccttccagactcttttctgaggcaggaaagcattaggcgaacaggcagattttttaaaaaaagaaagaaagctggtgggggaaagggggtctgcgcagctgaaggagttcaatgaaagtgggacaagcgttgcggaaaactccgttgcaccctacattcggacgagctcatagacgcgctctgctgcacgaaagagctttcgaagaggaagctgggccgcgcggagctggctgttccgccctcgcggcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaat

SEQ ID NO: 104907 - DNA, 980 bp, Homo sapiens; identical to SEQ ID NO: 70113
  misc_feature 1..980: note = chr10:100995730-100996710
  misc_feature 1..980: note = Hyper
  source 1..980: mol_type = genomic DNA

SEQ ID NO: 104908 - DNA, 562 bp, Homo sapiens; identical to SEQ ID NO: 70114
  misc_feature 1..562: note = chr10:101088914-101089476
  misc_feature 1..562: note = Hyper
  source 1..562: mol_type = genomic DNA

SEQ ID NO: 104909 - DNA, 561 bp, Homo sapiens; identical to SEQ ID NO: 70115
  misc_feature 1..561: note = chr10:101089801-101090362
  misc_feature 1..561: note = Hyper
  source 1..561: mol_type = genomic DNA

SEQ ID NO: 104910 - DNA, 313 bp, Homo sapiens; identical to SEQ ID NO: 70116
  misc_feature 1..313: note = chr10:101280172-101280485
  misc_feature 1..313: note = Hyper
  source 1..313: mol_type = genomic DNA

SEQ ID NO: 104911 - DNA, 312 bp, Homo sapiens; identical to SEQ ID NO: 70117
  misc_feature 1..312: note = chr10:101283181-101283493
  misc_feature 1..312: note = Hyper
  source 1..312: mol_type = genomic DNA

SEQ ID NO: 104912 - DNA, 1140 bp, Homo sapiens
  misc_feature 1..1140: note = chr10:101290117-101291257
  misc_feature 1..1140: note = Hyper
  source 1..1140: mol_type = genomic DNA
tcctcaagagacaaccgcttaggcctggcgcaaggtacctggcccgggagcggctggggcggcggaatttggggtagaggggcacccgtgggccggctggtggggaggagacagccccctgcatgagctcacagaggcgccctggtgggctccggcggctgcagagcgtctgtgggcgtgtattggcgatcaggcgctggaggggcgctttgtcctggtcgcagttttaagacctggattgttgggctagatttatgaaaggcctaggagcgaagcgagatgggaagcaagggaatgtaacaaggagaaatgcaggcttcggttggaaactggggagagagagattgtttcgatagcctttctccttttctttttccagaatcatgaaatcaccgaggagaagaaaactggggactagaagagagcagaaacatttcccctgagacagttttgccccggaggtggggtggggaagtggcgctggagctcagcttcctgcttttatgctcggcggccaccgtgatgcacacacactcgaggtccgccaccccgcagtgccgtgcacccctctgcccccacctcggaatttttgtgcccgagcgctcgggatccacggcaaaaccaggcacattcctccctctgcagactcaccgcctggtttgtagacactggtctccgcctggggcgtcaatagtttcaggatttaaagcagaaagacaccgggcgcccctgtggctgaggaatggcggttccagcacaagaccctgcccacagagggtctctccctactgcctgcgggccgccgctaccctaagtactccggggcgcacgtggcccgcgcggcatcccagctccccgggcggacccaggggctgcctctccacaacagttccgctcccttctgcagagccccgcctctcccacctcccgacaggctgttctttctcccttcaaccttgggcacccactcctgtcgccgttgcgggacccgcgtggcagccctccaccctcgtacccactcccagccggtgtcttatgccgctcggaggcaatgtccaccgtccctgcacctttcacctgccccttccaggtgagacgggtctctttcagctccgccatcctgaccgccaaaaaatgctt

SEQ ID NO: 104913 - DNA, 1639 bp, Homo sapiens; identical to SEQ ID NO: 70122
  misc_feature 1..1639: note = chr10:101292333-101293972
  misc_feature 1..1639: note = Hyper
  source 1..1639: mol_type = genomic DNA

SEQ ID NO: 104914 - DNA, 1075 bp, Homo sapiens
  misc_feature 1..1075: note = chr10:101294528-101295603
  misc_feature 1..1075: note = Hyper
  source 1..1075: mol_type = genomic DNA
cacgaaacgcgcctccgcctgctaagggcgttctttgggtactggggctgtctcagggtcccacagcgccaggagccacaaacgttcccaaaagtccagccatttactaccgcacgctctgcgcagccaccaaaaagggtcacggtgctccaggacaggagccgcggtgcggccgggaacagctaaggacgctgttgtttgcttcttccgcagaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagcgcacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcag

SEQ ID NO: 104915 - DNA, 236 bp, Homo sapiens
  misc_feature 1..236: note = chr10:101296564-101296800
  misc_feature 1..236: note = Hyper
  source 1..236: mol_type = genomic DNA
agctgtatagacctgcgttcggtcaagtcttgcactctgccccacctcgagggtcgccagggaaaaggaagcctcgctcgcagtcccagctgttggccgcgcgaaggcggctccttccctggctgcagccagggctaccaacgcgcccgggggcgctgcgctgcgccccactgcggccgagctctcccccttggccgccctcccttctcccccggcggccgcggctttatgcggct

SEQ ID NO: 104916 - DNA, 66 bp, Homo sapiens; identical to SEQ ID NO: 70127
  misc_feature 1..66: note = chr10:101297064-101297130
  misc_feature 1..66: note = Hyper
  source 1..66: mol_type = genomic DNA

SEQ ID NO: 104917 - DNA, 30 bp, Homo sapiens; identical to SEQ ID NO: 70128
  misc_feature 1..30: note = chr10:101297437-101297467
  misc_feature 1..30: note = Hyper
  source 1..30: mol_type = genomic DNA

SEQ ID NO: 104918 - DNA, 499 bp, Homo sapiens; identical to SEQ ID NO: 70129
  misc_feature 1..499: note = chr10:101300095-101300594
  misc_feature 1..499: note = Hyper
  source 1..499: mol_type = genomic DNA

SEQ ID NO: 104919 - DNA, 30 bp, Homo sapiens; identical to SEQ ID NO: 70130
  misc_feature 1..30: note = chr10:101363437-101363467
  misc_feature 1..30: note = Hypo
  source 1..30: mol_type = genomic DNA

SEQ ID NO: 104920 - DNA, 23 bp, Homo sapiens
  misc_feature 1..23: note = chr10:101493051-101493074
  misc_feature 1..23: note = Hypo
  source 1..23: mol_type = genomic DNA
cgagactccgtctcaaaaaaata

SEQ ID NO: 104921 - DNA, 30 bp, Homo sapiens; identical to SEQ ID NO: 70132
  misc_feature 1..30: note = chr10:101780649-101780679
  misc_feature 1..30: note = Hypo
  source 1..30: mol_type = genomic DNA

SEQ ID NO: 104922 - DNA, 175 bp, Homo sapiens; identical to SEQ ID NO: 70133
  misc_feature 1..175: note = chr10:101874977-101875152
  misc_feature 1..175: note = Hyper
  source 1..175: mol_type = genomic DNA

SEQ ID NO: 104923 - DNA, 77 bp, Homo sapiens; identical to SEQ ID NO: 70134
  misc_feature 1..77: note = chr10:101988087-101988164
  misc_feature 1..77: note = Hypo
  source 1..77: mol_type = genomic DNA

SEQ ID NO: 104924 - DNA, 16 bp, Homo sapiens
  misc_feature 1..16: note = chr10:101988404-101988420
  misc_feature 1..16: note = Hypo
  source 1..16: mol_type = genomic DNA
ccgtctcaaaaacaaa

SEQ ID NO: 104925 - DNA, 30 bp, Homo sapiens; identical to SEQ ID NO: 70136
  misc_feature 1..30: note = chr10:102282456-102282486
  misc_feature 1..30: note = Hypo
  source 1..30: mol_type = genomic DNA

SEQ ID NO: 104926 - DNA, 270 bp, Homo sapiens; identical to SEQ ID NO: 70137
  misc_feature 1..270: note = chr10:102322032-102322302
  misc_feature 1..270: note = Hyper
  source 1..270: mol_type = genomic DNA

SEQ ID NO: 104927 - DNA, 33 bp, Homo sapiens; identical to SEQ ID NO: 70138
  misc_feature 1..33: note = chr10:102332594-102332627
  misc_feature 1..33: note = Hypo
  source 1..33: mol_type = genomic DNA

SEQ ID NO: 104928 - DNA, 64 bp, Homo sapiens; identical to SEQ ID NO: 70139
  misc_feature 1..64: note = chr10:102413884-102413948
  misc_feature 1..64: note = Hyper
  source 1..64: mol_type = genomic DNA

SEQ ID NO: 104929 - DNA, 1276 bp, Homo sapiens
  misc_feature 1..1276: note = chr10:102414410-102415686
  misc_feature 1..1276: note = Hyper
  source 1..1276: mol_type = genomic DNA
tgcataagattaagccgaggctctcagctgcgcagcgactcccctccggttcccatgttgtcgaggcatgctgggagtacaagttccgagcgcacggccaggtgaacgcgccgccgccgccgtcgccgcgcgactccccaccccccctagccccctcccgcgggtcccgactggcccaccccggcgggactggtgacgccggcgcggcctgcgcctcccggaaacccaggcagatagcccgggtggaagcggcccggccctggggtcaccatcgcccctcaccccggggttcgacggcggccctggacgtccccgggcccccgtcttcctcctgggccttctctctagtccctggcagctgggagcggccctcccgcccctgcactccttcctgtcgcgctgtggttctgccctctggttgtcgctcccctagccctcccctctttctctctgcagtgtttcttggggctgttgtctttctgtctgtcactctgcgtctcggtctctctggagtccttctgcctctgtcgccctcccccgcctcgctgtgtctccgtgcgggtgcccctgcagctccctggctcgcccggcctgcgtccgtcggtctgtctgcctctcgcggtctcctcggctcccccctccccctctctcccctctcccctctcccggcgctggcggccaccgcactgcagcgcggcaccagcagtctatgacaaaaacattatccttctgctgctaaacaatccaataaacctctccacagggagaaagttaacctcttgtctcttcggctgatgccttcccgcccacgtgactgctgccacagtaaattcaaatcattagtctcctcaccccatcaaaaaacttctattagtaatggagacctcgccggagaccttccgcggagagcgctgccttcccaattcccagtggaaaaattctgcgcgaaaaactaattctacttttaataatctgtcatcaggaccagaggcagtcataaattatatgggagcgcgtgcgagagcgcgccacaagagggaaatcagggcgaaaaatcaaagcccaagtttgacaaactttcctgaagataaataataacttacaaacaggattagttgtaaagtcacgctccggcgcgcagccaccgcggcaatcacgtctgccgagggccgccaccgcgaggcacctgtcaccggccgccaccgcttccgagccttcctcctcgtcctcctccttgcctgcctcccctcctcctcttcctcgccctccagccttc

SEQ ID NO: 104930 - DNA, 715 bp, Homo sapiens
  misc_feature 1..715: note = chr10:102419132-102419847
  misc_feature 1..715: note = Hyper
  source 1..715: mol_type = genomic DNA
tcagccccagacccacgcagtgcctcacgctcgcctgccccgcccgctccccgcgggcctgcgcgtgactttagcgcgcgcggctccgcccggaaggtcacctccttcatcacggattctatttgcatccggaatcgcatgtacatgaaaaatgtgtccgcgtgcggccccgactgcagacgcagatgaaattctgtgccgagcctgatgcgcggtaacctttgcagatggcgccgctattgctgagaaatggattgcttaataaagcgtatcatccggcatatttgctgcttggctagccaaatagaagttgttttttgcacaaatttccttgtcaaatttgtcaatgttcatgtcatttttgctttaggtcacagagcaaggtgcaaattcctggcatctttactagttgcagccaatttcggcgatttcggcggtgacggggattctcagaggagccgcgtgcccgtgcgctcccgcctgtcggccccagagagcgcagccctgacacctcctcccggaagcccgccggcccgaccctggtttggaaggagaggctcagggagtgggacagagggtatctctctttccccagcgtccacccccagacgcctcctacccccaaccagggaggttagaggggcagatgggagtacgaggcttacacccagctctcctatgccacttcctctccctaagacgtggccttttcccc

SEQ ID NO: 104931 - DNA, 468 bp, Homo sapiens; identical to SEQ ID NO: 70144
  misc_feature 1..468: note = chr10:102430682-102431150
  misc_feature 1..468: note = Hyper
  source 1..468: mol_type = genomic DNA

SEQ ID NO: 104932 - DNA, 163 bp, Homo sapiens; identical to SEQ ID NO: 70145
  misc_feature 1..163: note = chr10:102440854-102441017
  misc_feature 1..163: note = Hyper
  source 1..163: mol_type = genomic DNA

SEQ ID NO: 104933 - DNA, 407 bp, Homo sapiens
  misc_feature 1..407: note = chr10:102470039-102470446
  misc_feature 1..407: note = Hyper
  source 1..407: mol_type = genomic DNA
gcgcctgatgggaagcgacagctccgccccgcctccctccactcctgccctcccgcggctcctcccgggcgccgcgtcccgcgctcctgctgccagcccagccggcctggggcgccctagccgctggtcctggcccaacaagtagccaccgacccctcccatgtggcctaggacgggaggagcttctgcccggcagttgggggtgacaaggatggggtaaagaggggcgccgggcaggcgcagggcggggggaaggggcagcccacagttggcgctacacgactccgcttctgttttccccgtgttgacatagaaatcagactggaaagaaagcaacatgtagaggggcttccccgggtgtgaggtgacaggtgggttttcctgtctttttgcggatctgtgtctcc

SEQ ID NO: 104934 - DNA, 726 bp, Homo sapiens
  misc_feature 1..726: note = chr10:102473283-102474009
  misc_feature 1..726: note = Hyper
  source 1..726: mol_type = genomic DNA
tagaggcgggaactccggatgagaaagagacgagggggccaggatcccagggctggcagcgacaggaaggatgggaagaggtccgcaggcccgacgggtgcgggccagcctggccgcgcagggggagctgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccccgtttaacactatccccctcacctgcacgctcctggcccgcagcggaggtgggactggggagcagggcctgggactccgctggtgggggtacacgcaggggcactggcgggggcggggggcgacggcactcagaattgcgctgaggcaaattccccgccaggtccagattggggggcgcgaggacaggagcatcgagtgcccggatagctgagcccccccactccccatccccttcctggaccccacgtctagggccgctggcggctcctgcgattagcgctccagatgtttg

SEQ ID NO: 104935 - DNA, 699 bp, Homo sapiens
  misc_feature 1..699: note = chr10:102475261-102475960
  misc_feature 1..699: note = Hyper
  source 1..699: mol_type = genomic DNA
gagagagtgaatggccgcgtcagccgcaaagaggcccagacagatggacgcaggcaggaagacggacaggagagagagagagacaacgtgcgcccgaggctgaagagctgggtcaagaagagattcggcttccgggagcaggggcgtccgggagggactgcccagggcgccccgctgcccgaagcccagccccgccccagccgccgccggcgccgtctgtcggcagccgccctgggcctaggccgcagggtccacaggcggccctgacaggcggcggcggcggtgagggaagccggagcgagaggcagcggagccgcgtgtgtgtttttattattattatttctgattaaagaggaattcatctcgtatctgcctcctgccaggggccgaggctccgccattggggttaacggtgcggaagaatacaaaaaaatttcattgaggaggattataaaagttactagctggaacattaacagaagagtaacttgtaaaaaatgcaatattacaatattcacaaggacggcagagcgtggtaaagctataaaattcaacattaaaaccttccacagcctagataacctagttaacaaacatgggattggaactacttttctgtggagacaggaatacgcgccggggctggtcacacctcttccgcgggaggggcggggtcggcggccacggcctagccgcgcc

SEQ ID NO: 104936 - DNA, 804 bp, Homo sapiens
  misc_feature 1..804: note = chr10:102483750-102484554
  misc_feature 1..804: note = Hyper
  source 1..804: mol_type = genomic DNA
gcggggaggaagggacgaggggagggggctcgatgggggaattgccgggcgggcgctcgggcgctccgagctgcgcggctccccggggagaccgcagacactttgcggagatgttactccggagttggagacgatgataaatatgataatttgtataaaatctgaatgggtcttgttttcagggagaatgccttggatgatgaatgggcccggctttcagatagatggctgataaaaagtgtattggattgttgagagcgattttaattctcattctgtacctgcagatgccgcggccgccgcgcccggcctcctcctccctcctgcccactgcgcggggcggacgccggcccggccggcctcggcggctcaggaggcttctgaaatgactctaattacagagttattaattttaagaggagggtgagcggggggtttatgattattaatcgagcgcccgagctcggcgggcggggcttggcgggccgcgggctagcggcgctcggagtgcggaggacgcgcggggccccggggcggctccaagcccggcgggctccgcggcggcggcgaccaggctcgcttcccacttgggctgcgggcggcatggtccctctgcgcccatccggctctcctcacccctgccagtctccgacccggccgtccaacgtccctccctggccggctcgcctgcgcagccgagcatcaggctccgcgccggggtaggcgagcaggtccccagccccaggcccgcagctgtaggccggtgaggaacagctctgctagagaaagcgcaccccaccccca

SEQ ID NO: 104937 - DNA, 30 bp, Homo sapiens; identical to SEQ ID NO: 33257
  misc_feature 1..30: note = chr10:102489083-102489113
  misc_feature 1..30: note = Hyper
  source 1..30: mol_type = genomic DNA

SEQ ID NO: 104938 - DNA, 536 bp, Homo sapiens
  misc_feature 1..536: note = chr10:102489328-102489864
  misc_feature 1..536: note = Hyper
  source 1..536: mol_type = genomic DNA
agaagaccctgggaacgggcagaatctgagccgcgtctctgagtcgcagtgggaaggcggctcaggaaatgcgccctccgctggcgctgggtcgcggttctggctgcgttactttttccttgcatctgtggcccggcgcgccagcctggacactagatccgcaagaagggagttttcccagggccggctgaagaatgagaagtccgagctgcggggacgttgggggtctgtgcttagcggccacagcctgcccaccacgggttcccgccaccccgcctccccacctcccttcgcgccagggctgaaagtcccaggcgcccaatgcgtgcccaagaacgagccgtgaaccttttatctacccgtccccttccccgccatggacccaggacgacaccccacacccagacaccactctttccaggggcagatgctccggcgcgccccgcgccctgaagttcaacttggaatccaggtccgcgcgggaccccgcctagcgccccaagcgcacaggctgagcgccccgccctggcctcctg

SEQ ID NO: 104939 - DNA, 67 bp, Homo sapiens; identical to SEQ ID NO: 70160
  misc_feature 1..67: note = chr10:102490249-102490316
  misc_feature 1..67: note = Hyper
  source 1..67: mol_type = genomic DNA

SEQ ID NO: 104940 - DNA, 69 bp, Homo sapiens; identical to SEQ ID NO: 70161
  misc_feature 1..69: note = chr10:102490646-102490715
  misc_feature 1..69: note = Hyper
  source 1..69: mol_type = genomic DNA

SEQ ID NO: 104941 - DNA, 598 bp, Homo sapiens
  misc_feature 1..598: note = chr10:102495028-102495626
  misc_feature 1..598: note = Hyper
  source 1..598: mol_type = genomic DNA
aagttgggaagtaggcgagaagccaggctgtgggtctggaggggggcgtgtgacagtgaagaagagggggttgggtgagagggtgtgccggcgtctaggctgggctgcggtccgtgggcgcctcaggcagcgagggtggctgcttgcctgcggctggctggggcctcggtgcgtgtgcacgcgtgtgcgcggggcggagaacccgggctcctcggggtgccggagcctctgcgcggccgggagtgagagagcgggcgcgggcggagcacacagccgtggcggcgggcggctcgggttatctgagccgcttggtgttgggtggctgcgcccagatctccgggcggcggcggcggcgaaggcgagacgcgttgtcgggccgcggaggagcgggacagccagacccagccccaggacgcggcggccgcggggagcctagcatggaagagcgcgcgggtccggcaggtaagagcggcagagacccgtccgcgccgcaggcgaggactaggggagagggatgggggcggccatggccggggcgggctcctctcctctttcatccctgtgctcagtacccggcgggcgacgtgaaggctgggga

SEQ ID NO: 104942 - DNA, 660 bp, Homo sapiens
  misc_feature 1..660: note = chr10:102497149-102497809
  misc_feature 1..660: note = Hyper
  source 1..660: mol_type = genomic DNA
cctgacgggttagggcggccgcttacccggcgcgcgtggcacagcggccagcggcccgactccgcaccgcacttcctttcccttccctcttttcccgcctttgcgggtgcgggtctcgtgttccaggcagcagcagctccgggaaaggcgggggggagctgcggagctgggcaggagacagggctgtgtttgggaaaaggaaaccgcacttcgaggcggctccgcagagcagagctgcagagtcttccgccctcccagccgccttctccctttgcctctttctcttttcaccgccccctccctcatctcttcggtagccacgtttggccggggcacaactccctggaggccctgcccccctagacggccccgagcccttttggacctcatccggctagtttaaaatgacaatgacagaggcgcgtgaccgaacgtgcctgccggacgtcctggcgcaactgccgcagccgggtttgcgaaggatgcgggttttacttagtctcgctgagcctgttccggagcagcgaaaaccatcaggaaagggcgagagaaggaggaaggggattgaatcagcaactagggcaattgtggtcttcagctatcgctgcctatacccccagaacttacaaaaataagccgtttattcgatgccctcccttt

SEQ ID NO: 104943 - DNA, 275 bp, Homo sapiens; identical to SEQ ID NO: 70167
  misc_feature 1..275: note = chr10:102498176-102498451
  misc_feature 1..275: note = Hyper
  source 1..275: mol_type = genomic DNA

SEQ ID NO: 104944 - DNA, 41 bp, Homo sapiens; identical to SEQ ID NO: 70168
  misc_feature 1..41: note = chr10:102498723-102498764
  misc_feature 1..41: note = Hyper
  source 1..41: mol_type = genomic DNA

SEQ ID NO: 104945 - DNA, 340 bp, Homo sapiens; identical to SEQ ID NO: 70169
  misc_feature 1..340: note = chr10:102498824-102499164
  misc_feature 1..340: note = Hyper
  source 1..340: mol_type = genomic DNA

SEQ ID NO: 104946 - DNA, 39 bp, Homo sapiens; identical to SEQ ID NO: 33269
  misc_feature 1..39: note = chr10:102499518-102499557
  misc_feature 1..39: note = Hyper
  source 1..39: mol_type = genomic DNA

SEQ ID NO: 104947 - DNA, 30 bp, Homo sapiens; identical to SEQ ID NO: 70171
  misc_feature 1..30: note = chr10:102500820-102500850
  misc_feature 1..30: note = Hyper
  source 1..30: mol_type = genomic DNA

SEQ ID NO: 104948 - DNA, 174 bp, Homo sapiens; identical to SEQ ID NO: 33270
  misc_feature 1..174: note = chr10:102501247-102501421
  misc_feature 1..174: note = Hyper
  source 1..174: mol_type = genomic DNA

SEQ ID NO: 104949 - DNA, 743 bp, Homo sapiens; identical to SEQ ID NO: 33271
  misc_feature 1..743: note = chr10:102501726-102502469
  misc_feature 1..743: note = Hyper
  source 1..743: mol_type = genomic DNA

SEQ ID NO: 104950 - DNA, 739 bp, Homo sapiens; identical to SEQ ID NO: 70174
  misc_feature 1..739: note = chr10:102503828-102504567
  misc_feature 1..739: note = Hyper
  source 1..739: mol_type = genomic DNA

SEQ ID NO: 104951 - DNA, 42 bp, Homo sapiens; identical to SEQ ID NO: 70175
  misc_feature 1..42: note = chr10:102504907-102504949
  misc_feature 1..42: note = Hyper
  source 1..42: mol_type = genomic DNA

SEQ ID NO: 104952 - DNA, 223 bp, Homo sapiens
  misc_feature 1..223: note = chr10:102505693-102505916
  misc_feature 1..223: note = Hyper
  source 1..223: mol_type = genomic DNA
tggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctc

SEQ ID NO: 104953 - DNA, 598 bp, Homo sapiens
  misc_feature 1..598: note = chr10:102507395-102507993
  misc_feature 1..598: note = Hyper
  source 1..598: mol_type = genomic DNA
taatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccg

SEQ ID NO: 104954 - DNA, 1359 bp, Homo sapiens
  misc_feature 1..1359: note = chr10:102508280-102509639
  misc_feature 1..1359: note = Hyper
  source 1..1359: mol_type = genomic DNA
cagtccgggccgacccgactcggccgctagaagtctctgcgcttggattgctcagtacctgcggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtc

SEQ ID NO: 104955 - DNA, 38 bp, Homo sapiens; identical to SEQ ID NO: 70182
  misc_feature 1..38: note = chr10:102585759-102585797
  misc_feature 1..38: note = Hyper
  source 1..38: mol_type = genomic DNA

SEQ ID NO: 104956 - DNA, 1031 bp, Homo sapiens
  misc_feature 1..1031: note = chr10:102586054-102587085
  misc_feature 1..1031: note = Hyper
  source 1..1031: mol_type = genomic DNA
acacaggagaaagggcgagggggaaacctggaggcctggcctttctcccgcagagggagggaggtagcttccgacgacggctcccaacccacgggccctccgctcaccgctagcggaccagcgggcagtccacctgcgccgcctccatcccctgccgcgtagcccacgcatccaacctcttgagggaaaggcgggagggcggtgtctcccaaaagagctcccacctcttgtgttggcactgcacattgatgccattcttaggactttctgggagaaaaatgtcccgaaggcctttcttcgccaccgccccccactcccatttccacccattaggggccatgcctcctagaaccggagtggcatctataaaggccctggcccccagcgcgacagggtggacgcgccccaatacaaacccttcgtgggtggccgcgagcgcctccgctgggaagccctgggcgggcaccggcccacaggtcccgcccgtgggtgtgcgagcgcgtcggtgcctcccgcctccccgggctctctccacgcggacgcggtgatcgccccacctccgcccggcccgcccgccacggccattaccctgcccgcgacacctgcgcctgagacccggcgggaggagcgggcggagaagccaccggccggactcgtggggtccgccctggcttgcaggcgtctgatccccactccccgaccctcccgcagggagcgagttctccggcaacccgtacagccacccccagtacacggcctacaacgaggcttggagattcagcaaccccgccttactaagtgagtacgccacctggctggccggcggctcagcgcggccgcgcggcttctgggcacggtcccactcccggcgacccgacctctggggacccggccgggccagggggacaggcttgttagtgcagcactgaggcccggggacccctcgaggacgcccgcacctcctgccctcccgtgccctccctggtcgctcgaaggctctgcgccgccctcgccctcggatcccctggagg

SEQ ID NO: 104957 - DNA, 115 bp, Homo sapiens
  misc_feature 1..115: note = chr10:102587306-102587421
  misc_feature 1..115: note = Hyper
  source 1..115: mol_type = genomic DNA
ttattattatagtgccgccccccggggctccgcccctgccgctgctgccgctgcctatgaccgccactagttaccgcggggaccacatcaagcttcaggccgacagcttcggcct

SEQ ID NO: 104958 - DNA, 175 bp, Homo sapiens; identical to SEQ ID NO: 70184
  misc_feature 1..175: note = chr10:102588252-102588427
  misc_feature 1..175: note = Hyper
  source 1..175: mol_type = genomic DNA

SEQ ID NO: 104959 - DNA, 1291 bp, Homo sapiens
  misc_feature 1..1291: note = chr10:102589166-102590457
  misc_feature 1..1291: note = Hyper
  source 1..1291: mol_type = genomic DNA
cgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcataggtatggctttctgttcatctatgtgttcgtctgtatgtccct

SEQ ID NO: 104960 - DNA, 1379 bp, Homo sapiens
  misc_feature 1..1379: note = chr10:102890870-102892249
  misc_feature 1..1379: note = Hyper
  source 1..1379: mol_type = genomic DNA
ccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctgcgctccaggtcgcccagctcttcttggtgcttcccccaagttgagccgcccgcccgattctataacgcagactcgccatgcttgaagagttctctcagcctggacccctctctgtctcccgaaggacccctgctcggaggagctctccctggtcccctctccggatccactagccgggtcaggcagagagaaggaggccatagattcaggaccaccttctgcagctactcttggcctgggaatcttagagaaaggggtgcaacgtgaacagtttcttccgtcctggctgctgt

SEQ ID NO: 104961 - DNA, 1706 bp, Homo sapiens
  misc_feature 1..1706: note = chr10:102893583-102895289
  misc_feature 1..1706: note = Hyper
  source 1..1706: mol_type = genomic DNA
ctgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctgggacgcttcctgacgctctgctgcttgcctctgccgtctgtctgtctcccgctccagtggccctctcacccttcactgtaacacgccgtataggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagccagggctagctcgggggttggggggactccggtttccaaggcct

SEQ ID NO: 104962 - DNA, 1556 bp, Homo sapiens
  misc_feature 1..1556: note = chr10:102899140-102900696
  misc_feature 1..1556: note = Hyper
  source 1..1556: mol_type = genomic DNA
ggagggttcagggtccgaagacagcagccagcctttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcctcccaattccccaagaccgcctctagaggctgctgtgtccggagaactccgagcattttctggacacagattgcctaacagaggaacaggggttaggtggggagcggctggccggcccaaacacagcagccccaagctggctcccaagcctgggctctccacccccgctcccatcctctcttgagcacagttaggcccaacacccctgtcccccaaaacacctcctaccctccctcccccccagcccccatcttcaggaacatcacagggctcacactcactaaccgcggagagcacatgcaggccggagccctcagcccggcagctctcggaccctgcccagctcgacgcggactcatgcagaagaggacattccgcaggtaggtacaatcccagcgctggggcctggggcgtccggggggcggcctttgagcttcccggataccgctcgcctgctcccggagctgttcggccgccggctgcccgggtcgtgcactttcagtagggccccgctgactctcctgcccttgggctaggcctcccggggatgccagactcctggggacgctgggacccgcggcgcggcgggacacgcaggactcccgcctctccgcccggaattcgttgagacggaatctcagcggatcccgcgtccgccgagcgccgcggccagggagaaaggccggtgtggcggctggacccgcaaactccgtcccaagtggggcggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacacagagaatctggctcaacctgttaactataatagcggctttgtgtggccgcatctgtgcttgg

SEQ ID NO: 104963 - DNA, 119 bp, Homo sapiens; identical to SEQ ID NO: 70193
  misc_feature 1..119: note = chr10:102905699-102905818
  misc_feature 1..119: note = Hyper
  source 1..119: mol_type = genomic DNA

SEQ ID NO: 104964 - DNA, 249 bp, Homo sapiens
  misc_feature 1..249: note = chr10:102906332-102906581
  misc_feature 1..249: note = Hyper
  source 1..249: mol_type = genomic DNA
accccttgcttttcccgacgggctcccggagtctcatttctagaatgaggtgggagacctcgtgactacgcggaggccgccccagggctccgagggcaccgcacagggcaccaggcccttcccagctcaacccgggcccgtcgcggtagtgaattggcgcctgacgattgcgcggcagaggctggcgagcagcgctgggctgaagccgacccggcaccgcgcggcgcccggatccggagctgccagcag

SEQ ID NO: 104965 - DNA, 191 bp, Homo sapiens; identical to SEQ ID NO: 33291
  misc_feature 1..191: note = chr10:102975143-102975334
  misc_feature 1..191: note = Hyper
  source 1..191: mol_type = genomic DNA

SEQ ID NO: 104966 - DNA, 325 bp, Homo sapiens; identical to SEQ ID NO: 70197
  misc_feature 1..325: note = chr10:102975555-102975880
  misc_feature 1..325: note = Hyper
  source 1..325: mol_type = genomic DNA

SEQ ID NO: 104967 - DNA, 255 bp, Homo sapiens; identical to SEQ ID NO: 70198
  misc_feature 1..255: note = chr10:102976414-102976669
  misc_feature 1..255: note = Hyper
  source 1..255: mol_type = genomic DNA

SEQ ID NO: 104968 - DNA, 1297 bp, Homo sapiens; identical to SEQ ID NO: 70199
  misc_feature 1..1297: note = chr10:102976994-102978291
  misc_feature 1..1297: note = Hyper
  source 1..1297: mol_type = genomic DNA

SEQ ID NO: 104969 - DNA, 433 bp, Homo sapiens; identical to SEQ ID NO: 70200
  misc_feature 1..433: note = chr10:102978742-102979175
  misc_feature 1..433: note = Hyper
  source 1..433: mol_type = genomic DNA

SEQ ID NO: 104970 - DNA, 1773 bp, Homo sapiens
  misc_feature 1..1773: note = chr10:102982194-102983967
  misc_feature 1..1773: note = Hyper
  source 1..1773: mol_type = genomic DNA
aagcccaggtgcctccgggttcaggtgactggaaaagccagggcagggtgagtggacttccccggacttggcggctcagagggatggagaggtgggggggggggtccccgcggcgacgggaaggggcggagggtaggcgcgcggccccagctcgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaatagggaactgcgcctctctgcctcaccccgcgccgctcgccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccagagtcctgggggaacagatgggcaaagggctctaggaggtgatggaactcaggcccgaagggcaggcagcccacaggataccaagccttaacgaactacgccagaagaatgggcgtagggcccacagcccctcacacaacccaggccaagctccctcgtacactcagaccaggagaagaaacagacacgcaatacacaagccccgctcccttggagcctacacttgggcgaacacaccactgctgtttgcagtatcccgagacaggcccggcaggcgtgagctaagaggcctcgggcccgaacttgggatttgaggctctctcacatcgccggtcccagcggcagcgcctgaggcacagccaagaccatccgaggtccccgggccgcgcgcaggtagcagacttcttcagaactgggggagctaaagagagagtgggcttagagcccaggcctccctggatcccagatcctcgcctccgcctacagccaagcccctcagcttttgcccagagctgctgacttcctcgccgcctccctgcgcaatgggacctagagataagccccaagcccgggtgctagtccaggcagagtcgggtgctagtccaggcagagtccagtgctagtccgcggcctcaacagagctgtcggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggtagctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcgcaataaacatttgctgaattgaattgcgttttctccttatt

SEQ ID NO: 104971 - DNA, 236 bp, Homo sapiens
  misc_feature 1..236: note = chr10:102984305-102984541
  misc_feature 1..236: note = Hyper
  source 1..236: mol_type = genomic DNA
cccaaagggacccagcggggccaggcccagggccgcgaagcagagagcggccggaggtgccagggccgcttcattgggattcatgagcgtgttgggcgggcggcctggggcttcgggcgcggggcgggggccgagtgggggggtgcgcacggcgggcgcagatgcccgggtgaccgacccgccgtggtccctgcgccgcctttgtgccgaggaggcgcgcgcggggacctaatcca

SEQ ID NO: 104972 - DNA, 2559 bp, Homo sapiens
  misc_feature 1..2559: note = chr10:102985096-102987655
  misc_feature 1..2559: note = Hyper
  source 1..2559: mol_type = genomic DNA
ctcacatcaattttgcggagaaagagagcccagcggcccggaggcgggaccccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctcggcggtccggtccgggaggcgttgggctttcgagcgctaggagcccagggcggcggaagacccggggcgccgctcaatcgtccacgtcgatctcttcgtcttcctcgtcctccgagcagtcctggctgctggccggctggtccgtgagcggagaggcaggcgagagctgcagggcgccagcgcccggggccttcggggcgcctggggggaggaccggagagccgggcctcgacttggccctgccgcagccgccgccaccgccggctgtggcctccgagttctgctcgagttcggccagcgccacgatgtccatctgcccgctggggcccagtttcttggcggactctacgtcggccttcatctcctccaggtcccgcttgagcttagcgcgccgattctggaaccaggtgatgacttgcgcgttggtgaggcccagctgctgcgcgatttggtcgcgatcggcgggggacaggtacttctggtatagaaagcgcttttccaattcatagatctggtggttggtgaaggccgtgcgcgactttcgccgcttcttaggggtctgccgctgcccaaagatggtcataccgtcgcggcctgggaggaaaggacagtgtaggctcgcgttgggagagaggaagcccaccctggctctcgcccccgtaactccgtaacccacccaggcctgtccggcctgcagtctac

SEQ ID NO: 104973 - DNA, 418 bp, Homo sapiens; identical to SEQ ID NO: 70208
  misc_feature 1..418: note = chr10:102987947-102988365
  misc_feature 1..418: note = Hyper
  source 1..418: mol_type = genomic DNA

SEQ ID NO: 104974 - DNA, 325 bp, Homo sapiens; identical to SEQ ID NO: 70209
  misc_feature 1..325: note = chr10:102988611-102988936
  misc_feature 1..325: note = Hyper
  source 1..325: mol_type = genomic DNA

SEQ ID NO: 104975 - DNA, 1125 bp, Homo sapiens; identical to SEQ ID NO: 33305
  misc_feature 1..1125: note = chr10:102989172-102990297
  misc_feature 1..1125: note = Hyper
  source 1..1125: mol_type = genomic DNA

SEQ ID NO: 104976 - DNA, 1565 bp, Homo sapiens
  misc_feature 1..1565: note = chr10:102996019-102997584
  misc_feature 1..1565: note = Hyper
  source 1..1565: mol_type = genomic DNA
aggtctcactactgtcggggggcgccgggcgcaggccgggcatggggcctgagcttaggccaggtggaaaggtggaaggacctagtggggacagacgaagagaccgaggagccgcccgcccggctaaatggacacaggaaaggcctgagtcaggcttctcataataaataaactgcacgtgaataattcagcagtcgcgcgggggccggttgcatcagcgccgccgccgccgcgcggcgcccaattccccgcggaggggagtagccaattaaggcacttgaaaagggagtcgggtggaagatcccccgcccaccagtatcctggatttacccaggtcgagttcagagagcctccccggtcccaaccccctcgggccccatgggtcagggggccgcctgctgggaagtgctacctcagctaagccgctcaggtgtcccgagactccgggcaagggaagacaggcggcgagacggagccagaataagggatgcggacgtctgacctgtggaaaacccagcatctgcagtgcccagccgcacagggaacgtgggcggcgtggttccaagcacagtgaagacgccaggctcggatctgtgctcagagccgggatccctccgggctgcttcgtcctggccaggactttccttgccctgaagtgaggcgccagggaagctgcagggccctccgccctctctgaactcccacgtacttgggcctctcccagcctttcttggacctgtggaagcaattcctgcaggaccagactcccctgtctccccgcggccccctaggtacactccgtaacttccgaaaccttatttcgtttgagcgaaacccggcccctttggctcttcccacttcccacaagtccctgggttcccgatcctgagggattgcattcatcccatctcacacccaccaacgctcaatccctccagttcctccccagccccttcacttccattaattaggtcgactcccttccttcgccgctccctcctgtccccactcagcctccctacacctatgcggcgagcctcgggccaagacctccgccctggctccgccagtcctgcgggggccggcatgcaccagacctcaaaagggatcttcacgggaattccgcatagccagatcccaagcctccagggaggccaccagccctcccccatcttcttcttcctcctccgtctcctttcctcttccctccgcctctacgtatttctttctattcgtttcttttcgtttggtgaggtgccacccgccacagccctgtcccctagggagaggcctggactaactttgccgtcctcgtggccttagcccggactgtgagtctcgagcggcttccgagaggcagctcgggtgtcttcgcagagacagatgaggtgggctggcgattccctagcctcagatggctctgccaccagccagctctgtgatcctgggtaagtctttcaacctctctgagtcttgacgttggtaaaaggcaggagatttagagaaggtgttgggagactaaatcttttcattcgtttgagaaagggagtcgcctgtgttgggac

SEQ ID NO: 104977 - DNA, 624 bp, Homo sapiens; identical to SEQ ID NO: 70215
  misc_feature 1..624: note = chr10:102998278-102998902
  misc_feature 1..624: note = Hyper
  source 1..624: mol_type = genomic DNA

SEQ ID NO: 104978 - DNA, 557 bp, Homo sapiens
  misc_feature 1..557: note = chr10:103043857-103044414
  misc_feature 1..557: note = Hyper
  source 1..557: mol_type = genomic DNA
gaggggagcggggagcgaggggcgggggaggggcgcctgcctgcgcacagcagatgttgccgctcctcggatggagctgttaatgtaagtggagtttctgcaatggtaattaggagggccctcattaccctggcggagccggctgagagccgataaagccgagggggagaagggccgacatcagggtaatgggggagcagggccattgaggagctggagccgagccggggaccgctccgcgcgcagctggagcccggcgagagggccgcggaaggggggtgcgaaccggggccggaccccggggaggagccgggaggcgagcggcgaggggcactgcgcggctgggtctgccccggggtttcgcactgcgccgcgggtcgaagtaccgcgagttggccctgactgtctgcaggatgagggtgtcgaggagggttccaggccagcgtgcctgcctcgcctccagcccggggtaaggagatccacggaggcctctgcgcctaaactcaggtggccagacagagttggggcgggaggcgggtatacggaaaggacaccct

SEQ ID NO: 104979 - DNA, 482 bp, Homo sapiens; identical to SEQ ID NO: 70219
  misc_feature 1..482: note = chr10:103051132-103051614
  misc_feature 1..482: note = Hyper
  source 1..482: mol_type = genomic DNA

SEQ ID NO: 104980 - DNA, 129 bp, Homo sapiens; identical to SEQ ID NO: 70220
  misc_feature 1..129: note = chr10:103052311-103052440
  misc_feature 1..129: note = Hyper
  source 1..129: mol_type = genomic DNA

SEQ ID NO: 104981 - DNA, 95 bp, Homo sapiens; identical to SEQ ID NO: 70221
  misc_feature 1..95: note = chr10:103052659-103052754
  misc_feature 1..95: note = Hyper
  source 1..95: mol_type = genomic DNA

SEQ ID NO: 104982 - DNA, 144 bp, Homo sapiens; identical to SEQ ID NO: 70222
  misc_feature 1..144: note = chr10:103106119-103106263
  misc_feature 1..144: note = Hypo
  source 1..144: mol_type = genomic DNA

SEQ ID NO: 104983 - DNA, 147 bp, Homo sapiens; identical to SEQ ID NO: 70223
  misc_feature 1..147: note = chr10:103198991-103199138
  misc_feature 1..147: note = Hypo
  source 1..147: mol_type = genomic DNA

SEQ ID NO: 104984 - DNA, 199 bp, Homo sapiens; identical to SEQ ID NO: 70224
  misc_feature 1..199: note = chr10:103326517-103326716
  misc_feature 1..199: note = Hyper
  source 1..199: mol_type = genomic DNA

SEQ ID NO: 104985 - DNA, 30 bp, Homo sapiens; identical to SEQ ID NO: 70225
  misc_feature 1..30: note = chr10:103533282-103533312
  misc_feature 1..30: note = Hyper
  source 1..30: mol_type = genomic DNA

SEQ ID NO: 104986 - DNA, 114 bp, Homo sapiens
  misc_feature 1..114: note = chr10:103534463-103534577
  misc_feature 1..114: note = Hyper
  source 1..114: mol_type = genomic DNA
acaagctaccttcagcgcgccttaccgaaggggtcgccgtcctctgccatggcgttgatgcgcttgttggccaggacctgcacgtgcttcccgctggtgcggctgtagagttgg

SEQ ID NO: 104987 - DNA, 600 bp, Homo sapiens; identical to SEQ ID NO: 33318
  misc_feature 1..600: note = chr10:103534896-103535496
  misc_feature 1..600: note = Hyper
  source 1..600: mol_type = genomic DNA

SEQ ID NO: 104988 - DNA, 206 bp, Homo sapiens
  misc_feature 1..206: note = chr10:103535710-103535916
  misc_feature 1..206: note = Hyper
  source 1..206: mol_type = genomic DNA
cgccgcgggaggacgcgctgagcagggcgcgagcggagagggtgcgggtgcgggaggccggcggcgatcacgacgcggctccgcgggtcccgtggaacgtcgtgctcgccgcgccgcaccgaatcgctgtgcgccgctgccggagccggtggccgctggctgctcgggagccggagcgggcgggagggtcacgggctggcggggtg

SEQ ID NO: 104989 - DNA, 391 bp, Homo sapiens
  misc_feature 1..391: note = chr10:103536127-103536518
  misc_feature 1..391: note = Hyper
  source 1..391: mol_type = genomic DNA
cgggaggggcgggggcggccggtctgggcgcctccccctatccccggcctgtcccctcgcgcgctccccggtcccggacgcgcggggatgggggcgcctagggctgcaaactctgcgggccgggagaccccgagcctgggcttccccgaccgcctggagcgcccgagtctggcgggtctgggtctccgcctccgggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccgtcctgtcggtctctccagtct

SEQ ID NO: 104990 - DNA, 50 bp, Homo sapiens
  misc_feature 1..50: note = chr10:103539248-103539298
  misc_feature 1..50: note = Hyper
  source 1..50: mol_type = genomic DNA
ttgcccagctgtgtccgcggggcgccccaaccggccgagaaactcttggg

SEQ ID NO: 104991 - DNA, 21 bp, Homo sapiens
  misc_feature 1..21: note = chr10:103548965-103548986
  misc_feature 1..21: note = Hypo
  source 1..21: mol_type = genomic DNA
gaaaatgaggccaggcgcggt

SEQ ID NO: 104992 - DNA, 79 bp, Homo sapiens; identical to SEQ ID NO: 70234
  misc_feature 1..79: note = chr10:103579758-103579837
  misc_feature 1..79: note = Hypo
  source 1..79: mol_type = genomic DNA

SEQ ID NO: 104993 - DNA, 90 bp, Homo sapiens; identical to SEQ ID NO: 70235
  misc_feature 1..90: note = chr10:103599532-103599622
  misc_feature 1..90: note = Hyper
  source 1..90: mol_type = genomic DNA

SEQ ID NO: 104994 - DNA, 253 bp, Homo sapiens
  misc_feature 1..253: note = chr10:103603249-103603502
  misc_feature 1..253: note = Hyper
  source 1..253: mol_type = genomic DNA
cacccgtgagctggtcgtaggagccgtccaggtctcgggaatcggacaaactctccttgcggccctggccccgcatggcccccggcgccccgctcccgcccgggccgtgggagggggcgccgggtggccgggatagggcgctcacacggcgccccctggcggcctactgtgctgtcggggctggggaagtccgggctgaggctgagtctgggaatgggcccggggtctgaggtctacccggaggtcctggagc

SEQ ID NO: 104995 - DNA, 30 bp, Homo sapiens; identical to SEQ ID NO: 42637
  misc_feature 1..30: note = chr10:103814237-103814267
  misc_feature 1..30: note = Hypo
  source 1..30: mol_type = genomic DNA

SEQ ID NO: 104996 - DNA, 18 bp, Homo sapiens
  misc_feature 1..18: note = chr10:103818196-103818214
  misc_feature 1..18: note = Hypo
  source 1..18: mol_type = genomic DNA
acacgaagagaaaaccca

SEQ ID NO: 104997 - DNA, 24 bp, Homo sapiens
  misc_feature 1..24: note = chr10:103897018-103897042
  misc_feature 1..24: note = Hypo
  source 1..24: mol_type = genomic DNA
ccaggagaccgaacccatgagtgt

SEQ ID NO: 104998 - DNA, 139 bp, Homo sapiens; identical to SEQ ID NO: 70240
  misc_feature 1..139: note = chr10:103930132-103930271
  misc_feature 1..139: note = Hypo
  source 1..139: mol_type = genomic DNA

SEQ ID NO: 104999 - DNA, 213 bp, Homo sapiens; identical to SEQ ID NO: 70241
  misc_feature 1..213: note = chr10:103986007-103986220
  misc_feature 1..213: note = Hyper
  source 1..213: mol_type = genomic DNA

SEQ ID NO: 105000 - DNA, 43 bp, Homo sapiens; identical to SEQ ID NO: 70242
  misc_feature 1..43: note = chr10:103991502-103991545
  misc_feature 1..43: note = Hyper
  source 1..43: mol_type = genomic DNA

SEQ ID NO: 105001 - DNA, 191 bp, Homo sapiens; identical to SEQ ID NO: 70243
  misc_feature 1..191: note = chr10:104000813-104001004
  misc_feature 1..191: note = Hyper
  source 1..191: mol_type = genomic DNA

SEQ ID NO: 105002 - DNA, 587 bp, Homo sapiens; identical to SEQ ID NO: 70244
  misc_feature 1..587: note = chr10:104001210-104001797
  misc_feature 1..587: note = Hyper
  source 1..587: mol_type = genomic DNA

SEQ ID NO: 105003 - DNA, 30 bp, Homo sapiens; identical to SEQ ID NO: 70245
  misc_feature 1..30: note = chr10:104086676-104086706
  misc_feature 1..30: note = Hypo
  source 1..30: mol_type = genomic DNA

SEQ ID NO: 105004 - DNA, 83 bp, Homo sapiens; identical to SEQ ID NO: 70246
  misc_feature 1..83: note = chr10:104160053-104160136
  misc_feature 1..83: note = Hypo
  source 1..83: mol_type = genomic DNA

SEQ ID NO: 105005 - DNA, 114 bp, Homo sapiens; identical to SEQ ID NO: 70247
  misc_feature 1..114: note = chr10:104161655-104161769
  misc_feature 1..114: note = Hypo
  source 1..114: mol_type = genomic DNA

SEQ ID NO: 105006 - DNA, 276 bp, Homo sapiens; identical to SEQ ID NO: 70248
  misc_feature 1..276: note = chr10:104168609-104168885
  misc_feature 1..276: note = Hyper
  source 1..276: mol_type = genomic DNA

SEQ ID NO: 105007 - DNA, 83 bp, Homo sapiens; identical to SEQ ID NO: 70249
  misc_feature 1..83: note = chr10:104169160-104169243
  misc_feature 1..83: note = Hyper
  source 1..83: mol_type = genomic DNA

SEQ ID NO: 105008 - DNA, 825 bp, Homo sapiens
  misc_feature 1..825: note = chr10:104170037-104170862
  misc_feature 1..825: note = Hyper
  source 1..825: mol_type = genomic DNA
gggccatggagctggcgcctgggaacgggacctgctcacagggagccagaaagcagtttctagctccagctttgcgctaactcgctgccagaccttggaaaagcttagtccctctcaggcccctctccctccgggttcctgcagcgcagcagcaccgggaaggtctttttggctgtccacgcggcgggggagcagtgtggagtgtacccccatccaatccctgtcccgtgcagggacccccgcaactcccgccttccaccccagcgcacactggaggaggggaactgaaggcaaacgcaggggccggggccgcctgctcgcgttttccagagccgggtcccctcccccgccgtgcgcagtcgcgaccgcacgcatgtgcgcatgttccgggagagcctgcgcgtggggcctggggagggggcggtccccaggctgagtcacgagagcccgggcttccgtggcaggagccgggggtcggcaagccccagccctgccctccctccgactctggactccgtcgccgactgggtcctccatccttcccctccagcgacttctaccctgccccgccccccaccttgagcagctccctagggaagtcgccgccatcattgaggccctccaggttcccgatgaagtccccgcaggtcatgcgcttcccgatgttctaaggaagggaacggaggcctgtgagtttggagggcccttggcctcccaggtcctgcatgtctggccaggggtttgttttccggctcctgcccgcccgcctccactcacatggccgtggagatccgtgttgagcagcatgagcgcacaggtcagcgt

SEQ ID NO: 105009 - DNA, 64 bp, Homo sapiens; identical to SEQ ID NO: 70253
  misc_feature 1..64: note = chr10:104416998-104417062
  misc_feature 1..64: note = Hypo
  source 1..64: mol_type = genomic DNA

SEQ ID NO: 105010 - DNA, 115 bp, Homo sapiens; identical to SEQ ID NO: 70254
  misc_feature 1..115: note = chr10:104629233-104629348
  misc_feature 1..115: note = Hyper
  source 1..115: mol_type = genomic DNA

SEQ ID NO: 105011 - DNA, 167 bp, Homo sapiens; identical to SEQ ID NO: 70255
  misc_feature 1..167: note = chr10:104679009-104679176
  misc_feature 1..167: note = Hyper
  source 1..167: mol_type = genomic DNA

SEQ ID NO: 105012 - DNA, 213 bp, Homo sapiens; identical to SEQ ID NO: 70256
  misc_feature 1..213: note = chr10:104758202-104758415
  misc_feature 1..213: note = Hypo
  source 1..213: mol_type = genomic DNA

SEQ ID NO: 105013 - DNA, 81 bp, Homo sapiens; identical to SEQ ID NO: 70257
  misc_feature 1..81: note = chr10:104812055-104812136
  misc_feature 1..81: note = Hypo
  source 1..81: mol_type = genomic DNA

SEQ ID NO: 105014 - DNA, 124 bp, Homo sapiens; identical to SEQ ID NO: 70258
  misc_feature 1..124: note = chr10:104823124-104823248
  misc_feature 1..124: note = Hypo
  source 1..124: mol_type = genomic DNA

SEQ ID NO: 105015 - DNA, 30 bp, Homo sapiens; identical to SEQ ID NO: 70259
  misc_feature 1..30: note = chr10:104835453-104835483
  misc_feature 1..30: note = Hypo
  source 1..30: mol_type = genomic DNA

SEQ ID NO: 105016 - DNA, 30 bp, Homo sapiens; identical to SEQ ID NO: 70260
  misc_feature 1..30: note = chr10:104953416-104953446
  misc_feature 1..30: note = Hypo
  source 1..30: mol_type = genomic DNA

SEQ ID NO: 105017 - DNA, 1616 bp, Homo sapiens
  misc_feature 1..1616: note = chr10:105036450-105038066
  misc_feature 1..1616: note = Hyper
  source 1..1616: mol_type = genomic DNA
gtaactggaaaaacacgacctcgccctcgggaaggctttctgtgcgcctcacctcaggatgagggtgggtgtaggggacacctcccagaaacccctaacctcccagtcggttaaagaagaggggatagggtcaagggatgcgacagagctgtgtggtttccggatgggaaacctcagtcgtttaggcacccctccgctcgagtcacttccgaagcagtcgattcttggggagaagcgctgcggaaaggggcgactccgatgcagatggccctgtcccggcgccccaggtcgtcgcgcgcgcagctgcggtagtcactgcgcctccccgcccccactcctggatgccccccttccctctcccggccagactctgagcaggagctccgcccccagcgcgccgccccagccccggcgccttaaaagccgggcgcaccgccccgccgcgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagccgcgaggagatccacgagtatcggcgccagctgcaggcgcgcaccatcgagatcgagggcctgcgcggggccaacgagtccttggagaggcagatcctggagctggaggagcggcacagtgccgaggtagctggctaccaggtaagggccggggctgggcgtggggaggggtgc

SEQ ID NO: 105018 - DNA, 37 bp, Homo sapiens; identical to SEQ ID NO: 70266
  misc_feature 1..37: note = chr10:105038717-105038754
  misc_feature 1..37: note = Hyper
  source 1..37: mol_type = genomic DNA

SEQ ID NO: 105019 - DNA, 171 bp, Homo sapiens; identical to SEQ ID NO: 70267
  misc_feature 1..171: note = chr10:105041598-105041769
  misc_feature 1..171: note = Hyper
  source 1..171: mol_type = genomic DNA

SEQ ID NO: 105020 - DNA, 28 bp, Homo sapiens
  misc_feature 1..28: note = chr10:105119651-105119679
  misc_feature 1..28: note = Hypo
  source 1..28: mol_type = genomic DNA
aaaattgaacacagccgggcgtggtggc

SEQ ID NO: 105021 - DNA, 40 bp, Homo sapiens; identical to SEQ ID NO: 70269
  misc_feature 1..40: note = chr10:105127036-105127076
  misc_feature 1..40: note = Hypo
  source 1..40: mol_type = genomic DNA

SEQ ID NO: 105022 - DNA, 157 bp, Homo sapiens; identical to SEQ ID NO: 70270
  misc_feature 1..157: note = chr10:105155377-105155534
  misc_feature 1..157: note = Hypo
  source 1..157: mol_type = genomic DNA

SEQ ID NO: 105023 - DNA, 175 bp, Homo sapiens
  misc_feature 1..175: note = chr10:105344345-105344520
  misc_feature 1..175: note = Hyper
  source 1..175: mol_type = genomic DNA
cggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcg

SEQ ID NO: 105024 - DNA, 332 bp, Homo sapiens; identical to SEQ ID NO: 70271
  misc_feature 1..332: note = chr10:105413585-105413917
  misc_feature 1..332: note = Hypo
  source 1..332: mol_type = genomic DNA

SEQ ID NO: 105025 - DNA, 56 bp, Homo sapiens; identical to SEQ ID NO: 70272
  misc_feature 1..56: note = chr10:105615662-105615718
  misc_feature 1..56: note = Hyper
  source 1..56: mol_type = genomic DNA

SEQ ID NO: 105026 - DNA, 30 bp, Homo sapiens; identical to SEQ ID NO: 70273
  misc_feature 1..30: note = chr10:105632567-105632597
  misc_feature 1..30: note = Hypo
  source 1..30: mol_type = genomic DNA

SEQ ID NO: 105027 - DNA, 38 bp, Homo sapiens; identical to SEQ ID NO: 70274
  misc_feature 1..38: note = chr10:105725883-105725921
  misc_feature 1..38: note = Hypo
  source 1..38: mol_type = genomic DNA

SEQ ID NO: 105028 - DNA, 30 bp, Homo sapiens; identical to SEQ ID NO: 42647
  misc_feature 1..30: note = chr10:105796706-105796736
  misc_feature 1..30: note = Hypo
  source 1..30: mol_type = genomic DNA

SEQ ID NO: 105029 - DNA, 30 bp, Homo sapiens; identical to SEQ ID NO: 70276
  misc_feature 1..30: note = chr10:105993190-105993220
  misc_feature 1..30: note = Hypo
  source 1..30: mol_type = genomic DNA

SEQ ID NO: 105030 - DNA, 44 bp, Homo sapiens; identical to SEQ ID NO: 70277
  misc_feature 1..44: note = chr10:106014312-106014356
  misc_feature 1..44: note = Hyper
  source 1..44: mol_type = genomic DNA

SEQ ID NO: 105031 - DNA, 30 bp, Homo sapiens; identical to SEQ ID NO: 70278
  misc_feature 1..30: note = chr10:106030700-106030730
  misc_feature 1..30: note = Hypo
  source 1..30: mol_type = genomic DNA

SEQ ID NO: 105032 - DNA, 55 bp, Homo sapiens; identical to SEQ ID NO: 70279
  misc_feature 1..55: note = chr10:106034596-106034651
  misc_feature 1..55: note = Hyper
  source 1..55: mol_type = genomic DNA

SEQ ID NO: 105033 - DNA, 30 bp, Homo sapiens
  misc_feature 1..30: note = chr10:106113431-106113461
  misc_feature 1..30: note = Hyper
  source 1..30: mol_type = genomic DNA
tgcccaggtgccagccgcagaagctcctcc

SEQ ID NO: 105034 - DNA, 30 bp, Homo sapiens; identical to SEQ ID NO: 70281
  misc_feature 1..30: note = chr10:106160593-106160623
  misc_feature 1..30: note = Hypo
  source 1..30: mol_type = genomic DNA

SEQ ID NO: 105035 - DNA, 80 bp, Homo sapiens; identical to SEQ ID NO: 70282
  misc_feature 1..80: note = chr10:106348683-106348763
  misc_feature 1..80: note = Hypo
  source 1..80: mol_type = genomic DNA

SEQ ID NO: 105036 - DNA, 430 bp, Homo sapiens
  misc_feature 1..430: note = chr10:106398552-106398982
  misc_feature 1..430: note = Hyper
  source 1..430: mol_type = genomic DNA
ctcctgctcagaggccgcgggaagctgcggggactggatggtgcacctccccagtgcgcataggacttgggagaccacactcctccgggctgtgtgagcctcgggtccgcccagatctcttatactgtggcacctccgcccagagcctgaagagaagagcagcaccgcgtccctcccgaaccccgagcttcggctcgggctgcagcgccgggcctcctccggcaggggcgctgggaactcgcggatggccggctctcgtccagcgcccgatcccgcgcccacctgggcctgcggcgctggaacttttcttaggaatacccgctactccctgtctttggaaacccacagatgccaggacccgcaccattctgggccggacgttgtcgctggcttggttctttggcccagcctcccccgctgctaattgcca

SEQ ID NO: 105037 - DNA, 3519 bp, Homo sapiens
  misc_feature 1..3519: note = chr10:106399306-106402825
  misc_feature 1..3519: note = Hyper
  source 1..3519: mol_type = genomic DNA
aactctatctactcccgaaggggaggagcagggctggaggctgtctctctctccctaagcctcctccctcctgcctcctcctttcttaatagctcctcctctagctcctctagtctcagacttttcaacccctagaatcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggatctcagctgcaccaagcgcgcaggctacactcctgcagtagcggattggggaccagataagcccacgcggctcccgcctgagtaccctcttaactggcggccgacactttgaaacaattgagtccgttcagaaacggactggggagagtgagggcacgacctcaaaatcctaggcagcaaaatgaggtctggatcctccctggaagaacagacatctcgactactctctcgccccacctctggccgggaggtcggggcaaggagaatccctcaaccgagaagatctggcaagtccccgatcccaccggggccttccgcctcttttccctcatcccctaggaggctttatcaggttctaaccgcttgtagtgggggccgtgggtgctcggggcgccaagaggagggggctgccgagagcggcctgcctagttctcagcattgcctctttgaccactcgcaggctcctggaaatgcaaacacagcccgtgcgtgatccgcacgcgaccaaaagccgagcgcacacctcccgcccccgccccacttgccatcgctcacactaacgtgcacacatgctcgtgcaaacgcgcacgcacggaaccgcgcgccccctcacacccagccgcgctcccggcccggctcagccaggtgcccccacgcggcagcgcccggtctgcccgccggccccctgcgaacccctcgcctcacgcccgcctgcctgcgcgcacgcacgcgcacgcacgcattccccacgcccccgcgcgggggcgcaggccttgggtggcggggtttggccgggagccggccgggccagggagcggcgagcagagtccagggtgcatcccgcgcttggcttccgtgcgcagcctccccgcgcggaggcacctggctccctctcggctctagaacgcgaacagttggcgttgagcacacaactcctcctccttctcccccgagacccctgtaccctccccgcgcgccatctcccgcccctcataacaggcccgaagagtaaacccccaaacgcgtccagaagcggctcccaactcttcgccgggagcacgttggaggctggatttcggagagactcgggattggggtctattgccggcccctcctggatccggcttgattttcatattttaagaagattttcttattacctttgattactcctttttaccaaatttctggaggagctcagtggggaggattggggggaatctgattttaagaaagaaagcaccgaaggggcaattattaattttcctcgggtttggaatcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtgagtacccacccggcggcgggtccgcctgtttcctgacaccgaaggggaatgggggggtgggtgggagcgagggacagatagttgctcgggggtcgaggcgggggacgcctcgacttttcgagataacaggtttgtccgattccccccacgcccccaacaggttaacggagtttgttgttagacgctgtgtgtgtttgtttactggagaccctaggcttcggccgccgggaggggagtggaggaaggggcttcttaaagatgagtgggggagggatctgtgctcactttctccaatacttggcttggagggtcagttttcctgtttgcggggtgcttgaattcttggatgagaaaaagggctgacttggggcgggagccgctgaacagaccgattcctgcggctgccgggctccccctacccccaccccacccccaccccccctcccgtcacgcgaaagggaacccggaaggccattcggactcccagcctcctgctcgcctcggggtcgctgctatccgctccaggcgcgcagtcctccagcccaagagggaggctcggccaagtcggcccccagccttggccttcaggtaaccccggttcctccttcaaagtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggaggggctccccctacctcgccggcacccagcgctgtgcagccaagcaaagaaaaggcgggggacaggttcccaccatctccccgacttccctccctcccgcggtccctactagag

SEQ ID NO: 105038 - DNA, 61 bp, Homo sapiens; identical to SEQ ID NO: 70291
  misc_feature 1..61: note = chr10:106440762-106440823
  misc_feature 1..61: note = Hyper
  source 1..61: mol_type = genomic DNA

SEQ ID NO: 105039 - DNA, 21 bp, Homo sapiens
  misc_feature 1..21: note = chr10:108522437-108522458
  misc_feature 1..21: note = Hypo
  source 1..21: mol_type = genomic DNA
agccaccgtgcccagcctatt

SEQ ID NO: 105040 - DNA, 27 bp, Homo sapiens
  misc_feature 1..27: note = chr10:108561564-108561591
  misc_feature 1..27: note = Hypo
  source 1..27: mol_type = genomic DNA
ggcgtgagccaccgtgcccagctagta

SEQ ID NO: 105041 - DNA, 143 bp, Homo sapiens; identical to SEQ ID NO: 42649
  misc_feature 1..143: note = chr10:108578381-108578524
  misc_feature 1..143: note = Hypo
  source 1..143: mol_type = genomic DNA

SEQ ID NO: 105042 - DNA, 20 bp, Homo sapiens
  misc_feature 1..20: note = chr10:108755052-108755072
  misc_feature 1..20: note = Hypo
  source 1..20: mol_type = genomic DNA
cagagcgagactccatctca

SEQ ID NO: 105043 - DNA, 1110 bp, Homo sapiens
  misc_feature 1..1110: note = chr10:108923771-108924881
  misc_feature 1..1110: note = Hyper
  source 1..1110: mol_type = genomic DNA
tgagtctcccgtcagcgcaaacgtggtgctggtcagtctcagctcctccatccggaagcgggtggctttgtccgggtcccgctcccgagtcccaggctcctgctgccctccatctcttagcactccccgggggctccgactcgcgccctctccccgttctgccttctcctgatccgctccgctccgtctcctccggccggagcgtgcagcaaccgccatggatgccccagtgccccgagcccgctccagggatagcgctcggtccccgggggccactgagaacaggggacgcactacgaggggcaggggcgtggcaggagccctgcctggccgcccctggtgggaaaagcccctaggggtcgaggccgagcgtggagcggagctggggtgcggcgaggggcagcaggagccgccgccgcagacgcccggggcgcagaggatcaagagccccgcgccggcgaggagcgcgctcagccgggcttgggagccgccgccggcgccaacttttcccatcgcgggagcgaagagcagcggagagaggggtcccagaacgaaggtggcggcacgagctctgcgctggcggctgtggggggccggcgctcaggaccccaactccatccaagttgcgccgcggtgggggcgggcggaggcggcgccgggcaggtggcggccgcttgcccgggctgggcttgtgccgagcgcgggtccggacggagcgagccgccgccgcgcgggggtggagctgagctgaagtcactggcggagcgggcgcgggcgctggcgggcgacgcgggagggagggcaggcgctgccgggactccgggcgccgcgtcccgcggccgagctgcgctgcgcaccgggtctccgggcgctggaggcgccgccggcgacctcccctcggcctcgcaggcgctgccgccgcctctccccgccgcccactctgcgcccccgcggccgcgggtcccggcgctgagtccgcgcaccctgcccgcgggggcggtcgaccccgggctcccggagcagtcgatgtgtcgggagcttcctattcctgctttattgtttctatgagtctatgttgctgtttccttttttctccgtctttctggtctt

SEQ ID NO: 105044 - DNA, 791 bp, Homo sapiens
  misc_feature 1..791: note = chr10:109674181-109674972
  misc_feature 1..791: note = Hyper
  source 1..791: mol_type = genomic DNA
ttcacactccctccccgcttcgctccccgaccccaccccatcaccactctgctactcgcaacgctgcctggtcgcacccaggaaccatctttgtgggtggggttcctcgtctccgcggacaggctgctagtgagccgcagctcctccatccggaagccagggatcttcatcttgccgcggagttccatgctgccgtcgcccccagtcttcagggactttgcgctcccgcaggctcctgctcacctctcccatcgttgggcgctggtggcaccccaggaggagagaggagcagcaggagcccggtctcgcagtgccggcacggacagtactctgggggtctgggccgcgtgccacgaggagcagaggagccaccggagccgcttccgcagacgccctgacacggaggacccagagcgccgcgccgcgccgccgaggaacgcgctcaccggcgccaaattttcccatcccgggagcgagggcggcggcgaagggtccgggacccgaggtggcggcgcggggctctgcgcgggcggctgtgggtgctggagctcaggaccctaactttagcgaagtcgggccgcggcggggcgggtggaggcggcgtgggcaggggctgccgcaggtgcggagtgaggcgccgccacacgggcgggggcaggagtctcaggaactcggcagccgccagcagagcccggtgcgggaccgggagctgccggggcctcagctccgctctccccacagctctccgtggctgcaggttgaggtcgaactgcaagcgccacggaccctgc

SEQ ID NO: 105045 - DNA, 30 bp, Homo sapiens; identical to SEQ ID NO: 70311
  misc_feature 1..30: note = chr10:109675175-109675205
  misc_feature 1..30: note = Hyper
  source 1..30: mol_type = genomic DNA

SEQ ID NO: 105046 - DNA, 22 bp, Homo sapiens
  misc_feature 1..22: note = chr10:110168394-110168416
  misc_feature 1..22: note = Hypo
  source 1..22: mol_type = genomic DNA
tttgtataaaattaacgggcgg

SEQ ID NO: 105047 - DNA, 22 bp, Homo sapiens
  misc_feature 1..22: note = chr10:110168716-110168738
  misc_feature 1..22: note = Hypo
  source 1..22: mol_type = genomic DNA
aaattaacgggcaaaagtgcaa

SEQ ID NO: 105048 - DNA, 410 bp, Homo sapiens
  misc_feature 1..410: note = chr10:110225912-110226322
  misc_feature 1..410: note = Hyper
  source 1..410: mol_type = genomic DNA
tctcctgcacctggtcgcggtggcgcgcccccatctcccgctgaaacccagaactttcggttcagcagggctgggaagcagccgccggcgcccacttttcccaccgcgggggcggagaacagcagagaggggtcccagaccgaaggtggcagcgcgtggctctgcgctggcggctgtggggggcaggcgctcaggaccccaattccctccaagttgggccgcggtgggggcgggtggaggtggcgccgggcagctggcggccgctcgctggggctgggtttgtgccgagcgcgagtctggaaggagcgagccgcagccgcgcgggggtggagccgaactgaagtcactggctgagcaggcacgggcgctggcgggcacgcgggaaggagggcggccgatgccaggtctcc

SEQ ID NO: 105049 - DNA, 233 bp, Homo sapiens; identical to SEQ ID NO: 70315
  misc_feature 1..233: note = chr10:110408434-110408667
  misc_feature 1..233: note = Hypo
  source 1..233: mol_type = genomic DNA

SEQ ID NO: 105050 - DNA, 786 bp, Homo sapiens
  misc_feature 1..786: note = chr10:110671647-110672433
  misc_feature 1..786: note = Hyper
  source 1..786: mol_type = genomic DNA
gtgtcttactccttccgtccagggcattccgcagactcctgctcccttcttcctctccacttgctctcaatagagggcgcgctgggcgaagtaggggcgtggcaggagccccgctccgcggatccaggttgaaattcctccctcctggaatccgaccgtgagcatttctgagcggtggtgaggaggaggccaccaagacacctccctcccgctgtgcaaaggaacgcaggagcccggcgcaggtggtgggcttaccgcgcgcacgcctggctggagaggtgacgccgctgtctgccaacctttcccagcttttcccacgattggagccaagagaggtccccggggatctcagttgggcaattgtaagggaaggagctcaggacactgacttcaagatgaagggggaggtcagcgaagacagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggaccccggctgcgcgcggatcgcctgcgccactgtccccactgacccgcccgccgggtttgccaattaccagcgccacctggtcccgcacccaaccccacattttctctgtcaagggcttgtttccagggctccaggaactttcaaaatgttattggtgtgtgtcgggggggtggggggcgggggggttgtgtg

SEQ ID NO: 105051 - DNA, 890 bp, Homo sapiens
  misc_feature 1..890: note = chr10:111216345-111217235
  misc_feature 1..890: note = Hyper
  source 1..890: mol_type = genomic DNA
agatgtgcagagagtcgcctgtcggagcaaatgtgacgctgattggcttcagctccccagctgcaaatgggtagctttgccggggtttctctcttgagctccaggcactctcaaggatccggttcatgtcttcgccctggcccgcttggtatagggggcgcacaggaagaggccaagaagtggaaagaacctcatctcgatgtcccaagtgacaaagcccccggggctcggggctttggtacagaggagcagcagaagccgccgccgcagacgcccggatgcggaggacccagagcgctgcgcagctgaggagcacctggggagccaccgccggcgccaacttttgccatcccgggagccatagcggcagagagggggtcccggacccgaggtggcagcgaggggctctgctttggcagctgtcggggctggagctcaggaccccaactccagccaagtcgggccgcggcggggcaggcgtaggctgcgcaggcaggggtggccgcgggtgctgagccagtcgccgccgcgcaggcgggcgctggagtctcagctacctggcgcgaccgccagcagcacccagcgcggggccgggagctgctgggggcccaggctccgctctccccaccgctctgcaccgctgccggctgcggacagacccgatgcgccaccaccaccgcagttgccacgacccccatggaatcgctggcgcctccgctccggttctctaacccggcgcactctgggatcccaaagcttgccgtgggttggaggcttcctactctttgtgcgttgaggctttgacctgacccagagcgcagcttatgccctggcttgggcagaaaataatattaattactgatcctttgtgctcccggtcctggcttcct

SEQ ID NO: 105052 - DNA, 30 bp, Homo sapiens; identical to SEQ ID NO: 70326
  misc_feature 1..30: note = chr10:111610387-111610417
  misc_feature 1..30: note = Hypo
  source 1..30: mol_type = genomic DNA

SEQ ID NO: 105053 - DNA, 23 bp, Homo sapiens
  misc_feature 1..23: note = chr10:111674541-111674564
  misc_feature 1..23: note = Hypo
  source 1..23: mol_type = genomic DNA
cgagactccgtctcaaaaaaaaa

SEQ ID NO: 105054 - DNA, 143 bp, Homo sapiens; identical to SEQ ID NO: 70328
  misc_feature 1..143: note = chr10:111902760-111902903
  misc_feature 1..143: note = Hypo
  source 1..143: mol_type = genomic DNA

SEQ ID NO: 105055 - DNA, 30 bp, Homo sapiens; identical to SEQ ID NO: 70329
  misc_feature 1..30: note = chr10:111912926-111912956
  misc_feature 1..30: note = Hypo
  source 1..30: mol_type = genomic DNA

SEQ ID NO: 105056 - DNA, 30 bp, Homo sapiens; identical to SEQ ID NO: 70330
  misc_feature 1..30: note = chr10:111921592-111921622
  misc_feature 1..30: note = Hypo
  source 1..30: mol_type = genomic DNA

SEQ ID NO: 105057 - DNA, 33 bp, Homo sapiens; identical to SEQ ID NO: 42652
  misc_feature 1..33: note = chr10:111946090-111946123
  misc_feature 1..33: note = Hypo
  source 1..33: mol_type = genomic DNA

SEQ ID NO: 105058 - DNA, 23 bp, Homo sapiens
  misc_feature 1..23: note = chr10:111954352-111954375
  misc_feature 1..23: note = Hypo
  source 1..23: mol_type = genomic DNA
tgttgtacttttggccgggcgcg

SEQ ID NO: 105059 - DNA, 32 bp, Homo sapiens; identical to SEQ ID NO: 42653
  misc_feature 1..32: note = chr10:111979836-111979868
  misc_feature 1..32: note = Hypo
  source 1..32: mol_type = genomic DNA

SEQ ID NO: 105060 - DNA, 30 bp, Homo sapiens; identical to SEQ ID NO: 70334
  misc_feature 1..30: note = chr10:111988079-111988109
  misc_feature 1..30: note = Hypo
  source 1..30: mol_type = genomic DNA

SEQ ID NO: 105061 - DNA, 18 bp, Homo sapiens
  misc_feature 1..18: note = chr10:112030553-112030571
  misc_feature 1..18: note = Hypo
  source 1..18: mol_type = genomic DNA
aaaaaaggtgttggccgg

SEQ ID NO: 105062 - DNA, 39 bp, Homo sapiens; identical to SEQ ID NO: 70339
  misc_feature 1..39: note = chr10:112079204-112079243
  misc_feature 1..39: note = Hypo
  source 1..39: mol_type = genomic DNA

SEQ ID NO: 105063 - DNA, 94 bp, Homo sapiens
  misc_feature 1..94: note = chr10:112257148-112257242
  misc_feature 1..94: note = Hyper
  source 1..94: mol_type = genomic DNA
ctataccccacccctcgaggcaaatctccgacgtcctctccttacacgcgcagacctcggtagcgacgggaatccgttccggactcctctgggg

SEQ ID NO: 105064 - DNA, 169 bp, Homo sapiens; identical to SEQ ID NO: 70342
  misc_feature 1..169: note = chr10:112257809-112257978
  misc_feature 1..169: note = Hyper
  source 1..169: mol_type = genomic DNA

SEQ ID NO: 105065 - DNA, 77 bp, Homo sapiens; identical to SEQ ID NO: 70343
  misc_feature 1..77: note = chr10:112258331-112258408
  misc_feature 1..77: note = Hyper
  source 1..77: mol_type = genomic DNA

SEQ ID NO: 105066 - DNA, 1047 bp, Homo sapiens; identical to SEQ ID NO: 70344
  misc_feature 1..1047: note = chr10:112402947-112403994
  misc_feature 1..1047: note = Hyper
  source 1..1047: mol_type = genomic DNA

SEQ ID NO: 105067 - DNA, 338 bp, Homo sapiens; identical to SEQ ID NO: 70345
  misc_feature 1..338: note = chr10:112404226-112404564
  misc_feature 1..338: note = Hyper
  source 1..338: mol_type = genomic DNA

SEQ ID NO: 105068 - DNA, 253 bp, Homo sapiens; identical to SEQ ID NO: 33363
  misc_feature 1..253: note = chr10:112431872-112432125
  misc_feature 1..253: note = Hyper
  source 1..253: mol_type = genomic DNA

SEQ ID NO: 105069 - DNA, 79 bp, Homo sapiens; identical to SEQ ID NO: 33364
  misc_feature 1..79: note = chr10:112432360-112432439
  misc_feature 1..79: note = Hyper
  source 1..79: mol_type = genomic DNA

SEQ ID NO: 105070 - DNA, 30 bp, Homo sapiens; identical to SEQ ID NO: 70348
  misc_feature 1..30: note = chr10:112440386-112440416
  misc_feature 1..30: note = Hypo
  source 1..30: mol_type = genomic DNA

SEQ ID NO: 105071 - DNA, 79 bp, Homo sapiens; identical to SEQ ID NO: 42655
  misc_feature 1..79: note = chr10:112524488-112524567
  misc_feature 1..79: note = Hypo
  source 1..79: mol_type = genomic DNA

SEQ ID NO: 105072 - DNA, 161 bp, Homo sapiens; identical to SEQ ID NO: 70350
  misc_feature 1..161: note = chr10:112553605-112553766
  misc_feature 1..161: note = Hypo
  source 1..161: mol_type = genomic DNA

SEQ ID NO: 105073 - DNA, 88 bp, Homo sapiens; identical to SEQ ID NO: 70351
  misc_feature 1..88: note = chr10:112582575-112582663
  misc_feature 1..88: note = Hypo
  source 1..88: mol_type = genomic DNA

SEQ ID NO: 105074 - DNA, 63 bp, Homo sapiens; identical to SEQ ID NO: 70352
  misc_feature 1..63: note = chr10:112590867-112590930
  misc_feature 1..63: note = Hypo
  source 1..63: mol_type = genomic DNA

SEQ ID NO: 105075 - DNA, 77 bp, Homo sapiens; identical to SEQ ID NO: 70353
  misc_feature 1..77: note = chr10:112836722-112836799
  misc_feature 1..77: note = Hyper
  source 1..77: mol_type = genomic DNA

SEQ ID NO: 105076 - DNA, 32 bp, Homo sapiens; identical to SEQ ID NO: 70354
  misc_feature 1..32: note = chr10:112837138-112837170
  misc_feature 1..32: note = Hyper
  source 1..32: mol_type = genomic DNA

SEQ ID NO: 105077 - DNA, 83 bp, Homo sapiens; identical to SEQ ID NO: 15387
  misc_feature 1..83: note = chr10:113623006-113623089
  misc_feature 1..83: note = Hypo
  source 1..83: mol_type = genomic DNA

SEQ ID NO: 105078 - DNA, 45 bp, Homo sapiens; identical to SEQ ID NO: 70361
  misc_feature 1..45: note = chr10:113748400-113748445
  misc_feature 1..45: note = Hypo
  source 1..45: mol_type = genomic DNA

SEQ ID NO: 105079 - DNA, 39 bp, Homo sapiens; identical to SEQ ID NO: 70366
  misc_feature 1..39: note = chr10:114571159-114571198
  misc_feature 1..39: note = Hypo
  source 1..39: mol_type = genomic DNA

SEQ ID NO: 105080 - DNA, 39 bp, Homo sapiens; identical to SEQ ID NO: 70367
  misc_feature 1..39: note = chr10:114571498-114571537
  misc_feature 1..39: note = Hypo
  source 1..39: mol_type = genomic DNA

SEQ ID NO: 105081 - DNA, 346 bp, Homo sapiens; identical to SEQ ID NO: 70368
  misc_feature 1..346: note = chr10:114712100-114712446
  misc_feature 1..346: note = Hyper
  source 1..346: mol_type = genomic DNA

SEQ ID NO: 105082 - DNA, 43 bp, Homo sapiens; identical to SEQ ID NO: 70370
  misc_feature 1..43: note = chr10:114752064-114752107
  misc_feature 1..43: note = Hypo
  source 1..43: mol_type = genomic DNA

SEQ ID NO: 105083 - DNA, 213 bp, Homo sapiens; identical to SEQ ID NO: 42662
  misc_feature 1..213: note = chr10:114829478-114829691
  misc_feature 1..213: note = Hypo
  source 1..213: mol_type = genomic DNA

SEQ ID NO: 105084 - DNA, 30 bp, Homo sapiens; identical to SEQ ID NO: 42663
  misc_feature 1..30: note = chr10:115479125-115479155
  misc_feature 1..30: note = Hypo
  source 1..30: mol_type = genomic DNA

SEQ ID NO: 105085 - DNA, 43 bp, Homo sapiens; identical to SEQ ID NO: 70375
  misc_feature 1..43: note = chr10:115585285-115585328
  misc_feature 1..43: note = Hypo
  source 1..43: mol_type = genomic DNA

SEQ ID NO: 105086 - DNA, 54 bp, Homo sapiens; identical to SEQ ID NO: 70377
  misc_feature 1..54: note = chr10:115803627-115803681
  misc_feature 1..54: note = Hyper
  source 1..54: mol_type = genomic DNA

SEQ ID NO: 105087 - DNA, 249 bp, Homo sapiens; identical to SEQ ID NO: 70378
  misc_feature 1..249: note = chr10:115804010-115804259
  misc_feature 1..249: note = Hyper
  source 1..249: mol_type = genomic DNA

SEQ ID NO: 105088 - DNA, 748 bp, Homo sapiens
  misc_feature 1..748: note = chr10:115804539-115805287
  misc_feature 1..748: note = Hyper
  source 1..748: mol_type = genomic DNA
gacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagc

SEQ ID NO: 105089 - DNA, 34 bp, Homo sapiens; identical to SEQ ID NO: 15388
  misc_feature 1..34: note = chr10:115844821-115844855
  misc_feature 1..34: note = Hypo
  source 1..34: mol_type = genomic DNA

SEQ ID NO: 105090 - DNA, 147 bp, Homo sapiens; identical to SEQ ID NO: 70382
  misc_feature 1..147: note = chr10:115999036-115999183
  misc_feature 1..147: note = Hyper
  source 1..147: mol_type = genomic DNA

SEQ ID NO: 105091 - DNA, 44 bp, Homo sapiens; identical to SEQ ID NO: 70383
  misc_feature 1..44: note = chr10:116045978-116046022
  misc_feature 1..44: note = Hypo
  source 1..44: mol_type = genomic DNA

SEQ ID NO: 105092 - DNA, 162 bp, Homo sapiens; identical to SEQ ID NO: 70384
  misc_feature 1..162: note = chr10:116061168-116061330
  misc_feature 1..162: note = Hypo
  source 1..162: mol_type = genomic DNA

SEQ ID NO: 105093 - DNA, 30 bp, Homo sapiens; identical to SEQ ID NO: 70385
  misc_feature 1..30: note = chr10:116064482-116064512
  misc_feature 1..30: note = Hyper
  source 1..30: mol_type = genomic DNA

SEQ ID NO: 105094 - DNA, 477 bp, Homo sapiens; identical to SEQ ID NO: 70386
  misc_feature 1..477: note = chr10:116163144-116163621
  misc_feature 1..477: note = Hyper
  source 1..477: mol_type = genomic DNA

SEQ ID NO: 105095 - DNA, 30 bp, Homo sapiens; identical to SEQ ID NO: 70387
  misc_feature 1..30: note = chr10:116163889-116163919
  misc_feature 1..30: note = Hyper
  source 1..30: mol_type = genomic DNA

SEQ ID NO: 105096 - DNA, 238 bp, Homo sapiens; identical to SEQ ID NO: 70388
  misc_feature 1..238: note = chr10:116164126-116164364
  misc_feature 1..238: note = Hyper
  source 1..238: mol_type = genomic DNA

SEQ ID NO: 105097 - DNA, 80 bp, Homo sapiens; identical to SEQ ID NO: 70389
  misc_feature 1..80: note = chr10:116164574-116164654
  misc_feature 1..80: note = Hyper
  source 1..80: mol_type = genomic DNA

SEQ ID NO: 105098 - DNA, 72 bp, Homo sapiens; identical to SEQ ID NO: 42665
  misc_feature 1..72: note = chr10:116331126-116331198
  misc_feature 1..72: note = Hypo
  source 1..72: mol_type = genomic DNA

SEQ ID NO: 105099 - DNA, 87 bp, Homo sapiens; identical to SEQ ID NO: 70391
  misc_feature 1..87: note = chr10:116391726-116391813
  misc_feature 1..87: note = Hyper
  source 1..87: mol_type = genomic DNA

SEQ ID NO: 105100 - DNA, 41 bp, Homo sapiens; identical to SEQ ID NO: 70392
  misc_feature 1..41: note = chr10:116392017-116392058
  misc_feature 1..41: note = Hyper
  source 1..41: mol_type = genomic DNA

SEQ ID NO: 105101 - DNA, 205 bp, Homo sapiens; identical to SEQ ID NO: 70393
  misc_feature 1..205: note = chr10:116675455-116675660
  misc_feature 1..205: note = Hypo
  source 1..205: mol_type = genomic DNA

SEQ ID NO: 105102 - DNA, 195 bp, Homo sapiens; identical to SEQ ID NO: 33373
  misc_feature 1..195: note = chr10:116852246-116852441
  misc_feature 1..195: note = Hyper
  source 1..195: mol_type = genomic DNA

SEQ ID NO: 105103 - DNA, 1378 bp, Homo sapiens
  misc_feature 1..1378: note = chr10:116852647-116854025
  misc_feature 1..1378: note = Hyper
  source 1..1378: mol_type = genomic DNA
tttctgctgaagctgcgaagcctgtgtcgatctctcattcgtggggctcccggggcgcggggtgcgggtggggccggggtgcccgcaccggccggggggaagggcacgcgggccacacctggggggcctgtctccagtcagcgcgcgggccaggcggggtgggcgcgcgcgcgtgggggagtccccggtccctgtcaggggcggggcgagaccaaggcgccgggcctgtggggaggagtgtaggcgcgcgcgagggcggggggcggccccacgcatcgtgggctcccggcgctgccgctgcggccggctcgaggcaccggagacagaatggctgccggggcgcccttgaccgccgggcgggcgaggcggggctgaccgccgcctccttgatcgcccccttccacgttgggcgcgcccacttcggggcgcccgctcggcccccgccctcctgggcgcgcggcgctcggagccgaggcagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgacc

SEQ ID NO: 105104 - DNA, 36 bp, Homo sapiens; identical to SEQ ID NO: 70398
  misc_feature 1..36: note = chr10:117011797-117011833
  misc_feature 1..36: note = Hypo
  source 1..36: mol_type = genomic DNA

SEQ ID NO: 105105 - DNA, 30 bp, Homo sapiens; identical to SEQ ID NO: 70399
  misc_feature 1..30: note = chr10:117628246-117628276
  misc_feature 1..30: note = Hypo
  source 1..30: mol_type = genomic DNA

SEQ ID NO: 105106 - DNA, 409 bp, Homo sapiens
  misc_feature 1..409: note = chr10:118030598-118031007
  misc_feature 1..409: note = Hyper
  source 1..409: mol_type = genomic DNA
gccgctcacttcggccgacaggagcaagtctgcggggcagaggggagggagcctgagtgcggcgggcggggaccccggccgcccctgctccgggcgagggcgcgcgcccgggtcagggatgcttgaccagccttcgggggcgccctgctctgggagcgggtccacctctcgaccatccgggagtccattttcccgccccctggaattccagctcctctctcctcctcccgggcccgcaaggaagagtggcgcaggctcagcccgcgggcttcaagggtttgctccagagcctgcgctgcccaccgcgcacgtcggccctccgccccggggcatcctggcctgagcaacgacccgggctcccgggccacccccggctccagccacccgctccgcccggctgaaactcagg

SEQ ID NO: 105107 - DNA, 1883 bp, Homo sapiens
  misc_feature 1..1883: note = chr10:118031302-118033185
  misc_feature 1..1883: note = Hyper
  source 1..1883: mol_type = genomic DNA
aaaagcttcaggcagcgccgcgccgccaccgcctccctaacccggggattcgcgatcccattccccaaaaagacacttcttccttccacatccaccacacccgcgccccaattttggtgcggagggcggggtgggctgctgcaagcgaccctaggaaagactcagagggtaagaaagcccgcggcgggcctcgacttacccaagagcggcagcgcgaagtacagggtcgccaggaacatggtgccggcgcggggctggtccccgcccccccaaaaaaatcccgagccgccgctgggtcttgccgagggagctcagcgtgcagcgatccccggacagctgtgctgctctggccgcccaaagttcagctccatccagtgaaagaggaaactccgggtctggcagcagccaccgccgccggcgactcagctccgggatggcgagggcgggaggcggttccgcttttaggggttcaggtccgacccaacctggaagggagggcgcgctttgagatgagagcggagagcgccggagactccccccacagaaccctctcccctcccccgttcccgcctttggggaatttccaacaccggggtgaggacccacccccacccaggtcggggtgcatgtgcgtgttttccaggggccgctgacacggggatggaggtgagggctggagaggtctgaagagggttcctaaagtccaagggggtgtctgttgggttcaacccgagacgctgaacgcaagcaaataaataaataaacggtactttccgagcgtcgcgagcggagcctgcagctgcctggagtccgagccctcggtggcggcggcggcagctccctagccagccctggcgccgaaagagccccttctcccgggaagttggcctccccctcctcgcgtcagccagcgagctcgctcagccgccggccctccccactccgatcgccaatccctagccccagtcgccgccctccttctccccgggactcgtctccctccagaggccgccaagccagggggaaccgatgtcccgactggggctgaaacccggttcctgcgcccctaccccctacccgccgcgcgtcctcggctccctcctgggcgtccgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgttagtggttattggaagcggcgcggagaatggcgtgttccgaggccagatttcttctggccagaggaccctcggcctgctcctgttcccgccgctccgcagctccagctccctcctaagctcgcccgccaggcagccgcagctgcacacgcccgcttgcggtgggacccgcggccggacccgtactcgcgcacaggacacgcagtgttctgcagccggccgcgggtgctgccagacacacacactctctctctctctctctctctctgtc

SEQ ID NO: 105108 - DNA, 923 bp, Homo sapiens
  misc_feature 1..923: note = chr10:118033245-118034168
  misc_feature 1..923: note = Hyper
  source 1..923: mol_type = genomic DNA
acaagggctctttcttcttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgcacgccggggggcgcccggggcaccgaagtctacactgggtcgggagaccggtctaggagccagccggcagtgctcgggatctttgctgatgtccaagttcatctctcggggagaccgagtttgaatcaaatctgcgtgcgcccagctgtcaaatctgcaaacctatcacgccagacaatgggccgccgcggaggacagacaagaatggctcattttgatcgaggggggtaaattgaaaagggcacgggctttggttgaagtttgaggcccgggtgtcagggcggggagaagaagaggaggaaggaggagggttgggccgctctccattcaaccacacatcagccaggcgcgcccctcggctgcagcggctgcttgcaggcgggctgcatattgtgtggagtcgccaaagagggtctgcgcctcggggcgcgccccaaacccgggggacatcctac

SEQ ID NO: 105109 - DNA, 56 bp, Homo sapiens; identical to SEQ ID NO: 70410
  misc_feature 1..56: note = chr10:118547540-118547596
  misc_feature 1..56: note = Hyper
  source 1..56: mol_type = genomic DNA

SEQ ID NO: 105110 - DNA, 261 bp, Homo sapiens; identical to SEQ ID NO: 70411
  misc_feature 1..261: note = chr10:118608457-118608718
  misc_feature 1..261: note = Hyper
  source 1..261: mol_type = genomic DNA

SEQ ID NO: 105111 - DNA, 861 bp, Homo sapiens
  misc_feature 1..861: note = chr10:118890913-118891774
  misc_feature 1..861: note = Hyper
  source 1..861: mol_type = genomic DNA
tgaactgtctgtgggcggctgctgtgatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtccctgcaacacccaggtgtgcaggcgctacaagaaggagccggggccgctgcccccgcagcgcggacttcgccccgtgctgcacacgctttagaagagcgtgtccggaagtgtcctccccggccctcctcgcttcccaagatttgtttgcaacgtctacacccgtcaccaccgcataagcaccagggtgaggaggtctctttgcaggaattaatatcgatttcagtctcctgctccttcaaagtttctctttgacgatggcgagacttatattctaagtcagaagaaaataaaaccttgcctattctgggcccatgattgcacaaaatccaaaatgctgccggcatgaagatgcagctggaagactctagaaacctagcattaggaggcagagactttatagtgcccagagatgagttcctaaataaactaagaattacgcagtgggaaattaaggaggagggtctgaggggccgacctcagagggacagatagagaaatcgagagcgaaacactcaaggaagtggaacaaatcgtcgtagccaggcgtctctgcctctccggaaacccgaaatccgcccaaacctcatcccaggcgctcacggtaccagtcgcagggccccgcactataggggctgccaccctctgcccccggagtccccacgccgagactcatcattt

SEQ ID NO: 105112 - DNA, 2487 bp, Homo sapiens
  misc_feature 1..2487: note = chr10:118892013-118894500
  misc_feature 1..2487: note = Hyper
  source 1..2487: mol_type = genomic DNA
gagggggagagtttccgacgtaaataatttacaataaaattactattttaaaaaagtgtttttcgcttgcttcagatggatgaatacattctagacactgcggcacctcgcagtctgggtctgtgattttggttaaaatgtgggtggccgtggctgtagggacgatcgccgctgcgcagggtaaggaaagagggtgtcgcggttcgtgttctgatttgggaccactgaaaccctaagactggggaggcgaggggagtgtctttcctatcaatcacacaagacgctatctggactccgagactactgctagaggaggcccgaccacccagcggcgtccctgcctccccttccgcaaagaactgctcagaaatccagacgtttcctgcgtgcaggaagggttttgtgaatccgggtgtttgggagaggaggcaatgagtgctgactcgttttccaaaccgagcaattgtgcccgaagctacgcgcctgggaggccgtagggtgaagcgccggctgcgcaggctaccgccggcagccgctttgctctttcctggaggagtgggaagctgtcggccaccgccccgaacaggctcggagaaaagattctgaatttcctttgattagcggcgttaccttttcctttgcttttcccccattaaattcctgtttaaagttacaacacccagaaccttaattttgcattgccctgtggggcattctgtatcctgaattttcttacaccttccaaatttcatcattggaagtatttaaaaactggttccacttcatctggttttacgtagcaattgcttttattgctgattagatcaaatttatcagtgtcgttgcctactacgacgtttgttactgtttcctggggtcgggggtggttgtgattggagttgccctaaaggggagaaaaaccgcaggatttgcccgccaggaagctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatcaggttgactaactcgggcatttttcccaattctttggatcgctcctggattcagaaggaagttgggggttggggaggaatctcagaggaaaggtagtagaaaaaaaaaatagcccgaatgagatgaaattggtagcagagtctagtgggaaaggagagctgtcagaggcctggtgggagccaggagcccagcgcaggagctctgggcacctaatgcgcgtgagtccataaatatcaccacaatagatactataaatataaatacagggaaacacttaaaatcagtccagcgcttttttctcggccccttctttattgttggtccgggagtaaggctcgaaggccgaggagctcagatatcgggcggagagttcttgcaaattcccagctagcgaaccagccattgttaacggggcggaggacaggcggctggcgacggagccgagcagcgagggcaccggcaggctgaagaggctgtggcccgcggccggggcgcctgcgtgcaatccccccggcccggcgggcccgggacctggagcaccgcccacagccggcgggtgcggggatgcagcgcccgctgggcccggggcggcggcggcggctgcggcggccgagcctgcagcggcgcccgcgcccagggccggcaagctgggcccgcgcagcgctgagccgagagcgcccgtggcgcaaggcggcagcagcgcaggcaggccgggcggcgacaacaggcggccctgctccagcagccgtagcacgctgcacgtggccgcggtctccgacaccaccgagcgtagctccgagtccttgccctggtccttcttctgcttggtgcgccggttctggaaccagaccttcacctgcgcgccggggtgcggggagagttggagagaggggcagggaagaccagcgtcaaaggaagcgagctcccggggcgcgcggctccggggctctccccaagtcccagccctatccgcagccccacccagcagccggaggggtccgggccggggcgctgctgggggagctggcgccgccacgagggggacacagctgctccaccgggctgcgcttccgggtcagggaagcaggcccaggcaggcgccgcttacacagaacaaagtaataaaatgcccacggcaggaactcgaaggaagaccggaaagggtttcactggcttccgcgctaccccgcagcggtgtttggggctcacagatgtgtgaatcagtgcagtcccaaagccggaatttccggtggagggtgtga

SEQ ID NO: 105113 - DNA, 1978 bp, Homo sapiens
  misc_feature 1..1978: note = chr10:118896177-118898155
  misc_feature 1..1978: note = Hyper
  source 1..1978: mol_type = genomic DNA
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagcaccaaagcggcaaccgcggctccgtaaccaagcccagctgcctctcccggcggcagcggtcgggcaccgatcgcggccgtggggtcctcggcccagtgcactaactggcagggccgtagcccgcgatcggcagctgttctccggggctcgcgttcccccttgggtgcgctcagccctccagagcgcgggagtcccctggccggctcccggcaggtcgtccggcccttggagcgcgcacacctcctcccggagttttctgctcctttcccgggtcggaggccgcagcccgatgcccggccgcacccgcgcagcccctcatctccccccgcagcccggtcagcggggcccctccgggcgtggagggccgaggcccctggagagcgcaccggagagtcccaggcgcttgtccccagccggactcggggcggggagggccaacaactttctcccaagtcccagccggcactccttcccaccggcctgtgtcggcggcagcgcgcagctccggccccggagtcgaccccaaagaacgcgcctggcagccctgcccatccctacctcggaccaggatccggcggcagtaatccgggtccgctgcggaattggatttacttttgttacaatcctcagcagcgcccgacgctgagaaggcgccctgcggctccttgaggaaggcggctgggaggttcccctccgcgcccttgctctcccgactctccttgtgcgcgttcttcgagacccgggcagcctcggcgtccgagtggcatcgaacgtccattttgtctggtttcccgaacataggcaagaacaacaacaaaaacagaaaggaaaaaaaaagcaaaaaaaaaaaaaaggggggggggcggagaaggaaaaaaaaaagaggaaaaaggggacaaaacccccgacaacgcggcccgtacgcccggcccggcgacaggcaaggggcaagaatgaatgtccccgcggggaggcttcggcggccgcgcgcgggtcagcggcgacgggagagtggcgcgctcgccgagaggcggccagtctggtccaggatcctggtggagctgcggcgaggccgcctcgtcagcacccgcgtcctctgagcacgtccagtgtccccagcctggcgatcaggtagcgaacagcgcaactccgaaatgctgcggctcccgcctgtttctgagacggcgagttgtagttgtccgacacccggggggacgcacactcgctgttgcaattgattacgggtaatttcgcagcccccacgtttcggttacctcatgaatacactaaattgtttggataatatatcagatcgtaatggatggtttctgtccttgtccccaatcaagtaggggtttagccagtgaataaacggaaatgattggtc

SEQ ID NO: 105114 - DNA, 1663 bp, Homo sapiens
  misc_feature 1..1663: note = chr10:118898853-118900516
  misc_feature 1..1663: note = Hyper
  source 1..1663: mol_type = genomic DNA
tgctccagcccttctcgtcaccttgccggggcagaagccctctccacgccgctctccccattcattcctttatgggaaatgcggagcaaaaggagtgaaagatggcaattatctaattggactattaacaaacagtcctctgagtgcggcggtctggcgtggctcctgggcgggggaagggccgtgttccctgccctcattcacaaagagtgcaggggccggggaggaaaggggttttttaaagggggtgggtggggggagaggagaggtgggaggtttggctgagaatttttccacacaattccaagaatggggcggaggcggggggaggggagggggttggggagggggtcgcggcgagcgggtgggaggaaggccgggagggggaggggtgcgagtgtgtgtggcgggcccctaggggctccagctcgcagcgacgcgcgcaccgtccgcacctcccgccccgccgccacctcccctgcctccgccgccaccccgcgggacccctctaccgtcccaagccaggagggggccccctgagcggggtctttcgcgctgtccacccagccacccctccagccacttaggggcacccaggtttggcccagctccggagggcatctctggccctgcaggccgacatcaggcttccactttagttgactgggcggagcggtggaactgtcccgagctactctccgcagggcggcgggtttccagggtccccagcgggctgatcgcccctcagcccggcttcgctgcgcacgctgccctcgaagtccgacgccgactgggcgcccggggaaagtgcctttgattacgagctctgctccggcgggttggtgaggcgggtgggagcagagacgggtaagaggggtaagggactttgcggccaccctgttctgaagatgtagagtgggattgtgttaaaatccggcgaactctcctgttacctcccgcaacgctcaaaagcccagactggcgccttgaggcaccgagggctttgctcccatgcggccaagccgtcgggggtgcagccgccgggtcttgactcccactaccgcgtcgcgggtgcgggtccctgggattcgggtcctcctgatgggggtccctgcagcagatggggcattcacttccctgcagagctcggcccgagggagctcctgggcctccttgggcagggaggggtgcgaccgaattccctggcacaccggcccttccttgccccctaccctggaggggttggaggggtcggaccctcggactacgcgagatcgggtgcgcaggaggattctaggccttcctcagccctttaggagccctgcaggcggcggaagtcccaaaccgcagccttggcccaaatgggacccagatggctctgggtccccggcccggccgcacccctctgtacggcctccttctgtcggtgaaggccgcagcggcctgggaaacccatgcggacacctgcggcgcccggtcaaagacctggaagaaagctttttaaaaaataaaaatggcccaacccattacattttcttttaggtagatgggggagctggggggcggggcgggggcagtcagggaacaaacagctgcccttagaaatgacacgccctgtgggcaatggcggcgctgggacgtctgcagccgcattcactgccac

SEQ ID NO: 105115 - DNA, 674 bp, Homo sapiens; identical to SEQ ID NO: 70427
  misc_feature 1..674: note = chr10:118922143-118922817
  misc_feature 1..674: note = Hyper
  source 1..674: mol_type = genomic DNA

SEQ ID NO: 105116 - DNA, 544 bp, Homo sapiens; identical to SEQ ID NO: 70428
  misc_feature 1..544: note = chr10:118923031-118923575
  misc_feature 1..544: note = Hyper
  source 1..544: mol_type = genomic DNA

SEQ ID NO: 105117 - DNA, 1704 bp, Homo sapiens; identical to SEQ ID NO: 70429
  misc_feature 1..1704: note = chr10:118924354-118926058
  misc_feature 1..1704: note = Hyper
  source 1..1704: mol_type = genomic DNA

SEQ ID NO: 105118 - DNA, 588 bp, Homo sapiens; identical to SEQ ID NO: 70430
  misc_feature 1..588: note = chr10:118927006-118927594
  misc_feature 1..588: note = Hyper
  source 1..588: mol_type = genomic DNA

SEQ ID NO: 105119 - DNA, 150 bp, Homo sapiens
  misc_feature 1..150: note = chr10:118927889-118928039
  misc_feature 1..150: note = Hyper
  source 1..150: mol_type = genomic DNA
cccggcgcctctagccgctccacccgcacccccagttcgcgctgcggcggccagcctcttccccgacggccgaccgaatgtccctcagagctttccgtgaccggccagggcgcgtggctgtccggagcccctccacgttccccagcagca

SEQ ID NO: 105120 - DNA, 181 bp, Homo sapiens; identical to SEQ ID NO: 70433
  misc_feature 1..181: note = chr10:118928343-118928524
  misc_feature 1..181: note = Hyper
  source 1..181: mol_type = genomic DNA

SEQ ID NO: 105121 - DNA, 1123 bp, Homo sapiens
  misc_feature 1..1123: note = chr10:119000420-119001543
  misc_feature 1..1123: note = Hyper
  source 1..1123: mol_type = genomic DNA
ggtccccaaggcactcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccggacggggtaaactgagcggcggcggcggggcgctggggcggagactgcgacccggagccgcccggactgacggagcccactgcggtgcgggcgttggcgcgggcacggaggacccgggcaggcatcgcaagcgaccccgaggtaacacggccccggttccctgctcgcagggcgcggtgccggaggggagcgggcccgggggaggcagggaggcagggaggcccccagagctacgcgggcggggctgcggggaccccggggcagccggggcgcagggcgcagggcgcaaggtgcacggggccgagcgtgcagtttgggaggtggcacagttgggggcggcggggatcagggcagcgtcctgggggttctaggttgggtctccagattgggtccccgacggcgctcgcgggcgctctttccagggagcgcgggctctcgtggggacgcgctcgaggcaggtgagccgaggctggggcgcccgggggtgtccccggatgccggtgcgcgcggctccctgacccgcccttccgcggcctgggggacgggagaatggggggtccacggccgccttgggtcctcaccgcgcaccgcgcccgcagcggagccccggagccatggccctgagcgagctggcgctggtccgctggctgcaggagagccgccgctcgcggaagctcatcctgttcatcgtgttcctggcgctgctgctggacaacatgctgctcactgtcgtgggtacgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcgggtcaaaaactgt

SEQ ID NO: 105122 - DNA, 30 bp, Homo sapiens; identical to SEQ ID NO: 70437
  misc_feature 1..30: note = chr10:119016775-119016805
  misc_feature 1..30: note = Hypo
  source 1..30: mol_type = genomic DNA

SEQ ID NO: 105123 - DNA, 31 bp, Homo sapiens; identical to SEQ ID NO: 70438
  misc_feature 1..31: note = chr10:119136226-119136257
  misc_feature 1..31: note = Hypo
  source 1..31: mol_type = genomic DNA

SEQ ID NO: 105124 - DNA, 74 bp, Homo sapiens
  misc_feature 1..74: note = chr10:119292269-119292343
  misc_feature 1..74: note = Hyper
  source 1..74: mol_type = genomic DNA
ggggcagaggacctgcgggagcccgcgcagcgcctccgctctgccaggcccctccgcatcgggcacccaggctg

SEQ ID NO: 105125 - DNA, 1135 bp, Homo sapiens
  misc_feature 1..1135: note = chr10:119294281-119295416
  misc_feature 1..1135: note = Hyper
  source 1..1135: mol_type = genomic DNA
ggtgggaggacacttcgggcccagcgtagaggaggcctccgaggcccaagcgggcttcggctgctgcgagtccccagaggctccctcgggcctcactcgcggtgtctcctccagacgccaggggcaggccacgaagccgagggctccgcgtggccgtgggagaagcggggtgcacggagccttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggacgaggggtcttggggccgcctcgctggctgcggttggaagcacccgttttcccgcccgcccgcgcaggcgctgctctgtggccaccagcagaggtttcccggccgctgtgagtcgcccacgcgagcgacgtggggatacggggcgcacggagtctcagctgccgccacgcagcgcttgccctgcccgagcttcggctcactggcagcggcgaggccaccgaccaccctccgccttccagtcctaaactcggggctggagaccgcaggagctaaaccaggaagaagaaagagggcagggcctgaggccgggaagagcggcccgggggtcaacggtgagcgggtgcatacgaggcaagagccagagtgacattaagtggggccgcccgggcaaaccttgcgcgtgcaccccggcccacctgcagggcattctcccctgccttttctccttggcttgagtgcgggcggctgactcctgtgggcggggaggagagggtggtcttcccagggctccaagtggagtgatcactgcacccatggccaggaggtgggggtgcgcggagtgatttttgt

SEQ ID NO: 105126 - DNA, 1059 bp, Homo sapiens
  misc_feature 1..1059: note = chr10:119296629-119297688
  misc_feature 1..1059: note = Hyper
  source 1..1059: mol_type = genomic DNA
ggagccaggctgccccgggatggatggggtccgcgcgctccgagaggaatgggctagtcaatgtgcgctgctaggagtgtgtggtaatcaatcgccacccctgccaaaaccaaggaccccctgtgtcgggcgtcttcagccagccgcgagggggcgcggatctgagagagtcgcaccccgggaccccagctcttcctactccaccccaggcagggcccgcgcaggccgtccaaggcctgttctctgaaccacctgggttgggccgcgaaatatgggacctcaggcatggaattgtggctgcacaggtgatcacggcttcctagtccttcttagagcagaacctgtcccactccagcccacctctgcgcccccttcggaaggaagcctactggagctggaattccagcgtgggtggcgaactctcaagccaagagctggagctgatggaggcaggagggacgcacttccaagccatccgggctcctccgtagccagtgagcctcctttaacccctccactggcctggatgacggcctaggcgagactttggcagtgtggcgcgaccccagcgctcccccgccctcgggctcgggggcgcggtgggtaccgcgcccgcgcccggccctcgccactaggcgccgctgcgctcacgccgatcggggccccgggtcgccgcgcccgcctggcgagaggcctctggggaagacgccagaaagggatttgtcgtaataatttttaaaaaatgtttttagggcattaattatacttttcgttttctcaccgccaccctgcgcgttcggagaggccggcgtgactggggatctcagtgggttggaggaattcttaacgcccccgaggcctttccaactcgggacaccattctcgcgcctcgggccgggaaagggctcgcccttcacgggcgtcggtgcggtccgcggcgagccgcgggagcacagggcgggctcagcattctggttcaacgtgaggaccagaacctcggcgatcagggaccaggacgtggcagagtgcagcgggtagcttcgacggcacaaggccatg

SEQ ID NO: 105127 - DNA, 917 bp, Homo sapiens
  misc_feature 1..917: note = chr10:119300923-119301840
  misc_feature 1..917: note = Hyper
  source 1..917: mol_type = genomic DNA
tgatcataattatgccgccgcgcgagccaatggggacgagggaactcggtcctaaaatcatcccaaaaccgaaggcgagctcgaaaatgcggacacggcccgggaccggagatgcgatccgtagtcgttagttgcactgggtttgcacagcaaccaccacccccccaccaaccccgggacaacagatggcataataataataatagaaataataataataaaataatatcatctataataataataacattgaccacactgacaaaaataattacgacggaaccttaatagtacagtagcaccatatcgggctctcccctgaccttggactgccggtcccagatattccagaaggaattgttttggggaaggaggtgagcaccctcccagacagaaaacgctagagaccgtggggcgagagagggagagagttggaagcccactgctccggcggggtcggcagctcccggtctcaactcgcaaacgaacgagccgggtcaagaatcgcgaacgcaccgaccctgggacctcgaggctaagcgtggttgatggggtgggaggaccccgtacccctcactccaggatccctcctggcctaggaaaccgctgggagttttgctaagtgtggggattggtataaccgaacggcgcctttagcccgggaaccagcccctgcccgcttaccctcgcggtgctcttggggcgatcccagttctcccgacgcggggccgcgtaaggcagcagcggcggagcgctaggctagaggaatctgtctgtccttctgtcctaccagcttgggcgaggcaggctcgggattcagggggccgcagcggaggcggcgccggccagggactctgcagggaccggggtgccccggagggagtggtgctggtggaggaggaggcggtggctgaggg

SEQ ID NO: 105128 - DNA, 77 bp, Homo sapiens; identical to SEQ ID NO: 70446
  misc_feature 1..77: note = chr10:119301900-119301977
  misc_feature 1..77: note = Hyper
  source 1..77: mol_type = genomic DNA

SEQ ID NO: 105129 - DNA, 1028 bp, Homo sapiens; identical to SEQ ID NO: 70447
  misc_feature 1..1028: note = chr10:119302693-119303721
  misc_feature 1..1028: note = Hyper
  source 1..1028: mol_type = genomic DNA

SEQ ID NO: 105130 - DNA, 1334 bp, Homo sapiens
  misc_feature 1..1334: note = chr10:119303950-119305284
  misc_feature 1..1334: note = Hyper
  source 1..1334: mol_type = genomic DNA
tgttttcatttcttgcgatattttttatttgtttgtttttctctgggtacggggtgggaggaggagagttaaaacttcagaaaaaggagtaattagtttacggattggagtcagtaaaagacctacctccggcggcagccgatcaatactccgcggcttgtccattcattaacccattgcgttcctgccggagcctagaatcgggtagatgtcacccccctccccatattttaaaaaatcaaaccaaaggaaaaaaaacccaaaaagccttttacccttaatcccgaactggatttgcctgcatcctgcctggactgtcggcttgtttttctttgtttgggttttcggtgaatcgatttcctatgctaatgagtgaacccaaaactctgaggctttgcttgaaaagtttagggctgcccttcctcattcgctatcagtcatgcttatggtcccctcaccagacccggagccgctgggatcttcctgcgttacagactgtcctggcggtgtctgcaagtcggtaaccccccgggtttcgatcccttcgctcgcgtttctcttctagttctcgggagccgggagccccggagcccagttcgcgagaggcagcagcggctgtagccaagcacacccgccggccagatttctgtcccgatcgggcttcaacgactcgccccgcctctatacttttccggaggggcaataaaacaaataatttaaaaataaatctccatgaaaactctggagagcagcccgccgcctttccaccgtgggtcaaagttccccgagaggttagaaagaagagaaagtagtttcttcgggttgtgggcgccaatcccctggccaggctctgcggctccctcccctgcctccagcgcccggcgaggaggtggcgaggcccgcggcgccagggcggctgcggagccggccgaggtcaggagcctggggactggctcctctgcgacagcggctggttgggtgccgcaccggtggagacccggcgttccgggccgggcagctgagcaggcgttcccttcgtgagcccttgggaggaccaccggcccccgcaggtcgagcggcgcggctatgcgaaggccctgagcacggtgccgggccagcccggctcgggagaagtgcgcggctccggtcagagcagccccccctaatgggatttctgctgtgctccccgcagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccga

SEQ ID NO: 105131 - DNA, 256 bp, Homo sapiens
  misc_feature 1..256: note = chr10:119306116-119306372
  misc_feature 1..256: note = Hyper
  source 1..256: mol_type = genomic DNA
ccgaggagggcctggcgggtttgtgcggagcccggcacaaggcgcggcccggctgatttctcctggacagccgaggcggcggtggtctttgtccgcctcgctgcccacgctgcctggagtctttgtgtgcgtgtcaagccccgagcgcaccgacgcgcgccttgggccagcgccggggagaaatgaaccgtcctccccctcaattagcaaactcaaagcaaattaaattcagccttgttcccgctcagcttttttc

SEQ ID NO: 105132 - DNA, 52 bp, Homo sapiens; identical to SEQ ID NO: 70454
  misc_feature 1..52: note = chr10:119307022-119307074
  misc_feature 1..52: note = Hyper
  source 1..52: mol_type = genomic DNA

SEQ ID NO: 105133 - DNA, 68 bp, Homo sapiens; identical to SEQ ID NO: 70455
  misc_feature 1..68: note = chr10:119307830-119307898
  misc_feature 1..68: note = Hyper
  source 1..68: mol_type = genomic DNA

SEQ ID NO: 105134 - DNA, 30 bp, Homo sapiens; identical to SEQ ID NO: 70456
  misc_feature 1..30: note = chr10:119310948-119310978
  misc_feature 1..30: note = Hyper
  source 1..30: mol_type = genomic DNA

SEQ ID NO: 105135 - DNA, 293 bp, Homo sapiens; identical to SEQ ID NO: 70457
  misc_feature 1..293: note = chr10:119311443-119311736
  misc_feature 1..293: note = Hyper
  source 1..293: mol_type = genomic DNA

SEQ ID NO: 105136 - DNA, 30 bp, Homo sapiens; identical to SEQ ID NO: 70458
  misc_feature 1..30: note = chr10:119311979-119312009
  misc_feature 1..30: note = Hyper
  source 1..30: mol_type = genomic DNA

SEQ ID NO: 105137 - DNA, 1202 bp, Homo sapiens
  misc_feature 1..1202: note = chr10:119312341-119313543
  misc_feature 1..1202: note = Hyper
  source 1..1202: mol_type = genomic DNA
ctagctgtccttgtgcgtctagattgttttgagttagggccagcacgtgcagttgtgaggctgcagagtgcctatgacggtgtggaaatgcagtttattgaatgtgtgtgccgcggtctggttgcactgtgtatctgcgaattcgtctggagttgcacatctcagaagatgggggtggcctcggtgtgtgtggcttgcggggacgtttctcggtgtttggatgggggtccctgtgatggatgtccatgcccagccctagggcaacatctgtgtgtcttgggatcgaggcgtgtgtgtctagtgaggaggcttgggctggggtgtcgttccagcagcgccccactaactccggagtttggcaaacaacagccgttttgtgtaactgcgcatttttctagaccagtctttattattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggccttttgtttattagtgtctgttgcccggctgggagtctccggagggccccggagctgcgagtcggggtgccagaagcggacggcgggccagcgcccagagctggggtccgggtagggcagaggcgcgtcgcactcctctgagggggcgccagagcgcgccaaagatcacgcccacgtgcggagatgcgcgcatggaggctggactccaagtgctggagcctggtcctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcccgcccttcctcgttcttcgtgcttcgagttcattagtcg

SEQ ID NO: 105138 - DNA, 114 bp, Homo sapiens; identical to SEQ ID NO: 70461
  misc_feature 1..114: note = chr10:119469814-119469928
  misc_feature 1..114: note = Hypo
  source 1..114: mol_type = genomic DNA

SEQ ID NO: 105139 - DNA, 42 bp, Homo sapiens; identical to SEQ ID NO: 33430
  misc_feature 1..42: note = chr10:119494127-119494169
  misc_feature 1..42: note = Hyper
  source 1..42: mol_type = genomic DNA

SEQ ID NO: 105140 - DNA, 682 bp, Homo sapiens
  misc_feature 1..682: note = chr10:119494374-119495056
  misc_feature 1..682: note = Hyper
  source 1..682: mol_type = genomic DNA
taggaagcctagggtcgccgatgttccaggatggaatgttctggtgtcaccgtgcgggggggtggggggtgtcacagagctgggaactcgctcagagccagggtctctgctggggtcagcgtctgtacgctaaagccagggcgcaaagtgcgtgggcactgcggacactagaggcttatggcgctggaaatacaaggccgagttgccggcgcaaagagttccccgggcgggttggtgatgcggcgcgctttgataacaggttaatccggccaacattcgctccgcgagagagccatcggagggctccgggagactgcggcgccacggagggagaggcggcgagaggcccctctgcgagcaccctctgggcgcagtgcggtgggctatgctctgcgcagccccgggcgcgcctgggttctcagagcccaagacctgagccgctccgagcgcagggcgccagttctctttcagaagcgggagaagttcaggtgggacaggagacacgggggtgaggagatctttgagagggccggccgggaaagtgggggtcgcctgtggctgagagggccgcatgccgaaggtcccgaccccaggctcacgacaggcagcctggcacgcaggaaggggctttgggatagaacgtagcacctggctgagtgcttaacaacgattgaactgacct

SEQ ID NO: 105141 - DNA, 30 bp, Homo sapiens; identical to SEQ ID NO: 70465
  misc_feature 1..30: note = chr10:119777112-119777142
  misc_feature 1..30: note = Hypo
  source 1..30: mol_type = genomic DNA

SEQ ID NO: 105142 - DNA, 181 bp, Homo sapiens; identical to SEQ ID NO: 70466
  misc_feature 1..181: note = chr10:119806950-119807131
  misc_feature 1..181: note = Hypo
  source 1..181: mol_type = genomic DNA

SEQ ID NO: 105143 - DNA, 38 bp, Homo sapiens; identical to SEQ ID NO: 70467
  misc_feature 1..38: note = chr10:120127513-120127551
  misc_feature 1..38: note = Hypo
  source 1..38: mol_type = genomic DNA

SEQ ID NO: 105144 - DNA, 708 bp, Homo sapiens
  misc_feature 1..708: note = chr10:120353807-120354515
  misc_feature 1..708: note = Hyper
  source 1..708: mol_type = genomic DNA
gcaccagcccaaaggcgtaagggtcgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcgagatgcgccgcctcagcgggtgcaccagcacgacgtagcggtccactgcgatggtggtgagcgtgaacaccgacacatagacggtgaccggctgcaggaagaagaccaggtggcacaggccgccgccgaacacccagccgcgtggctcgaaggcataggccagcgtgagcggcacgcaggcggtgcacatgagcacgtcggacaaggccaggttgccgatgaggaagttcgtcacgttgtgcagccggcgcacccgcgcgatcaccagcacca

SEQ ID NO: 105145 - DNA, 378 bp, Homo sapiens
  misc_feature 1..378: note = chr10:120355260-120355638
  misc_feature 1..378: note = Hyper
  source 1..378: mol_type = genomic DNA
gcgctctgccatgctcggtgcttagagaactagtgaagaggacagtgtggggaggatggaatccgaaacgggaggaggggccggcaaacctggccagagcagcgaagaggacgaatctctactgcaggagcttgcacggcccctggagggtcagggtccggaggagcgcacagtggaggagggcggaggagaggcgcgaagcgtcaggctatcgggaggagccggtgcagtcttaggagggaaggagcggggaaggaagtagcggtgggagattgcaatgcagctgggggcttgagagaggcacgactgacccgttcttaaaggctggatcctgcctagcggccaggttgcggagggcagagacgctagagggctcgg

SEQ ID NO: 105146 - DNA, 45 bp, Homo sapiens; identical to SEQ ID NO: 70472
  misc_feature 1..45: note = chr10:120355967-120356012
  misc_feature 1..45: note = Hyper
  source 1..45: mol_type = genomic DNA

SEQ ID NO: 105147 - DNA, 126 bp, Homo sapiens; identical to SEQ ID NO: 70473
  misc_feature 1..126: note = chr10:120668218-120668344
  misc_feature 1..126: note = Hypo
  source 1..126: mol_type = genomic DNA

SEQ ID NO: 105148 - DNA, 420 bp, Homo sapiens; identical to SEQ ID NO: 70475
  misc_feature 1..420: note = chr10:120766813-120767233
  misc_feature 1..420: note = Hypo
  source 1..420: mol_type = genomic DNA

SEQ ID NO: 105149 - DNA, 42 bp, Homo sapiens; identical to SEQ ID NO: 42669
  misc_feature 1..42: note = chr10:120791236-120791278
  misc_feature 1..42: note = Hypo
  source 1..42: mol_type = genomic DNA

SEQ ID NO: 105150 - DNA, 120 bp, Homo sapiens; identical to SEQ ID NO: 70477
  misc_feature 1..120: note = chr10:120841443-120841563
  misc_feature 1..120: note = Hypo
  source 1..120: mol_type = genomic DNA

SEQ ID NO: 105151 - DNA, 30 bp, Homo sapiens; identical to SEQ ID NO: 70478
  misc_feature 1..30: note = chr10:120863286-120863316
  misc_feature 1..30: note = Hypo
  source 1..30: mol_type = genomic DNA

SEQ ID NO: 105152 - DNA, 30 bp, Homo sapiens; identical to SEQ ID NO: 42670
  misc_feature 1..30: note = chr10:120922882-120922912
  misc_feature 1..30: note = Hypo
  source 1..30: mol_type = genomic DNA

SEQ ID NO: 105153 - DNA, 30 bp, Homo sapiens; identical to SEQ ID NO: 70481
  misc_feature 1..30: note = chr10:121228977-121229007
  misc_feature 1..30: note = Hypo
  source 1..30: mol_type = genomic DNA

SEQ ID NO: 105154 - DNA, 178 bp, Homo sapiens; identical to SEQ ID NO: 70482
  misc_feature 1..178: note = chr10:121249843-121250021
  misc_feature 1..178: note = Hypo
  source 1..178: mol_type = genomic DNA

SEQ ID NO: 105155 - DNA, 43 bp, Homo sapiens; identical to SEQ ID NO: 42672
  misc_feature 1..43: note = chr10:121256846-121256889
  misc_feature 1..43: note = Hypo
  source 1..43: mol_type = genomic DNA

SEQ ID NO: 105156 - DNA, 417 bp, Homo sapiens; identical to SEQ ID NO: 70484
  misc_feature 1..417: note = chr10:121301494-121301911
  misc_feature 1..417: note = Hyper
  source 1..417: mol_type = genomic DNA

SEQ ID NO: 105157 - DNA, 165 bp, Homo sapiens; identical to SEQ ID NO: 70485
  misc_feature 1..165: note = chr10:121307203-121307368
  misc_feature 1..165: note = Hypo
  source 1..165: mol_type = genomic DNA

SEQ ID NO: 105158 - DNA, 148 bp, Homo sapiens; identical to SEQ ID NO: 70486
  misc_feature 1..148: note = chr10:121354399-121354547
  misc_feature 1..148: note = Hypo
  source 1..148: mol_type = genomic DNA

SEQ ID NO: 105159 - DNA, 30 bp, Homo sapiens; identical to SEQ ID NO: 42674
  misc_feature 1..30: note = chr10:121398024-121398054
  misc_feature 1..30: note = Hypo
  source 1..30: mol_type = genomic DNA

SEQ ID NO: 105160 - DNA, 27 bp, Homo sapiens
  misc_feature 1..27: note = chr10:121718497-121718524
  misc_feature 1..27: note = Hypo
  source 1..27: mol_type = genomic DNA
gggtgcggtggctcacgcctgtaatcc

SEQ ID NO: 105161 - DNA, 1278 bp, Homo sapiens
  misc_feature 1..1278: note = chr10:122216112-122217390
  misc_feature 1..1278: note = Hyper
  source 1..1278: mol_type = genomic DNA
ctcctgagagcaaagcgaagcccgcgagtgatctctggggaacttcctagaaaaaagaaagaatttcaggttcgaacggtgtagggagggccgaacacgggagcaaggttggccagggctgccctgagccctggagaatccccagagcgatcgtccactacatgcccacgtgcgtgcgtgtgccagggagcgagagcccggacagcgggagtcggaggcaggaccaggagctgcagaggggccgcgggcagagccccagcgagcgcgctgccctggcgcggagcccaggggccgcccactggcgggggaggcggggagcgcgcagggaggcggcggcggcggtggggcttccccgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggccgagctgcgggagccgcggagagcaccagctgacgccgcgggagctgctccggccgcaccatgcgggagctggccattgagatcggggtgcgagccctgctcttcggagtcttcgtgtaagtagtggcgcaccgcgggcagggcgcactgacgcgggggaacaaccgaccaagcctctctgtgccctaacttagtttgcgcagccgcttcccactggggcctgggttcgaggtcccttccccgccaagtgcccgcaacgtgtcctacgggaccaagagagacccttcctctctccttcctgggaccctaggcgcggagcgaccaccgcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttctcctactga

SEQ ID NO: 105162 - DNA, 30 bp, Homo sapiens; identical to SEQ ID NO: 70493
  misc_feature 1..30: note = chr10:122222277-122222307
  misc_feature 1..30: note = Hypo
  source 1..30: mol_type = genomic DNA

SEQ ID NO: 105163 - DNA, 92 bp, Homo sapiens; identical to SEQ ID NO: 70494
  misc_feature 1..92: note = chr10:122319368-122319460
  misc_feature 1..92: note = Hypo
  source 1..92: mol_type = genomic DNA

SEQ ID NO: 105164 - DNA, 31 bp, Homo sapiens; identical to SEQ ID NO: 70495
  misc_feature 1..31: note = chr10:122319520-122319551
  misc_feature 1..31: note = Hypo
  source 1..31: mol_type = genomic DNA

SEQ ID NO: 105165 - DNA, 120 bp, Homo sapiens; identical to SEQ ID NO: 70496
  misc_feature 1..120: note = chr10:122379107-122379227
  misc_feature 1..120: note = Hypo
  source 1..120: mol_type = genomic DNA

SEQ ID NO: 105166 - DNA, 30 bp, Homo sapiens; identical to SEQ ID NO: 42676
  misc_feature 1..30: note = chr10:122394238-122394268
  misc_feature 1..30: note = Hypo
  source 1..30: mol_type = genomic DNA

SEQ ID NO: 105167 - DNA, 120 bp, Homo sapiens; identical to SEQ ID NO: 15393
  misc_feature 1..120: note = chr10:122492432-122492552
  misc_feature 1..120: note = Hypo
  source 1..120: mol_type = genomic DNA

SEQ ID NO: 105168 - DNA, 265 bp, Homo sapiens; identical to SEQ ID NO: 70499
  misc_feature 1..265: note = chr10:122708495-122708760
  misc_feature 1..265: note = Hyper
  source 1..265: mol_type = genomic DNA

SEQ ID NO: 105169 - DNA, 437 bp, Homo sapiens; identical to SEQ ID NO: 70500
  misc_feature 1..437: note = chr10:122738879-122739316
  misc_feature 1..437: note = Hyper
  source 1..437: mol_type = genomic DNA

SEQ ID NO: 105170 - DNA, 152 bp, Homo sapiens; identical to SEQ ID NO: 70503
  misc_feature 1..152: note = chr10:123356838-123356990
  misc_feature 1..152: note = Hyper
  source 1..152: mol_type = genomic DNA

SEQ ID NO: 105171 - DNA, 46 bp, Homo sapiens; identical to SEQ ID NO: 70504
  misc_feature 1..46: note = chr10:123357614-123357660
  misc_feature 1..46: note = Hyper
  source 1..46: mol_type = genomic DNA

SEQ ID NO: 105172 - DNA, 63 bp, Homo sapiens; identical to SEQ ID NO: 70505
  misc_feature 1..63: note = chr10:123358268-123358331
  misc_feature 1..63: note = Hyper
  source 1..63: mol_type = genomic DNA

SEQ ID NO: 105173 - DNA, 143 bp, Homo sapiens; identical to SEQ ID NO: 70507
  misc_feature 1..143: note = chr10:123820809-123820952
  misc_feature 1..143: note = Hypo
  source 1..143: mol_type = genomic DNA

SEQ ID NO: 105174 - DNA, 34 bp, Homo sapiens; identical to SEQ ID NO: 33445
  misc_feature 1..34: note = chr10:123873006-123873040
  misc_feature 1..34: note = Hyper
  source 1..34: mol_type = genomic DNA

SEQ ID NO: 105175 - DNA, 988 bp, Homo sapiens
  misc_feature 1..988: note = chr10:123922604-123923592
  misc_feature 1..988: note = Hyper
  source 1..988: mol_type = genomic DNA
gggagagccaggtgccgcagctctccctggtacagacttcagctgcctccaggacccggggcctgaaggaggcagaagccggcggtggaaaagggcgcacgtctctcccagcgtcgctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgtaagtgctccgcccgggccgccccgagtctcccggggaggaggagaggatgcccgggctttgttagtgtcgcctttcctaatgc

SEQ ID NO: 105176 - DNA, 377 bp, Homo sapiens; identical to SEQ ID NO: 70512
  misc_feature 1..377: note = chr10:124133936-124134313
  misc_feature 1..377: note = Hyper
  source 1..377: mol_type = genomic DNA

SEQ ID NO: 105177 - DNA, 100 bp, Homo sapiens; identical to SEQ ID NO: 70513
  misc_feature 1..100: note = chr10:124220556-124220656
  misc_feature 1..100: note = Hyper
  source 1..100: mol_type = genomic DNA

SEQ ID NO: 105178 - DNA, 148 bp, Homo sapiens; identical to SEQ ID NO: 70514
  misc_feature 1..148: note = chr10:124220901-124221049
  misc_feature 1..148: note = Hyper
  source 1..148: mol_type = genomic DNA

SEQ ID NO: 105179 - DNA, 206 bp, Homo sapiens; identical to SEQ ID NO: 33449
  misc_feature 1..206: note = chr10:124221715-124221921
  misc_feature 1..206: note = Hyper
  source 1..206: mol_type = genomic DNA

SEQ ID NO: 105180 - DNA, 394 bp, Homo sapiens; identical to SEQ ID NO: 70518
  misc_feature 1..394: note = chr10:124639132-124639526
  misc_feature 1..394: note = Hyper
  source 1..394: mol_type = genomic DNA

SEQ ID NO: 105181 - DNA, 30 bp, Homo sapiens; identical to SEQ ID NO: 70520
  misc_feature 1..30: note = chr10:124714138-124714168
  misc_feature 1..30: note = Hyper
  source 1..30: mol_type = genomic DNA

SEQ ID NO: 105182 - DNA, 147 bp, Homo sapiens; identical to SEQ ID NO: 70523
  misc_feature 1..147: note = chr10:124892251-124892398
  misc_feature 1..147: note = Hyper
  source 1..147: mol_type = genomic DNA

SEQ ID NO: 105183 - DNA, 37 bp, Homo sapiens; identical to SEQ ID NO: 70529
  misc_feature 1..37: note = chr10:124897936-124897973
  misc_feature 1..37: note = Hyper
  source 1..37: mol_type = genomic DNA

SEQ ID NO: 105184 - DNA, 4778 bp, Homo sapiens
  misc_feature 1..4778: note = chr10:124892918-124897696
  misc_feature 1..4778: note = Hyper
  source 1..4778: mol_type = genomic DNA
acaagcacataacagcgcccctgcgcgcccctgggaggggagtcaaccggagaacttggggcgacaaccggaaagccgggatccggtagccgcacagcagggatgcgggcggctgtcccggactcttctcccgccacactgggcctgtcccctccccatctgagtctagcgctggagttgtgatcagccacgagtccccctccccagactgaaccctcagcattcccagtttaaagtcgactttcgtgcgtcagaactctagccaagtttgcatgcgtctgcgctgaatggcgaagctcccaaaacacacaggcatacacgccggggtctctccacgcatactcggccgcgtggcaggctgtgtgcaggcggtgcccacccaaccctcatagacctacgtgcatcgagctatttctgcggttgggggaaaatgacctctgggtatccagcagcgattgggcgacctaggcccagtttcctcctctctgggcgcgggtttccacttacaaaatccaagtatgagacccaccctgctggggtctcagggcagtgatccgttccaacccagattttggatggcgtagcgttttgcattccagtaaagccctgtgtaaactcaagggagtaataacagtaattgtttatggaagcgccatttacgtttccagatttccaaagcaaaaatggggttcgctgctgtagatgaatgcagaaagaaacattacatatgcccgtcgagatttggtgggggagggtctgacgccccaggaccgaaaaacaaaatctacctctcaagtggggaccccacacgatcacgtctgccaatgcagggcggccttgaattaggcgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgccggaccccaaagggtaggaaaatgatgagttctccgagggccgaggtcacgtcctgcctcttgggccggcgctgcgtggctctccagctgcgtgggggcggcgggcccctgtccagccccagggggcgggggagcggcagctgcgagcgcagataaccccgaggtgacccgggagggcctggtccgcccctcccccctcccgcaggcctggcggcgggaagcgggtccctgcgccgcaggggggagaggcaggcgcggtctccgggctcgcggccgttagtgcgcttcggccaagggcgccgcctgctccgcgtccctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttggatttgcgcccggggcggcccccgactttgcgccccgtagttgagttccgtttatggtctgatttccggcctctcgcctgctcgccccgccgcccgcctgtcccgctccctccctcccggggacccggaggagaggggaccatgccggaacccgggccggacgctgccggcaccgccagcgcacagccccaaccgccgccgccccccccacccgctcccaaggagtccccgttctccatcaagaacctgctcaacggagaccaccaccggccgccccctaagcctcagccgcccccacggacgctcttcgcgccagcctcggctgccgccgccgccgccgctgccgctgccgcggcggccaagggggccctggagggcgccgcgggcttcgcgctctcgcaggtgggcgacctggctttccctcgctttgagatcccggcgcagaggtttgccctgcccgcgcactacctggagcgctccccagcctggtggtacccctacaccctgacccccgccggcggccacctcccgcgacctgaaggtaccgacctctctttgaactttcgttgtccccctgcgcgcccgccccgtccccgccccgcgctgcttccctccgcagttctgggaccccagcacccgcaaaccctctgctcggtcagtttttttcggcccctagcctgccctcgcgctgggttgcgctgcccgttaatccaatcccacttggtgagaaaagaagtggaattggagccccgggcacggtgcttcccgggaaaagtggcctcgggcgtgaatagggaggcttcggacggccggggcttgggacacggcctggaaggagggggtgattccaatgcgcctaagccgaaagggaaccgttctgccggcccctggcgaggaagctgagggaatggaaggaggtggccgcgctaccaccatctgcttgcctgtcctcgggaggagggggatcccaggactcggcgtcccttctctggcccagccgagaaggaggcagcccgcgggaatggtgaggcctcatggcctgggacctggaggccggcgcgggttgagcctgccgtccccaggcgccgggcctcgctcaaggctgtgtcggtgtgcatgtgtgtgcgtccgtctgtctgtctccccagcctcggagaaggccttgctgagagactcctcccccgcctccggcacagaccgcgactctccggagccactgctcaaggccgaccccgatcacaaggagctggactccaagagcccggacgagatcattctggaggagagcgactccgaggaaagcaaaaaggaaggcgaagcggcgccaggcgcggccggggcgagcgtaggggcggcggcggccactccgggcgcagaagactggaagaagggcgctgaaagtccagagaagaagccggcgtgccgcaagaagaagacgcgcacagtcttctcgcgcagccaggtcttccagctcgagtccaccttcgacatgaagcgctatctgagcagctcggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctc

SEQ ID NO: 105185 - DNA, 152 bp, Homo sapiens; identical to SEQ ID NO: 70530
  misc_feature 1..152: note = chr10:124899035-124899187
  misc_feature 1..152: note = Hyper
  source 1..152: mol_type = genomic DNA

SEQ ID NO: 105186 - DNA, 644 bp, Homo sapiens; identical to SEQ ID NO: 70531
  misc_feature 1..644: note = chr10:124899554-124900198
  misc_feature 1..644: note = Hyper
  source 1..644: mol_type = genomic DNA

SEQ ID NO: 105187 - DNA, 77 bp, Homo sapiens; identical to SEQ ID NO: 70532
  misc_feature 1..77: note = chr10:124901589-124901666
  misc_feature 1..77: note = Hyper
  source 1..77: mol_type = genomic DNA

SEQ ID NO: 105188 - DNA, 2115 bp, Homo sapiens
  misc_feature 1..2115: note = chr10:124901892-124904007
  misc_feature 1..2115: note = Hyper
  source 1..2115: mol_type = genomic DNA
ctgcccccccaccaccgggcgctcattctgagccgcgacgccccctcaacaggctcccggcaccgcagagccagaggccacgcggtgagaaccccagtgcgtgcgctcttcttgtgtgagaggccggaggtagagttgggagaaagaggagccggcgaaaaggttagtgggatctgctttcccttctgcggccttctgggccagctagggcctgggagatggggaccagggtcggaggcttgggggcgggagggcggtgctgccggctgcttcctgcaagcggtttgaagaggcatcgcgttgtccggccgcctgcgcaagggccacgcgctgctgctttcacccccttgcgcccgcggggcacctggactccccttaagagtccccgtggggcctgagcttctgctgggcgctacgctgccctccacgattccattttgccccatttactcgggtcgtccacttcccgcggctcagtgacccagccagggggcgtcttccgctagcggtccaaatgtagactccgcaaagaggctaagaagacctgtctacccgggtgcgcgcgatggggtcagggtgtaagaaccaggagcctcatagaaacctctgcttggggtccaaagcccagccgggcactcccagaggacaacatccgcccccgcatgtacacgtggccccgcaggacccagccgcagggctcccacgctcggctccccgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttgagccctgccgggtgtctccgatcggagtctggggttgagatttgggctgcacttgtccccggtgtgtctctccggcggagtaccctgaaggtgcacgaggtggggagcataggctgaggtgggtaatcgggtcctggatagaaacacaaccctcgtcctcactggggcccatgtatgcgcctgggattcctccccacccttccatttccaggacccctaagggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgaggcaggagcggtgaggtggagtcacctgctgtgcctcacccaagcgctaatgtcttaaagaaatataaagaatccccttctttcgtgagctccttcaccgccctcgcccccgttggtgatggagtgcacgcatcagattttcatcaaagttctattaagtgaaacataggttgcagggcaccctttgattgaaacagtttaaattttaattgtgtttttaatttgacatatagttgcagaaaggaatgacactgcgtcgccaaggggcggtcgattttcttaatttctcccagaggaattgatgagtctatcaggccactagattggaaacccattaaagctctctggttaggctgttaattggaacttgatggatgtgggggggtggggaggggggtggagagtgtcgggactcggctatgctgatccaatcttcatgactttctgttttccaataaattacacaattcattttccagcagcagattacataaattgtacacctctggggctctctttttcaaatagggagcccttttccccaaaagcctattgtgagatgtcatttgcaccaaagaacgaacagcagaggcccttgaacgaaaatcgaaacataatcaacgtttatacttagaaaatttattgagatcattttctctggtatttccttattttaaagtttggacgcgccatatatcataa

SEQ ID NO: 105189 - DNA, 30 bp, Homo sapiens; identical to SEQ ID NO: 33465
  misc_feature 1..30: note = chr10:124904318-124904348
  misc_feature 1..30: note = Hyper
  source 1..30: mol_type = genomic DNA

SEQ ID NO: 105190 - DNA, 677 bp, Homo sapiens; identical to SEQ ID NO: 70537
  misc_feature 1..677: note = chr10:124904557-124905234
  misc_feature 1..677: note = Hyper
  source 1..677: mol_type = genomic DNA

SEQ ID NO: 105191 - DNA, 629 bp, Homo sapiens
  misc_feature 1..629: note = chr10:124905481-124906110
  misc_feature 1..629: note = Hyper
  source 1..629: mol_type = genomic DNA
ttccagcatgttccccgcacgacatatttacagttcaggaaggttcgaccaactttccctgcctgcccccagctttcttccccagcggggtggctggcactgctccccgagttagctggccagttcccctcggggctgccttgaccctggctccggaggcagcgcctagctcaggatgtctgcgagaagcggatggttagtgagaatccgacgattctttcgctgaacctcccgcgtaccccccaacagcgcgggagcacgcgggacccgctgcgacgtggcccaggagcctgcgccgccgcggcgcagaggagaacgcacaaattgtatttcagcgccaggtccttccgggttaatgagctgacaccatgattaaagctgaccatttgtaatgtgtctcgaccctgccgctgagccctgaagaggttaatgcggtgacggaggccggcacctgcccctcgctggcctcccgggccgctgcgcgcaccccctggcccccgccccctcgcctgcccctgccccggctgcgcggccgactcctaatcaattagcccattaacgagcccctcgaggagttaagtagggaagagttctgccacgggcagggccgcagtcggtaactcaccgcg

SEQ ID NO: 105192 - DNA, 174 bp, Homo sapiens; identical to SEQ ID NO: 70540
  misc_feature 1..174: note = chr10:124906770-124906944
  misc_feature 1..174: note = Hyper
  source 1..174: mol_type = genomic DNA

SEQ ID NO: 105193 - DNA, 1105 bp, Homo sapiens; identical to SEQ ID NO: 70541
  misc_feature 1..1105: note = chr10:124907268-124908373
  misc_feature 1..1105: note = Hyper
  source 1..1105: mol_type = genomic DNA

SEQ ID NO: 105194 - DNA, 769 bp, Homo sapiens
  misc_feature 1..769: note = chr10:124908904-124909673
  misc_feature 1..769: note = Hyper
  source 1..769: mol_type = genomic DNA
gtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcaggtacccccaagggcagcggaggctcgggcccgggcggcttggagcgcacgcctttcctctctccttcgcactcggactttaaagaagagaaagagaggctcctgcccgcgggctcgccctcgccggggtccgagcggccgcgggacggcggcgctgagcggcaggccggcgcggccaagaagaagacgcgcaccgtcttttcgcgcagccaggtgtaccagctcgagtccaccttcgacatgaagcgctacctgagcagctcggagcgcgcctgcctcgcctccagcctgcagctcacggagacccaggtaaagacttggttccagaaccgccgcaacaagtggaagcggcagctctcggctgagctggaggcggccaacatggcgcacgcgtcggcgcagactctggtgagcatgccgctggtgttccgggacagttcgctgctgcgcgtgccggtgccgcgctcgctcgcctttcccgcgccgctctactacccgggaagcaacctctcggccttacctctctacaacctatacaacaagctcgactactgaccggcccgccgccccgcgccgcccccagctgccc

SEQ ID NO: 105195 - DNA, 1027 bp, Homo sapiens
  misc_feature 1..1027: note = chr10:124910201-124911228
  misc_feature 1..1027: note = Hyper
  source 1..1027: mol_type = genomic DNA
gtgggcttggttacccggcatgataacgcacggaaggttttcaggtttttcggtggaaagacttgcatgcgtctgtctgtggaagtttggctcgctccacgtggagggtgggaccggggtcaggggttaaaggtcgggaccttggcgccgcccagactgcacgtggctggagctgcccgcccactctccctcctaacgcccagaatcgtcgcgcgggctggggcgcaccccggctggaatccagctcaagagtccgcgcggagaaagacaaagactgggaggcaggcctcgccatttaagcgattgccttctgggaacaagcgagctgggtgcccagcggcatattcccggcactgggctcgccttgagcttggccacagcagctcccgctatgacatgccctgtgccgcgcacttcctctccaggggtataaagcaggcgatggcgctgcttgtacctagtaaagcctccactttgctcgccgcgagcttggcgcgaccagcttgtcgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgcaaattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggccctatc

SEQ ID NO: 105196 - DNA, 30 bp, Homo sapiens; identical to SEQ ID NO: 70546
  misc_feature 1..30: note = chr10:124962095-124962125
  misc_feature 1..30: note = Hypo
  source 1..30: mol_type = genomic DNA

SEQ ID NO: 105197 - DNA, 30 bp, Homo sapiens; identical to SEQ ID NO: 70549
  misc_feature 1..30: note = chr10:125219999-125220029
  misc_feature 1..30: note = Hypo
  source 1..30: mol_type = genomic DNA

SEQ ID NO: 105198 - DNA, 194 bp, Homo sapiens; identical to SEQ ID NO: 70550
  misc_feature 1..194: note = chr10:125252113-125252307
  misc_feature 1..194: note = Hypo
  source 1..194: mol_type = genomic DNA

SEQ ID NO: 105199 - DNA, 572 bp, Homo sapiens
  misc_feature 1..572: note = chr10:125425515-125426087
  misc_feature 1..572: note = Hyper
  source 1..572: mol_type = genomic DNA
agcggagacagagctcgcgggcatggggtgagagcgggaggaagcagaggcagaggcggagcaggggcgcaggtgcctgcaacccaggatcccggggcgctaaaggcttcgggttctaccgcacgctcagtcgctggctccagaggtgctgctgggggccagggttcactgccgcgcgccaggtgcctgcccgtgaggcggcgcggggctcccgggtggctgcgcgcccagacgcctgcccgggaggccgcctgaggctccggggtggccgcgcgccctcctgggagccatggcggctggggccggtggtcgccgggcggcggcggcgccgaggggctgagccggccgcgggcagcgccatggcggcgccgggttgcggaccctgagcgccggcgcggggcgcgcaccatgaactcgtgggacgcgggcctggcggggctactggtgggcacgatgggcgtctcgctgctgtccaacgcgctggtgctgctctgcctgctgcacagcgcggacatccgccgccaggcgccggcgctcttcaccctgaacctcacgtgcgggaacctgctgtg

SEQ ID NO: 105200 - DNA, 717 bp, Homo sapiens
  misc_feature 1..717: note = chr10:125650749-125651466
  misc_feature 1..717: note = Hyper
  source 1..717: mol_type = genomic DNA
caacagggagattcccgggactggcccatcccagacacacacaatgggagaagccagttgtcccctggaggcgcgcaaccaccggcgccccctcgggctgcccagcgcagaaagttccttacctggtggaggcggctccggagccgacttctccctcttgggagctttcttgggcttggtggccctcttgggcggcctgggctcctgcgggcgccgctcccactcctccccgggccccgcaggcagcggcggagagaaggtctcgagctcgggctccgggcgcgcgtagtagggctcccggctccagatctcctgcccgtaataatcagggtcctcgagggctgcgccctgggctccgaccccggccagggtcactgccaggagcaccagggccagcgctggggtagcggtccccgggcgggacatgcctgctccgccccgcgcccagggcagggtcacggtcaccgggggcgccgggcgggctgcgggcgcagaagctggcgcggggcaagggcgcagggcacagcagagcggcgcgcttgggcgcgggaggcggccggctggctgcgcgtgtgaccggcccgcggggctgggctgggctgggccggggcggacaggggcgcgcagaggcgcggggcgggcgcaggggggccggccccgcccttccttcttccctccctttcccggcgacccctccgaggccggtccttggaggca

SEQ ID NO: 105201 - DNA, 110 bp, Homo sapiens; identical to SEQ ID NO: 70559
  misc_feature 1..110: note = chr10:125732094-125732204
  misc_feature 1..110: note = Hyper
  source 1..110: mol_type = genomic DNA

SEQ ID NO: 105202 - DNA, 764 bp, Homo sapiens; identical to SEQ ID NO: 70560
  misc_feature 1..764: note = chr10:125851165-125851929
  misc_feature 1..764: note = Hyper
  source 1..764: mol_type = genomic DNA

SEQ ID NO: 105203 - DNA, 1145 bp, Homo sapiens
  misc_feature 1..1145: note = chr10:125852132-125853277
  misc_feature 1..1145: note = Hyper
  source 1..1145: mol_type = genomic DNA
ctccccgcccggaaccgccgcaaggctagagccagggttctggaagcgcatccgagctcgcaaccggggagagagtggcggatgcccacttacctgccccgggccgcgcctggaaacttccccaaagtgcgataggggtgtgggggcggagcgcaaggctggggggaatccccgtcccctaccgccaaacgacgcgcgctcacaccgtgaaagcactggtctgtccgtcggtcggtcccccgcctgcggctcccagagctgggcggtgcaggggcgccccgattccgactactgggctccttctcccggacagcccgccggtgcgttccacgcggcttgcgccccccgccggcctccggctatccacggcgccaccacgccactgctcggtcccctgtcccctcgctccggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtctgcctgggccgccgccgccaccgccaccgccaccaccgcgccgggagcgccgcggggagtgaggctgcgcgccgcctccgccggcccggactccctacgcccagccccggccgccgccggcgctgcctggcccgaacccgcggaggggcgccggagccccgagcccagggccagacctcctaccgccgctcctcgccgaccccacctcggcgtctggcacctaacttgtacctgagaagcctgagtccagcccgggagcctctgcggctccggctccgcgggagcgcgcccagccccgagcctctagccccgcatccagggcgcgtcaacctgactccccgagcgctgggaggaaaagtttgggagtgacgtgcagacggcgaatgaaacatccgaggagaaccctccccccgccccatgtcgcgctgacacacatcagctccagtctggaatgtgagatcaaggcgtgtgcgccgagcggtgggtttggcccctgccccctccccctccgagtcaacactgct

SEQ ID NO: 105204 - DNA, 198 bp, Homo sapiens; identical to SEQ ID NO: 70563
  misc_feature 1..198: note = chr10:125853693-125853891
  misc_feature 1..198: note = Hyper
  source 1..198: mol_type = genomic DNA

SEQ ID NO: 105205 - DNA, 38 bp, Homo sapiens; identical to SEQ ID NO: 42679
  misc_feature 1..38: note = chr10:125919683-125919721
  misc_feature 1..38: note = Hypo
  source 1..38: mol_type = genomic DNA

SEQ ID NO: 105206 - DNA, 58 bp, Homo sapiens; identical to SEQ ID NO: 70567
  misc_feature 1..58: note = chr10:126077654-126077712
  misc_feature 1..58: note = Hyper
  source 1..58: mol_type = genomic DNA

SEQ ID NO: 105207 - DNA, 115 bp, Homo sapiens; identical to SEQ ID NO: 70568
  misc_feature 1..115: note = chr10:126083109-126083224
  misc_feature 1..115: note = Hypo
  source 1..115: mol_type = genomic DNA

SEQ ID NO: 105208 - DNA, 907 bp, Homo sapiens
  misc_feature 1..907: note = chr10:126135816-126136723
  misc_feature 1..907: note = Hyper
  source 1..907: mol_type = genomic DNA
ggacactttgaaggacggcagatccctgaccccttggtggcccgcgaggatcgcgggtgcgcgcggcgggcaggggtgcgctgacacccgcgcacctgcacccccggtggaggagccgagggcacacgacgatgccaatccctcgtgaatcccgcgaaagaggggccagggggctccggattcatagacgcggggcgtagaagggggtcaggtaggaaggcccaaggaacggcgcgaaagggctcccgggggcggcagccgtcagcgggaaggaggcggcggacgggaagaggacattggccgcggagtaggaggggaaagtctggaagtgcagagcgccggtgccgggagggccaggactgccccccgagccgccgccgccgccgccccccgccgcccctggctggggcgcgccaccccccacctgcgccgcgccgtcggcacccgggttctgcttcttccacttggtcctgcgattctggaaccagattttgacctgcgtctcggtgaggctgagagacagcgcgaggttcaggcgctcgcacactgacaggtagcgcgtggcccggaacttgttctccaaggccaccagctgctcgtaggtgaaggcggtgcgcgcgcgccgcggcttggcgcagttgggctccaggcgccggcgcctgggacgcggggagccgggggatcccgggggggacctcacagggccgcccccgccgtcctcgcagggctccccagacgccaatgccccggccggggcgtcaggtgagcgcgctaggcccggcagcaagcgcgcagcccgctcccgcagccgcggcctcctcggatcctccgcatcctcctcctcttccgcctcggaaccctccaggggggacgcctggccggcgcctgggcccgcagcatctagggg

SEQ ID NO: 105209 - DNA, 1885 bp, Homo sapiens; identical to SEQ ID NO: 70571
  misc_feature 1..1885: note = chr10:126137221-126139106
  misc_feature 1..1885: note = Hyper
  source 1..1885: mol_type = genomic DNA

SEQ ID NO: 105210 - DNA, 30 bp, Homo sapiens; identical to SEQ ID NO: 70572
  misc_feature 1..30: note = chr10:126184143-126184173
  misc_feature 1..30: note = Hypo
  source 1..30: mol_type = genomic DNA

SEQ ID NO: 105211 - DNA, 186 bp, Homo sapiens; identical to SEQ ID NO: 42680
  misc_feature 1..186: note = chr10:126198949-126199135
  misc_feature 1..186: note = Hypo
  source 1..186: mol_type = genomic DNA

SEQ ID NO: 105212 - DNA, 30 bp, Homo sapiens; identical to SEQ ID NO: 70574
  misc_feature 1..30: note = chr10:126254787-126254817
  misc_feature 1..30: note = Hypo
  source 1..30: mol_type = genomic DNA

SEQ ID NO: 105213 - DNA, 30 bp, Homo sapiens; identical to SEQ ID NO: 70575
  misc_feature 1..30: note = chr10:126278930-126278960
  misc_feature 1..30: note = Hypo
  source 1..30: mol_type = genomic DNA

SEQ ID NO: 105214 - DNA, 216 bp, Homo sapiens; identical to SEQ ID NO: 70576
  misc_feature 1..216: note = chr10:126314006-126314222
  misc_feature 1..216: note = Hypo
  source 1..216: mol_type = genomic DNA

SEQ ID NO: 105215 - DNA, 209 bp, Homo sapiens; identical to SEQ ID NO: 70577
  misc_feature 1..209: note = chr10:126314738-126314947
  misc_feature 1..209: note = Hypo
  source 1..209: mol_type = genomic DNA

SEQ ID NO: 105216 - DNA, 159 bp, Homo sapiens; identical to SEQ ID NO: 70578
  misc_feature 1..159: note = chr10:126331927-126332086
  misc_feature 1..159: note = Hypo
  source 1..159: mol_type = genomic DNA

SEQ ID NO: 105217 - DNA, 31 bp, Homo sapiens; identical to SEQ ID NO: 70579
  misc_feature 1..31: note = chr10:126479341-126479372
  misc_feature 1..31: note = Hypo
  source 1..31: mol_type = genomic DNA

SEQ ID NO: 105218 - DNA, 31 bp, Homo sapiens; identical to SEQ ID NO: 70580
  misc_feature 1..31: note = chr10:126479612-126479643
  misc_feature 1..31: note = Hypo
  source 1..31: mol_type = genomic DNA

SEQ ID NO: 105219 - DNA, 209 bp, Homo sapiens; identical to SEQ ID NO: 70581
  misc_feature 1..209: note = chr10:126697825-126698034
  misc_feature 1..209: note = Hypo
  source 1..209: mol_type = genomic DNA

SEQ ID NO: 105220 - DNA, 30 bp, Homo sapiens; identical to SEQ ID NO: 70582
  misc_feature 1..30: note = chr10:126710554-126710584
  misc_feature 1..30: note = Hypo
  source 1..30: mol_type = genomic DNA

SEQ ID NO: 105221 - DNA, 90 bp, Homo sapiens; identical to SEQ ID NO: 70583
  misc_feature 1..90: note = chr10:126712034-126712124
  misc_feature 1..90: note = Hypo
  source 1..90: mol_type = genomic DNA

SEQ ID NO: 105222 - DNA, 30 bp, Homo sapiens; identical to SEQ ID NO: 70584
  misc_feature 1..30: note = chr10:126744811-126744841
  misc_feature 1..30: note = Hypo
  source 1..30: mol_type = genomic DNA

SEQ ID NO: 105223 - DNA, 87 bp, Homo sapiens; identical to SEQ ID NO: 42687
  misc_feature 1..87: note = chr10:126809890-126809977
  misc_feature 1..87: note = Hypo
  source 1..87: mol_type = genomic DNA

SEQ ID NO: 105224 - DNA, 171 bp, Homo sapiens; identical to SEQ ID NO: 70586
  misc_feature 1..171: note = chr10:126814656-126814827
  misc_feature 1..171: note = Hypo
  source 1..171: mol_type = genomic DNA

SEQ ID NO: 105225 - DNA, 49 bp, Homo sapiens; identical to SEQ ID NO: 70587
  misc_feature 1..49: note = chr10:126847190-126847239
  misc_feature 1..49: note = Hyper
  source 1..49: mol_type = genomic DNA

SEQ ID NO: 105226 - DNA, 48 bp, Homo sapiens; identical to SEQ ID NO: 70588
  misc_feature 1..48: note = chr10:126850174-126850222
  misc_feature 1..48: note = Hyper
  source 1..48: mol_type = genomic DNA

SEQ ID NO: 105227 - DNA, 30 bp, Homo sapiens; identical to SEQ ID NO: 70590
  misc_feature 1..30: note = chr10:126881168-126881198
  misc_feature 1..30: note = Hypo
  source 1..30: mol_type = genomic DNA

SEQ ID NO: 105228 - DNA, 30 bp, Homo sapiens; identical to SEQ ID NO: 70591
  misc_feature 1..30: note = chr10:126914656-126914686
  misc_feature 1..30: note = Hypo
  source 1..30: mol_type = genomic DNA

SEQ ID NO: 105229 - DNA, 194 bp, Homo sapiens; identical to SEQ ID NO: 42689
  misc_feature 1..194: note = chr10:127380217-127380411
  misc_feature 1..194: note = Hypo
  source 1..194: mol_type = genomic DNA

SEQ ID NO: 105230 - DNA, 30 bp, Homo sapiens; identical to SEQ ID NO: 70593
  misc_feature 1..30: note = chr10:127445232-127445262
  misc_feature 1..30: note = Hypo
  source 1..30: mol_type = genomic DNA

SEQ ID NO: 105231 - DNA, 108 bp, Homo sapiens; identical to SEQ ID NO: 70594
  misc_feature 1..108: note = chr10:127451959-127452067
  misc_feature 1..108: note = Hypo
  source 1..108: mol_type = genomic DNA

SEQ ID NO: 105232 - DNA, 134 bp, Homo sapiens; identical to SEQ ID NO: 70595
  misc_feature 1..134: note = chr10:127463291-127463425
  misc_feature 1..134: note = Hypo
  source 1..134: mol_type = genomic DNA

SEQ ID NO: 105233 - DNA, 36 bp, Homo sapiens; identical to SEQ ID NO: 70596
  misc_feature 1..36: note = chr10:127464167-127464203
  misc_feature 1..36: note = Hypo
  source 1..36: mol_type = genomic DNA

SEQ ID NO: 105234 - DNA, 93 bp, Homo sapiens; identical to SEQ ID NO: 70597
  misc_feature 1..93: note = chr10:127475463-127475556
  misc_feature 1..93: note = Hypo
  source 1..93: mol_type = genomic DNA

SEQ ID NO: 105235 - DNA, 30 bp, Homo sapiens; identical to SEQ ID NO: 70598
  misc_feature 1..30: note = chr10:127568161-127568191
  misc_feature 1..30: note = Hypo
  source 1..30: mol_type = genomic DNA

SEQ ID NO: 105236 - DNA, 36 bp, Homo sapiens; identical to SEQ ID NO: 70599
  misc_feature 1..36: note = chr10:127582121-127582157
  misc_feature 1..36: note = Hypo
  source 1..36: mol_type = genomic DNA

SEQ ID NO: 105237 - DNA, 35 bp, Homo sapiens; identical to SEQ ID NO: 70600
  misc_feature 1..35: note = chr10:127601472-127601507
  misc_feature 1..35: note = Hypo
  source 1..35: mol_type = genomic DNA

SEQ ID NO: 105238 - DNA, 36 bp, Homo sapiens; identical to SEQ ID NO: 70601
  misc_feature 1..36: note = chr10:127753348-127753384
  misc_feature 1..36: note = Hypo
  source 1..36: mol_type = genomic DNA

SEQ ID NO: 105239 - DNA, 338 bp, Homo sapiens; identical to SEQ ID NO: 33489
  misc_feature 1..338: note = chr10:128075686-128076024
  misc_feature 1..338: note = Hyper
  source 1..338: mol_type = genomic DNA

SEQ ID NO: 105240 - DNA, 1201 bp, Homo sapiens
  misc_feature 1..1201: note = chr10:128076244-128077445
  misc_feature 1..1201: note = Hyper
  source 1..1201: mol_type = genomic DNA
tggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcccggagcgcacacgtccccgccccaggatgatgtggccgcagggcccggggcgcccggctgccaagcgcacatgcggcggcacggtccagcttttcaggctgaagctggaaacgatgactctgctactcgctccccggctctctgggaaccctcggagtgcgggtcaggtctccaccgcggcccacagcccggcgcgcgaccccg

SEQ ID NO: 105241 - DNA, 32 bp, Homo sapiens; identical to SEQ ID NO: 70608
  misc_feature 1..32: note = chr10:128593761-128593793
  misc_feature 1..32: note = Hyper
  source 1..32: mol_type = genomic DNA

SEQ ID NO: 105242 - DNA, 203 bp, Homo sapiens; identical to SEQ ID NO: 70611
  misc_feature 1..203: note = chr10:128888576-128888779
  misc_feature 1..203: note = Hypo
  source 1..203: mol_type = genomic DNA

SEQ ID NO: 105243 - DNA, 992 bp, Homo sapiens
  misc_feature 1..992: note = chr10:128993490-128994482
  misc_feature 1..992: note = Hyper
  source 1..992: mol_type = genomic DNA
ctccaggagctgccccgaccccgggctgcccgcgggctccctcctccctcctgccctcgcccgccagctcgcagtctcttaggtctgcagcgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccgctgcgcgcctgctgcccgccccctccaccgctgccggcccggccctgctggccc

SEQ ID NO: 105244 - DNA, 225 bp, Homo sapiens; identical to SEQ ID NO: 70614
  misc_feature 1..225: note = chr10:128994686-128994911
  misc_feature 1..225: note = Hyper
  source 1..225: mol_type = genomic DNA

SEQ ID NO: 105245 - DNA, 1662 bp, Homo sapiens
  misc_feature 1..1662: note = chr10:129534660-129536322
  misc_feature 1..1662: note = Hyper
  source 1..1662: mol_type = genomic DNA
cagcagagagcttggcgctctccgctctgcgcgcccgaggtcacagcgcggagaaacctggcggggccccggactccccggcttgggaaaagcgatgactgccctgaactgctggggcgttcgaaatttccagggtcccgaccctccgtggggtacgcgcgacttcggcgcagatgtcagtccgctgccttccgggttgagggagcgaggactccagacgaccccagggccgctgtccaggcccagccccgcgttctccacctcgccacctcgctctgcggctccagcctggagatctacggacttcattgcgatctcttgcgcagtgtagtcgccctctatccctagccccgagtcccgggtaacccaggggccccggcgaggcgagtttctttggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggtcgcacccgggcgctgctggcggccaagctggatgggtcgccagtgagtttcggtgcggcaccgctggcccaggcccgggcgcggctggacatggccacctactgcgacgacctgggcccctcctcggccccgcccggccaggcccaggccaccgcgcaccccccgggctatgagccaggggatctgggcgcggtgggcgggggccccctcctgtgggtgaacgcgccagcgctcagccccaagtcctacgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacagcggctgagcccaccacaggcccgcgtttacagtgcggcggtcccggggctctcaatctctgtgcgctccttcggaggaagaagcgggagagccagcaa

SEQ ID NO: 105246 - DNA, 30 bp, Homo sapiens; identical to SEQ ID NO: 70618
  misc_feature 1..30: note = chr10:129684716-129684746
  misc_feature 1..30: note = Hypo
  source 1..30: mol_type = genomic DNA

SEQ ID NO: 105247 - DNA, 402 bp, Homo sapiens; identical to SEQ ID NO: 70619
  misc_feature 1..402: note = chr10:129705629-129706031
  misc_feature 1..402: note = Hyper
  source 1..402: mol_type = genomic DNA

SEQ ID NO: 105248 - DNA, 30 bp, Homo sapiens; identical to SEQ ID NO: 70620
  misc_feature 1..30: note = chr10:129885942-129885972
  misc_feature 1..30: note = Hypo
  source 1..30: mol_type = genomic DNA

SEQ ID NO: 105249 - DNA, 135 bp, Homo sapiens; identical to SEQ ID NO: 42695
  misc_feature 1..135: note = chr10:129888855-129888990
  misc_feature 1..135: note = Hypo
  source 1..135: mol_type = genomic DNA

SEQ ID NO: 105250 - DNA, 30 bp, Homo sapiens; identical to SEQ ID NO: 70622
  misc_feature 1..30: note = chr10:129897051-129897081
  misc_feature 1..30: note = Hypo
  source 1..30: mol_type = genomic DNA

SEQ ID NO: 105251 - DNA, 117 bp, Homo sapiens; identical to SEQ ID NO: 70623
  misc_feature 1..117: note = chr10:129914687-129914804
  misc_feature 1..117: note = Hypo
  source 1..117: mol_type = genomic DNA

SEQ ID NO: 105252 - DNA, 122 bp, Homo sapiens; identical to SEQ ID NO: 70624
  misc_feature 1..122: note = chr10:129925726-129925848
  misc_feature 1..122: note = Hypo
  source 1..122: mol_type = genomic DNA

SEQ ID NO: 105253 - DNA, 24 bp, Homo sapiens
  misc_feature 1..24: note = chr10:129947242-129947266
  misc_feature 1..24: note = Hypo
  source 1..24: mol_type = genomic DNA
taggtgatgggtacacggggtttg

SEQ ID NO: 105254 - DNA, 211 bp, Homo sapiens; identical to SEQ ID NO: 70626
  misc_feature 1..211: note = chr10:129947985-129948196
  misc_feature 1..211: note = Hyper
  source 1..211: mol_type = genomic DNA

SEQ ID NO: 105255 - DNA, 30 bp, Homo sapiens; identical to SEQ ID NO: 33501
  misc_feature 1..30: note = chr10:129948725-129948755
  misc_feature 1..30: note = Hyper
  source 1..30: mol_type = genomic DNA

SEQ ID NO: 105256 - DNA, 17 bp, Homo sapiens
  misc_feature 1..17: note = chr10:129953663-129953680
  misc_feature 1..17: note = Hypo
  source 1..17: mol_type = genomic DNA
attatttttttgagacg

SEQ ID NO: 105257 - DNA, 735 bp, Homo sapiens
  misc_feature 1..735: note = chr10:130008498-130009233
  misc_feature 1..735: note = Hyper
  source 1..735: mol_type = genomic DNA
cacagtaatcagaggcggcctttacaaatagattgcatttgaccttgttggtttgatggacgggagtggagtccggccgcggacggcgtcccttccagggccggccgccagagggcgagcgcgccttcccgggcggggcggggacgggacggggacggggaggggacgggacggggacggggaggggacggggacacggacacgggaggcttccgctcgcccgcgggtggcgtctctgctcccactagagcgggccaggcctctgggttccgtttctcaagcacacagggagggtggccgcgggccaggggcggccgcgagactccacgtccacgtcccgggcagtccctccggaggttgggccgcgcggcccggggagcggagcgctgcgcttctctgcgagcaccccggggcctttaggcgcccccgtttcctcgtcagtggggggcgcggtgccgcttctccgcgggctaaactgctgaggaaggggcgagttcctgcggcccctgcctgtcccggccacgccccacctccgccccgccgcgttgcgcgttcccgcggggccccgggcacccctggggccccggggatctctgacgcccccttccctccaacccccgctgcgatcccacaggtggggtgaacagcgcccctgctgtcccacggggcgtcttcgcgggtgatgcccacactctcagcctgaagagcaggacctgtccgcgggtggggcccacc

SEQ ID NO: 105258 - DNA, 53 bp, Homo sapiens; identical to SEQ ID NO: 70631
  misc_feature 1..53: note = chr10:130012130-130012183
  misc_feature 1..53: note = Hypo
  source 1..53: mol_type = genomic DNA

SEQ ID NO: 105259 - DNA, 104 bp, Homo sapiens; identical to SEQ ID NO: 70632
  misc_feature 1..104: note = chr10:130065661-130065765
  misc_feature 1..104: note = Hypo
  source 1..104: mol_type = genomic DNA

SEQ ID NO: 105260 - DNA, 545 bp, Homo sapiens
  misc_feature 1..545: note = chr10:130084893-130085438
  misc_feature 1..545: note = Hyper
  source 1..545: mol_type = genomic DNA
taccagcacctgggccgtagttgtctcctggctcctggggtccgcggagctctagatgtacctgcagctcctcccgagtcctgcaagccacccttgtccctcttctcccgctcaccccccggcccccccatctcttttgctattccggggaaggccacgcagggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtcggaggagcccccgcccgccggcggccagcgcacagcccggccaggggcgccctccctgccgccgccggccctttgatcgcccgcggcccgcggcccgcagaccacagccagcgctgtgctgggcaggtggcggcagcggggcgcggcgcgctcaggcgcacgggtccccgggccgcggcgcgctccccgccacgccgcacatcaaggcccggccggccggcgggcgccttcattagcag

SEQ ID NO: 105261 - DNA, 34 bp, Homo sapiens; identical to SEQ ID NO: 70636
  misc_feature 1..34: note = chr10:130166708-130166742
  misc_feature 1..34: note = Hypo
  source 1..34: mol_type = genomic DNA

SEQ ID NO: 105262 - DNA, 232 bp, Homo sapiens; identical to SEQ ID NO: 70637
  misc_feature 1..232: note = chr10:130203334-130203566
  misc_feature 1..232: note = Hypo
  source 1..232: mol_type = genomic DNA

SEQ ID NO: 105263 - DNA, 36 bp, Homo sapiens; identical to SEQ ID NO: 70638
  misc_feature 1..36: note = chr10:130268452-130268488
  misc_feature 1..36: note = Hypo
  source 1..36: mol_type = genomic DNA

SEQ ID NO: 105264 - DNA, 53 bp, Homo sapiens; identical to SEQ ID NO: 70639
  misc_feature 1..53: note = chr10:130268909-130268962
  misc_feature 1..53: note = Hypo
  source 1..53: mol_type = genomic DNA

SEQ ID NO: 105265 - DNA, 30 bp, Homo sapiens; identical to SEQ ID NO: 70641
  misc_feature 1..30: note = chr10:130299142-130299172
  misc_feature 1..30: note = Hypo
  source 1..30: mol_type = genomic DNA

SEQ ID NO: 105266 - DNA, 176 bp, Homo sapiens; identical to SEQ ID NO: 70642
  misc_feature 1..176: note = chr10:130317077-130317253
  misc_feature 1..176: note = Hypo
  source 1..176: mol_type = genomic DNA

SEQ ID NO: 105267 - DNA, 207 bp, Homo sapiens
  misc_feature 1..207: note = chr10:130338788-130338995
  misc_feature 1..207: note = Hyper
  source 1..207: mol_type = genomic DNA
cgtaactttgggggtcggctccctgggcccccagctcacgatgcccgctaggagccggcgccggggcgccccaaggctgcctccccccgcagcgctgcgcagtgcgccctggtgggatggggacgctgcacccctgaacccccccaaatccggcaggcctagggctggaggcgcggaaaccctcactcctgccgagctcccgagcgg

SEQ ID NO: 105268 - DNA, 89 bp, Homo sapiens; identical to SEQ ID NO: 70644
  misc_feature 1..89: note = chr10:130339328-130339417
  misc_feature 1..89: note = Hyper
  source 1..89: mol_type = genomic DNA

SEQ ID NO: 105269 - DNA, 137 bp, Homo sapiens
  misc_feature 1..137: note = chr10:130339653-130339790
  misc_feature 1..137: note = Hyper
  source 1..137: mol_type = genomic DNA
tatgtgcataaccttcgctgtctcgctaaaggtcagcgcgcccctgctcatttcccgggctgccttttgggggcactctgatgccggggatttcctcgggtgttggggaaacaagacgtgctcgcctaacaaagact

SEQ ID NO: 105270 - DNA, 29 bp, Homo sapiens
  misc_feature 1..29: note = chr10:130402649-130402678
  misc_feature 1..29: note = Hypo
  source 1..29: mol_type = genomic DNA
tggagtgcgatggcacgatctgagcgtgc

SEQ ID NO: 105271 - DNA, 30 bp, Homo sapiens; identical to SEQ ID NO: 70650
  misc_feature 1..30: note = chr10:130520011-130520041
  misc_feature 1..30: note = Hypo
  source 1..30: mol_type = genomic DNA

SEQ ID NO: 105272 - DNA, 63 bp, Homo sapiens; identical to SEQ ID NO: 70651
  misc_feature 1..63: note = chr10:130546173-130546236
  misc_feature 1..63: note = Hypo
  source 1..63: mol_type = genomic DNA

SEQ ID NO: 105273 - DNA, 243 bp, Homo sapiens; identical to SEQ ID NO: 70652
  misc_feature 1..243: note = chr10:130577739-130577982
  misc_feature 1..243: note = Hypo
  source 1..243: mol_type = genomic DNA

SEQ ID NO: 105274 - DNA, 20 bp, Homo sapiens
  misc_feature 1..20: note = chr10:130754356-130754376
  misc_feature 1..20: note = Hypo
  source 1..20: mol_type = genomic DNA
gacgccgatgctcctgcaga

SEQ ID NO: 105275 - DNA, 22 bp, Homo sapiens
  misc_feature 1..22: note = chr10:130803707-130803729
  misc_feature 1..22: note = Hypo
  source 1..22: mol_type = genomic DNA
agaactgaggccaggcgcggtg

SEQ ID NO: 105276 - DNA, 30 bp, Homo sapiens; identical to SEQ ID NO: 70656
  misc_feature 1..30: note = chr10:130829116-130829146
  misc_feature 1..30: note = Hypo
  source 1..30: mol_type = genomic DNA

SEQ ID NO: 105277 - DNA, 110 bp, Homo sapiens; identical to SEQ ID NO: 70657
  misc_feature 1..110: note = chr10:130829975-130830085
  misc_feature 1..110: note = Hyper
  source 1..110: mol_type = genomic DNA

SEQ ID NO: 105278 - DNA, 85 bp, Homo sapiens; identical to SEQ ID NO: 70658
  misc_feature 1..85: note = chr10:130855248-130855333
  misc_feature 1..85: note = Hypo
  source 1..85: mol_type = genomic DNA

SEQ ID NO: 105279 - DNA, 144 bp, Homo sapiens; identical to SEQ ID NO: 70659
  misc_feature 1..144: note = chr10:130855393-130855537
  misc_feature 1..144: note = Hypo
  source 1..144: mol_type = genomic DNA

SEQ ID NO: 105280 - DNA, 30 bp, Homo sapiens; identical to SEQ ID NO: 70660
  misc_feature 1..30: note = chr10:130911792-130911822
  misc_feature 1..30: note = Hypo
  source 1..30: mol_type = genomic DNA

SEQ ID NO: 105281 - DNA, 152 bp, Homo sapiens; identical to SEQ ID NO: 70661
  misc_feature 1..152: note = chr10:130914837-130914989
  misc_feature 1..152: note = Hypo
  source 1..152: mol_type = genomic DNA

SEQ ID NO: 105282 - DNA, 41 bp, Homo sapiens; identical to SEQ ID NO: 70662
  misc_feature 1..41: note = chr10:130938219-130938260
  misc_feature 1..41: note = Hypo
  source 1..41: mol_type = genomic DNA

SEQ ID NO: 105283 - DNA, 179 bp, Homo sapiens; identical to SEQ ID NO: 42702
  misc_feature 1..179: note = chr10:130946123-130946302
  misc_feature 1..179: note = Hypo
  source 1..179: mol_type = genomic DNA

SEQ ID NO: 105284 - DNA, 134 bp, Homo sapiens; identical to SEQ ID NO: 70664
  misc_feature 1..134: note = chr10:131034780-131034914
  misc_feature 1..134: note = Hypo
  source 1..134: mol_type = genomic DNA

SEQ ID NO: 105285 - DNA, 30 bp, Homo sapiens; identical to SEQ ID NO: 70665
  misc_feature 1..30: note = chr10:131058458-131058488
  misc_feature 1..30: note = Hypo
  source 1..30: mol_type = genomic DNA

SEQ ID NO: 105286 - DNA, 208 bp, Homo sapiens; identical to SEQ ID NO: 42704
  misc_feature 1..208: note = chr10:131058908-131059116
  misc_feature 1..208: note = Hypo
  source 1..208: mol_type = genomic DNA

SEQ ID NO: 105287 - DNA, 81 bp, Homo sapiens; identical to SEQ ID NO: 70667
  misc_feature 1..81: note = chr10:131146694-131146775
  misc_feature 1..81: note = Hypo
  source 1..81: mol_type = genomic DNA

SEQ ID NO: 105288 - DNA, 30 bp, Homo sapiens; identical to SEQ ID NO: 70668
  misc_feature 1..30: note = chr10:131171764-131171794
  misc_feature 1..30: note = Hypo
  source 1..30: mol_type = genomic DNA

SEQ ID NO: 105289 - DNA, 49 bp, Homo sapiens; identical to SEQ ID NO: 70669
  misc_feature 1..49: note = chr10:131265287-131265336
  misc_feature 1..49: note = Hyper
  source 1..49: mol_type = genomic DNA

SEQ ID NO: 105290 - DNA, 47 bp, Homo sapiens; identical to SEQ ID NO: 70671
  misc_feature 1..47: note = chr10:131323870-131323917
  misc_feature 1..47: note = Hypo
  source 1..47: mol_type = genomic DNA

SEQ ID NO: 105291 - DNA, 30 bp, Homo sapiens; identical to SEQ ID NO: 70674
  misc_feature 1..30: note = chr10:131377867-131377897
  misc_feature 1..30: note = Hypo
  source 1..30: mol_type = genomic DNA

SEQ ID NO: 105292 - DNA, 30 bp, Homo sapiens; identical to SEQ ID NO: 70677
  misc_feature 1..30: note = chr10:131456424-131456454
  misc_feature 1..30: note = Hypo
  source 1..30: mol_type = genomic DNA

SEQ ID NO: 105293 - DNA, 30 bp, Homo sapiens; identical to SEQ ID NO: 70678
  misc_feature 1..30: note = chr10:131503379-131503409
  misc_feature 1..30: note = Hypo
  source 1..30: mol_type = genomic DNA

SEQ ID NO: 105294 - DNA, 30 bp, Homo sapiens; identical to SEQ ID NO: 70679
  misc_feature 1..30: note = chr10:131510626-131510656
  misc_feature 1..30: note = Hypo
  source 1..30: mol_type = genomic DNA

SEQ ID NO: 105295 - DNA, 30 bp, Homo sapiens; identical to SEQ ID NO: 70680
  misc_feature 1..30: note = chr10:131592644-131592674
  misc_feature 1..30: note = Hypo
  source 1..30: mol_type = genomic DNA

SEQ ID NO: 105296 - DNA, 213 bp, Homo sapiens; identical to SEQ ID NO: 70681
  misc_feature 1..213: note = chr10:131606675-131606888
  misc_feature 1..213: note = Hypo
  source 1..213: mol_type = genomic DNA

SEQ ID NO: 105297 - DNA, 36 bp, Homo sapiens; identical to SEQ ID NO: 70682
  misc_feature 1..36: note = chr10:131636273-131636309
  misc_feature 1..36: note = Hypo
  source 1..36: mol_type = genomic DNA

SEQ ID NO: 105298 - DNA, 120 bp, Homo sapiens; identical to SEQ ID NO: 42706
  misc_feature 1..120: note = chr10:131641071-131641191
  misc_feature 1..120: note = Hypo
  source 1..120: mol_type = genomic DNA

SEQ ID NO: 105299 - DNA, 218 bp, Homo sapiens; identical to SEQ ID NO: 42707
  misc_feature 1..218: note = chr10:131647719-131647937
  misc_feature 1..218: note = Hypo
  source 1..218: mol_type = genomic DNA

SEQ ID NO: 105300 - DNA, 174 bp, Homo sapiens; identical to SEQ ID NO: 70685
  misc_feature 1..174: note = chr10:131739036-131739210
  misc_feature 1..174: note = Hypo
  source 1..174: mol_type = genomic DNA

SEQ ID NO: 105301 - DNA, 30 bp, Homo sapiens; identical to SEQ ID NO: 42709
  misc_feature 1..30: note = chr10:131739627-131739657
  misc_feature 1..30: note = Hypo
  source 1..30: mol_type = genomic DNA

SEQ ID NO: 105302 - DNA, 1316 bp, Homo sapiens
  misc_feature 1..1316: note = chr10:131757029-131758345
  misc_feature 1..1316: note = Hyper
  source 1..1316: mol_type = genomic DNA
gagcgcgggctcctccgcggcccggcgcgcggcctcgggccgattacatttcaatcgatgcccttcccggagctgggcggggtggcggcgcctggacgcggcgtcctttgtagacgcagctggcgccgaggcagcccgcgcccccgccgcccgccgcccgccgctcacctgcacatgatctcgtgggtcagcagcacacggcacatctccgggttcttgtcctggccctcgtagacgatggcctgcgcgagggacaagcagaggctggggttacgcggcgcccgcggctttggcgccaaatcgccccgggcgctgcaggcctggctggcagcaggtgcaccacgctcgaggggaggcgatgcgcccccctccctcggccaccctcccgatggggtcaccctcggagctgggctaggccgcgatggcttctccctcccctgcctcccagcctcctcccccgggcgcccgccaggcctgcgaggggccttcggctgcagggaaggcgccgactgggctcgggccgcggggagggcagggcgagggaggccggggccggggcgcaaggagcgagagcccgctggcaccgaccccggaacccggggctcccgggccccttcggcattccgcgccgccgccaggccgcgtcctcaggccattgtctacaacgagttccaatctgcatgttgggagaggccgatcagaacgccccgaggctaaagaagcagggaaggatggtcgcggcgcaggagcagtttgccaagggccgagggccgcgcccgccctgccctgcgcgctcccccggctctagcaagtctggcgccccgcggcttcccgcggcttcccgcgttccaaacccaggcgcccgcggggagcaggccgccctggaccggccgccgtcccgagctcccggggcctccctgagtggtgggcagcgacctggcctctgcacgctgcgggcggcctgggagcccaggcgggaggcccaggagcagcaaccgcacgtgggccgcggcgtcgccagcgccccgcaggagtgccggggccccagggcgcccgagcccgcgcggccacgtgctcctcgccggatgatatttggaaagaaagtgctaatggccaatctggtgtttattttgaaactgctaacagtgatttttctcgggtaaaaaggcagtctctgcgcgcacgctcgggtgggttttgagcagaggctccgccagatggtgcgaagccctaggtgcgctcacggccgcgctcagcccggctccgccgctgggaacccgagctggggatcgggagccgcccgcccgggctgggcc

SEQ ID NO: 105303 - DNA, 2936 bp, Homo sapiens
  misc_feature 1..2936: note = chr10:131761007-131763943
  misc_feature 1..2936: note = Hyper
  source 1..2936: mol_type = genomic DNA
tacttcaagccccaccggttaatcatgtgaagtgccatcgacttattgatcgtttatgttttgttttccttctatgccatgagaagatttcgtgtttacatccatgtcattttaatctcaaatctttatgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttcttacgcacagcgagtgacaaagaaggctccggtctctccgggccgacgggaagcgcgcccggcctctccggcgacccggagccgggtgtctggctgcgcgacctgcgcggtggccagaccgccctggagccaactgctccaaaaaccaagcggacgccgcgggcgctgtggcccggccctcggagccgccggacccgggtgagcgcgcggcgcgcggcttcccgacctggtttctaggaatcgggagggcagccgggcgcgggcagactgtgggccccgcggcccagctcctgtagccgggactccgcgcccaggagcgcggcccgcccaaaggacgtctgcgcgacacggagcagagacccaggggacgaccaggaactgtcctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacccccacgcctcttggaagga

SEQ ID NO: 105304 - DNA, 30 bp, Homo sapiens; identical to SEQ ID NO: 70692
  misc_feature 1..30: note = chr10:131767417-131767447
  misc_feature 1..30: note = Hyper
  source 1..30: mol_type = genomic DNA

SEQ ID NO: 105305 - DNA, 1645 bp, Homo sapiens
  misc_feature 1..1645: note = chr10:131768685-131770330
  misc_feature 1..1645: note = Hyper
  source 1..1645: mol_type = genomic DNA
cttctggaagctaaccgcgcacaaaagtttgccaataaaattctagtttgaaaccgcggtttgccaacacgagtaaaggaagttggggtggtggagagctacagtgggcacggacggaaagggtggccacggtcaccgatgtactaatgtcctcctcctcggctacccgatctcactccttcacagcaccttaacagagtgtatacacccgttctggtgcgcaaaagtggggcgatgggtgccggcggccgggccggggagtccgtccgggtaattaactcagctccggcgactgcgacgatgaggccgggagggaaggaagagcataccgctcttggacagaaatgtgtcaagctctcctcccttccagcctgcataaaccctttcgcgcacattcgcgcgacttctaagggatccaagccagcggactgggtccagcagcgcgcggcggcgggacgcacccctcctctccccccaggaaggcgggtgcacgccggggctggaagggggagggtgcacctctggctacaaattcggccgcgaagagattctttaccaactctaagggtttgctgaatgtacagaccagaatgagtcccgttaaaaggaagctattcccacattaaacatgtgtgttttccatactaatggagtcacttaaagctgttgctaatttaactttttaaaaaggccacactgtggaaatttgcattttctttaggacattgaaatgaagagaaaactgctgggcggcaaggcggcccagggcatagctaggggccatgtagaaataaaaacagataaagaaaagaagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcactatattaaaactttcgaaatgaaggcgctctcctgcctgcgatttttaggtaca

SEQ ID NO: 105306 - DNA, 889 bp, Homo sapiens
  misc_feature 1..889: note = chr10:131770569-131771458
  misc_feature 1..889: note = Hyper
  source 1..889: mol_type = genomic DNA
ttttggttgttaatccgaaaggaggagttttaattgcttcctgcgttgtcgtccaggcatctaggcgcttcgaccttccccatccctctctccaagggtctggcgtttgtactgggggaagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgcccgcgctcccgtaggcgagaggagcgcacccggctccggggccccggcaacccggcccccagcgttcagtgtccggcccgccacgcgcgaagttcaactttgctggcgccgcggccgcctgggggccgcgggctggggcggggagcccccgacgggatcgagagcgcgcttacctgtgccgctcactcgacggacatcgcgggcgccccggccgcgaggtgtcggcggcgccggctgcgggccgggaggtgggcggccccgcgccttcccacgttcccacctcccgccctcccgggagagcccacgggcccggccgcgagcacgccagtgcgcacgcgccacactgccttccaccgcgggcggcgggctagggccgagcgggggcgcgtggaggtgcccgtaggcggcccagcggcccgcctgccaccgtgccccggggccgcagctgcgcccagcgctagccacctgga

SEQ ID NO: 105307 - DNA, 315 bp, Homo sapiens; identical to SEQ ID NO: 70698
  misc_feature 1..315: note = chr10:131825216-131825531
  misc_feature 1..315: note = Hypo
  source 1..315: mol_type = genomic DNA

SEQ ID NO: 105308 - DNA, 786 bp, Homo sapiens; identical to SEQ ID NO: 70699
  misc_feature 1..786: note = chr10:131843979-131844765
  misc_feature 1..786: note = Hypo
  source 1..786: mol_type = genomic DNA

SEQ ID NO: 105309 - DNA, 211 bp, Homo sapiens; identical to SEQ ID NO: 70700
  misc_feature 1..211: note = chr10:131845025-131845236
  misc_feature 1..211: note = Hypo
  source 1..211: mol_type = genomic DNA

SEQ ID NO: 105310 - DNA, 32 bp, Homo sapiens; identical to SEQ ID NO: 70701
  misc_feature 1..32: note = chr10:131851993-131852025
  misc_feature 1..32: note = Hypo
  source 1..32: mol_type = genomic DNA

SEQ ID NO: 105311 - DNA, 86 bp, Homo sapiens; identical to SEQ ID NO: 70702
  misc_feature 1..86: note = chr10:131936580-131936666
  misc_feature 1..86: note = Hypo
  source 1..86: mol_type = genomic DNA

SEQ ID NO: 105312 - DNA, 94 bp, Homo sapiens; identical to SEQ ID NO: 70703
  misc_feature 1..94: note = chr10:131937390-131937484
  misc_feature 1..94: note = Hypo
  source 1..94: mol_type = genomic DNA

SEQ ID NO: 105313 - DNA, 39 bp, Homo sapiens; identical to SEQ ID NO: 70704
  misc_feature 1..39: note = chr10:131987277-131987316
  misc_feature 1..39: note = Hypo
  source 1..39: mol_type = genomic DNA

SEQ ID NO: 105314 - DNA, 30 bp, Homo sapiens; identical to SEQ ID NO: 70705
  misc_feature 1..30: note = chr10:131988259-131988289
  misc_feature 1..30: note = Hypo
  source 1..30: mol_type = genomic DNA

SEQ ID NO: 105315 - DNA, 44 bp, Homo sapiens; identical to SEQ ID NO: 70706
  misc_feature 1..44: note = chr10:131988602-131988646
  misc_feature 1..44: note = Hyper
  source 1..44: mol_type = genomic DNA

SEQ ID NO: 105316 - DNA, 262 bp, Homo sapiens; identical to SEQ ID NO: 70707
  misc_feature 1..262: note = chr10:132001274-132001536
  misc_feature 1..262: note = Hypo
  source 1..262: mol_type = genomic DNA

SEQ ID NO: 105317 - DNA, 35 bp, Homo sapiens; identical to SEQ ID NO: 70708
  misc_feature 1..35: note = chr10:132005005-132005040
  misc_feature 1..35: note = Hypo
  source 1..35: mol_type = genomic DNA

SEQ ID NO: 105318 - DNA, 75 bp, Homo sapiens; identical to SEQ ID NO: 70709
  misc_feature 1..75: note = chr10:132050760-132050835
  misc_feature 1..75: note = Hypo
  source 1..75: mol_type = genomic DNA

SEQ ID NO: 105319 - DNA, 98 bp, Homo sapiens; identical to SEQ ID NO: 70710
  misc_feature 1..98: note = chr10:132229336-132229434
  misc_feature 1..98: note = Hypo
  source 1..98: mol_type = genomic DNA

SEQ ID NO: 105320 - DNA, 30 bp, Homo sapiens; identical to SEQ ID NO: 70711
  misc_feature 1..30: note = chr10:132237416-132237446
  misc_feature 1..30: note = Hypo
  source 1..30: mol_type = genomic DNA

SEQ ID NO: 105321 - DNA, 30 bp, Homo sapiens; identical to SEQ ID NO: 70712
  misc_feature 1..30: note = chr10:132280529-132280559
  misc_feature 1..30: note = Hypo
  source 1..30: mol_type = genomic DNA

SEQ ID NO: 105322 - DNA, 30 bp, Homo sapiens; identical to SEQ ID NO: 70713
  misc_feature 1..30: note = chr10:132290329-132290359
  misc_feature 1..30: note = Hypo
  source 1..30: mol_type = genomic DNA

SEQ ID NO: 105323 - DNA, 30 bp, Homo sapiens; identical to SEQ ID NO: 70714
  misc_feature 1..30: note = chr10:132308764-132308794
  misc_feature 1..30: note = Hypo
  source 1..30: mol_type = genomic DNA

SEQ ID NO: 105324 - DNA, 92 bp, Homo sapiens; identical to SEQ ID NO: 70715
  misc_feature 1..92: note = chr10:132317215-132317307
  misc_feature 1..92: note = Hypo
  source 1..92: mol_type = genomic DNA

SEQ ID NO: 105325 - DNA, 247 bp, Homo sapiens; identical to SEQ ID NO: 70716
  misc_feature 1..247: note = chr10:132365670-132365917
  misc_feature 1..247: note = Hypo
  source 1..247: mol_type = genomic DNA

SEQ ID NO: 105326 - DNA, 30 bp, Homo sapiens; identical to SEQ ID NO: 70717
  misc_feature 1..30: note = chr10:132447397-132447427
  misc_feature 1..30: note = Hypo
  source 1..30: mol_type = genomic DNA

SEQ ID NO: 105327 - DNA, 174 bp, Homo sapiens; identical to SEQ ID NO: 42719
  misc_feature 1..174: note = chr10:132525800-132525974
  misc_feature 1..174: note = Hypo
  source 1..174: mol_type = genomic DNA

SEQ ID NO: 105328 - DNA, 165 bp, Homo sapiens; identical to SEQ ID NO: 42720
  misc_feature 1..165: note = chr10:132586486-132586651
  misc_feature 1..165: note = Hypo
  source 1..165: mol_type = genomic DNA

SEQ ID NO: 105329 - DNA, 30 bp, Homo sapiens; identical to SEQ ID NO: 70720
  misc_feature 1..30: note = chr10:132600977-132601007
  misc_feature 1..30: note = Hypo
  source 1..30: mol_type = genomic DNA

SEQ ID NO: 105330 - DNA, 194 bp, Homo sapiens; identical to SEQ ID NO: 70721
  misc_feature 1..194: note = chr10:132609120-132609314
  misc_feature 1..194: note = Hypo
  source 1..194: mol_type = genomic DNA

SEQ ID NO: 105331 - DNA, 150 bp, Homo sapiens; identical to SEQ ID NO: 70723
  misc_feature 1..150: note = chr10:132768174-132768324
  misc_feature 1..150: note = Hypo
  source 1..150: mol_type = genomic DNA

SEQ ID NO: 105332 - DNA, 194 bp, Homo sapiens; identical to SEQ ID NO: 70724
  misc_feature 1..194: note = chr10:132811723-132811917
  misc_feature 1..194: note = Hypo
  source 1..194: mol_type = genomic DNA

SEQ ID NO: 105333 - DNA, 164 bp, Homo sapiens; identical to SEQ ID NO: 42723
  misc_feature 1..164: note = chr10:132818146-132818310
  misc_feature 1..164: note = Hypo
  source 1..164: mol_type = genomic DNA

SEQ ID NO: 105334 - DNA, 124 bp, Homo sapiens; identical to SEQ ID NO: 70726
  misc_feature 1..124: note = chr10:132859296-132859420
  misc_feature 1..124: note = Hypo
  source 1..124: mol_type = genomic DNA

SEQ ID NO: 105335 - DNA, 35 bp, Homo sapiens; identical to SEQ ID NO: 70727
  misc_feature 1..35: note = chr10:132871489-132871524
  misc_feature 1..35: note = Hypo
  source 1..35: mol_type = genomic DNA

SEQ ID NO: 105336 - DNA, 141 bp, Homo sapiens; identical to SEQ ID NO: 70728
  misc_feature 1..141: note = chr10:132873732-132873873
  misc_feature 1..141: note = Hypo
  source 1..141: mol_type = genomic DNA

SEQ ID NO: 105337 - DNA, 155 bp, Homo sapiens; identical to SEQ ID NO: 70729
  misc_feature 1..155: note = chr10:132893493-132893648
  misc_feature 1..155: note = Hypo
  source 1..155: mol_type = genomic DNA

SEQ ID NO: 105338 - DNA, 182 bp, Homo sapiens; identical to SEQ ID NO: 70730
  misc_feature 1..182: note = chr10:132976493-132976675
  misc_feature 1..182: note = Hypo
  source 1..182: mol_type = genomic DNA

SEQ ID NO: 105339 - DNA, 191 bp, Homo sapiens; identical to SEQ ID NO: 42726
  misc_feature 1..191: note = chr10:132977044-132977235
  misc_feature 1..191: note = Hypo
  source 1..191: mol_type = genomic DNA

SEQ ID NO: 105340 - DNA, 97 bp, Homo sapiens; identical to SEQ ID NO: 70732
  misc_feature 1..97: note = chr10:133058323-133058420
  misc_feature 1..97: note = Hypo
  source 1..97: mol_type = genomic DNA

SEQ ID NO: 105341 - DNA, 23 bp, Homo sapiens
  misc_feature 1..23: note = chr10:133089975-133089998
  misc_feature 1..23: note = Hypo
  source 1..23: mol_type = genomic DNA
accgcgcccggcctccataaaca

SEQ ID NO: 105342 - DNA, 1857 bp, Homo sapiens
  misc_feature 1..1857: note = chr10:133109124-133110981
  misc_feature 1..1857: note = Hyper
  source 1..1857: mol_type = genomic DNA
agctgaaacagctatcgatttccagcttgctttcaagtctggcagagactgtgaaagtcctaacttctccgcgatgtcagccacggcccgcggcggtcacggagccacttcagcacctcgcgatggacagtgacccccggcgtggcgcgagttccctgcggtccccacgcgggcctgggcggcgggtccctccacggctccgtccagacacccggaggcacctgccaaagctgcggaggtggacgaccgggcgtccaagcacgaactttctcgccgaggcacggctgccgggctccgtcctgagggtttggggcggcgaggaccgccggggaggagggcgcgcgagccggaggccagagccgggccgggcagggcgcgcccaggagcaggggagacggcgacccgggccgaggcgggacggggacacgttacctgcccgtggagcgcggggaaggggtgcgcggcggcggcggcggcggagtctggcgcagagggcagcggcagcagcgggagcaccggctcgctcggggccggccagccggggagaccggggagcagcggggccgcgggcggcggggccgaggcgagcagcaccgggggaaccacgacccccgcgctgagccggagcagcccggccgagcccggcaccatccagacccagggcggcggcggcggcggctctgcgtccatcggccagaggagaggctgccgccgccggggctgctgctgctgcagctgccgccgccgccgctggaacctggcgcccgcctgcatcctacatccccgcgctgacggcggcggcgggggcggcgggcgcccgagatgctgggccggcggcggcgcggctccggagcgaactcacttggctccgcggcgcggccgctcgctccgcccctgccccgcgcgggaagctcctcctcctcccgcccgcgccgccgccgcccccggacccggcccccgccccggtccccgcccgcccgcgcccctccccgccggaccccgccccgccctcgcgctccccggccctggccggggtctcctccccgctgcgcccctggacccgggcggccgcggaggacgtgggtgggagagggccgagggcgcgcccggctgggctcccgccgatgccggccccctggtggcctctggccctctgggacccagcgcaccgcgagggaggctccgggctccgcactcaagggcaagcggaagccgaggtggcggcgccggagccaggcatgtcccgctgcccagcgcggggctgagggcgcagacggggaccgcgcgagccgctctctacctggcctcctcggagtccagggcgcggagggtactgggctgcggatccggcgcaggcggccccggacgctgctaggcgcgggcggatttctgttgcacaaatgggccaaacaggttcgtaaggcccccgcgggtcccctggcccggaagttgagccgcgggtgcctggtctgaagttccgcgccccacagtggcccgcgggcctcggcggctcctgccctacgccctccaaggcaccaggcaggtggccccagggcctttgcccacgacaccccctgggtggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgccggccgagccgagcctgggtccgcactggccacgcgcagccaccgccagacggcgctagccctcccccgctgtagaccctgcttcggaggccgccagcctcctccc

SEQ ID NO: 105343 - DNA, 183 bp, Homo sapiens; identical to SEQ ID NO: 70738
  misc_feature 1..183: note = chr10:133117656-133117839
  misc_feature 1..183: note = Hypo
  source 1..183: mol_type = genomic DNA

SEQ ID NO: 105344 - DNA, 43 bp, Homo sapiens; identical to SEQ ID NO: 70739
  misc_feature 1..43: note = chr10:133226414-133226457
  misc_feature 1..43: note = Hypo
  source 1..43: mol_type = genomic DNA

SEQ ID NO: 105345 - DNA, 30 bp, Homo sapiens; identical to SEQ ID NO: 70741
  misc_feature 1..30: note = chr10:133495425-133495455
  misc_feature 1..30: note = Hypo
  source 1..30: mol_type = genomic DNA

SEQ ID NO: 105346 - DNA, 192 bp, Homo sapiens; identical to SEQ ID NO: 70742
  misc_feature 1..192: note = chr10:133516016-133516208
  misc_feature 1..192: note = Hypo
  source 1..192: mol_type = genomic DNA

SEQ ID NO: 105347 - DNA, 279 bp, Homo sapiens; identical to SEQ ID NO: 70743
  misc_feature 1..279: note = chr10:133530719-133530998
  misc_feature 1..279: note = Hypo
  source 1..279: mol_type = genomic DNA

SEQ ID NO: 105348 - DNA, 194 bp, Homo sapiens; identical to SEQ ID NO: 70744
  misc_feature 1..194: note = chr10:133532602-133532796
  misc_feature 1..194: note = Hypo
  source 1..194: mol_type = genomic DNA

SEQ ID NO: 105349 - DNA, 51 bp, Homo sapiens; identical to SEQ ID NO: 70746
  misc_feature 1..51: note = chr10:133555035-133555086
  misc_feature 1..51: note = Hypo
  source 1..51: mol_type = genomic DNA

SEQ ID NO: 105350 - DNA, 30 bp, Homo sapiens; identical to SEQ ID NO: 70747
  misc_feature 1..30: note = chr10:133589829-133589859
  misc_feature 1..30: note = Hypo
  source 1..30: mol_type = genomic DNA

SEQ ID NO: 105351 - DNA, 30 bp, Homo sapiens; identical to SEQ ID NO: 70748
  misc_feature 1..30: note = chr10:133590138-133590168
  misc_feature 1..30: note = Hypo
  source 1..30: mol_type = genomic DNA

SEQ ID NO: 105352 - DNA, 30 bp, Homo sapiens; identical to SEQ ID NO: 70749
  misc_feature 1..30: note = chr10:133603524-133603554
  misc_feature 1..30: note = Hypo
  source 1..30: mol_type = genomic DNA

SEQ ID NO: 105353 - DNA, 30 bp, Homo sapiens; identical to SEQ ID NO: 70750
  misc_feature 1..30: note = chr10:133645234-133645264
  misc_feature 1..30: note = Hypo
  source 1..30: mol_type = genomic DNA

SEQ ID NO: 105354 - DNA, 157 bp, Homo sapiens; identical to SEQ ID NO: 70751
  misc_feature 1..157: note = chr10:133783240-133783397
  misc_feature 1..157: note = Hypo
  source 1..157: mol_type = genomic DNA

SEQ ID NO: 105355 - DNA, 1531 bp, Homo sapiens
  misc_feature 1..1531: note = chr10:133794727-133796258
  misc_feature 1..1531: note = Hyper
  source 1..1531: mol_type = genomic DNA
gccatattttaaaaacgctgtaaccccctcccatctccgcgttcacccttgaggaaatcctaacagtcaccatggatataaacattaataacaaaattaaagctcataacaggccacttgccacgccttggtgtttggtcattaaaaccaatactggtctgaactacagaccgcggagggcaacgtggactttgaggctgttcggtccaactgcgagacgcagattcacctccaggtggaattctagctcgcgcggagctggagaatcggggctttcccgtgcggtccgacccgggtccaagccaacccccgcccgagtggcgaggccgcgaaccccgggcagtacgcggggtccccacgccccgggctccgcatgcccgcaggaggggtgggtacggaaggggaggatggcgcagcctcgcccggcccgcgatgccccctaggcctccccggcaacctccccttggcgccctcttggccttccccaggcttcccccccgcgccccctcggctcccgcgccgcctcctccgcctcaccctgcaggctctcctcctgcatcccgggcgctccgttctgcgacatggcgccagagggcaactgcggcgatcggagtccgcgccgggctgcgggatgtgcttcagctgcgggcggtgggaaagcggaggtcggagcgccgcggcccagctgcgctcccggactgagcggagccccgcagcccggccggaggaactcacagggcagggcggggccgggcggatctgcggccgcgtcgcccattggccgcgacttggggcctgcgcgtgcgcaggggcgtggggtgcgtgtggcacgtgcggcgcgtgcgcggggcgggtcctgcggtgggcgaggggcagaggcctgcggtgcgcgggacgcgggcggggagaggggcggggcgaggggcgcgcaggcgcgagggcggcagcgaccgcctgaggtgagccggcccgggctggacgccgcgggccgcgtgacgagtgggctgcgcggtcgccgccgcggcgggcggtgggccgggttctcctttgaaggggcggtgggaccggcggactctctgggcactggctaccacggagacgccgctacgcttcggggcggggcccgtctttccatcctgctagtggggaaactgaggcgcggggctggcggcgtccgtgcggggggcgtgaggacgtgcagggaagcggccgctgcggctccgagacggcccgtggggtcgggacctgcgcccggggcgggagctgcgagcggtgggccggagctgagcgtctcgggacgggaccgcgtccccgggtctttgcccgccccgccggggcgcccctgcgtgaacagcggggcccgttgtgtccggggcgtccgcccgcaggaagaagcggaggctcgagcagagtcgaaagagtctgcccgagggaggcgcggaccccaggggcccgggagaggcgcgccgtccgcctctgcggcaaggggcctccggggtgcaaacgcggtgtggggcgggcgtccccgggg

SEQ ID NO: 105356 - DNA, 408 bp, Homo sapiens; identical to SEQ ID NO: 70755
  misc_feature 1..408: note = chr10:133806718-133807126
  misc_feature 1..408: note = Hypo
  source 1..408: mol_type = genomic DNA

SEQ ID NO: 105357 - DNA, 34 bp, Homo sapiens; identical to SEQ ID NO: 70756
  misc_feature 1..34: note = chr10:133836708-133836742
  misc_feature 1..34: note = Hyper
  source 1..34: mol_type = genomic DNA

SEQ ID NO: 105358 - DNA, 1178 bp, Homo sapiens
  misc_feature 1..1178: note = chr10:133849661-133850839
  misc_feature 1..1178: note = Hyper
  source 1..1178: mol_type = genomic DNA
cctgaagtcccagcccggagcacgcggccgtggtgagctgcgatcccaggccccggcgcagcgctgagactgtggctctcaatccgcagcagctgcttcatctgctcaatgccagactccaaaaagcatttctctcgcaacaggccaggggaggcagcgttcggggatgggacgccaagagttaagggtgaggccgcacgcgtgcagctcccccgtgctgcgcatggcgctgggatcggcctgagcggcgggtgagtccctctaagccggcggcgcccggtgcccggctccctacgcgcgccccgcggcccccgggctattttcagccacgccgagccctgttttaggagcttgcacagcggctccgcggagaccgggactgcgtgggggaggatcgcggcgggggccgtcgccgagcaaggagcgcggccgcggggaccgcccgggagtgggggcggcggggcgggccgggttcggggctcctgcccgcggtgacggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctgcgtctggcacggtgcgtccgggacgcgggcgccctggcggccgtggggcgggcggggggcgacgtcccgagggagggggtcccgcggcagagacgcccctgtctggggcggggtcctccttgcctctcccggcggtccccccgtgggcgggtcctctccacggcaccccctgccctgcacaggcctcggcgctggcgtgacgcggccgctgggtggggcccgcgcaggtgctgggccagggctggggacccgcatctccgtgtctccgactgtgcctcccgcggaaaggggcgccgtgcgattatttttatgttggtgtctggtttttaaatttcacagcccccatttcagggatggccagcgtggccgtgggatgctgacgatacgggaagccagagaataaaggctttggtggaggtcgggaggaggcgccggcctggacagttttcctagaaaatattctctgcgtgtacccgcgaccttgcctctcgtggaaagccgctgggagttggagcggctccctcctgcccccgtctgaggtctggc

SEQ ID NO: 105359 - DNA, 32 bp, Homo sapiens; identical to SEQ ID NO: 70759
  misc_feature 1..32: note = chr10:133858093-133858125
  misc_feature 1..32: note = Hypo
  source 1..32: mol_type = genomic DNA

SEQ ID NO: 105360 - DNA, 61 bp, Homo sapiens; identical to SEQ ID NO: 70760
  misc_feature 1..61: note = chr10:133910786-133910847
  misc_feature 1..61: note = Hypo
  source 1..61: mol_type = genomic DNA

SEQ ID NO: 105361 - DNA, 139 bp, Homo sapiens; identical to SEQ ID NO: 70761
  misc_feature 1..139: note = chr10:133913329-133913468
  misc_feature 1..139: note = Hypo
  source 1..139: mol_type = genomic DNA

SEQ ID NO: 105362 - DNA, 277 bp, Homo sapiens; identical to SEQ ID NO: 70762
  misc_feature 1..277: note = chr10:133913780-133914057
  misc_feature 1..277: note = Hypo
  source 1..277: mol_type = genomic DNA

SEQ ID NO: 105363 - DNA, 30 bp, Homo sapiens; identical to SEQ ID NO: 42732
  misc_feature 1..30: note = chr10:133921177-133921207
  misc_feature 1..30: note = Hypo
  source 1..30: mol_type = genomic DNA

SEQ ID NO: 105364 - DNA, 32 bp, Homo sapiens; identical to SEQ ID NO: 70764
  misc_feature 1..32: note = chr10:133935358-133935390
  misc_feature 1..32: note = Hypo
  source 1..32: mol_type = genomic DNA

SEQ ID NO: 105365 - DNA, 49 bp, Homo sapiens; identical to SEQ ID NO: 70765
  misc_feature 1..49: note = chr10:133935785-133935834
  misc_feature 1..49: note = Hypo
  source 1..49: mol_type = genomic DNA

SEQ ID NO: 105366 - DNA, 128 bp, Homo sapiens; identical to SEQ ID NO: 70766
  misc_feature 1..128: note = chr10:133947267-133947395
  misc_feature 1..128: note = Hypo
  source 1..128: mol_type = genomic DNA

SEQ ID NO: 105367 - DNA, 307 bp, Homo sapiens; identical to SEQ ID NO: 70767
  misc_feature 1..307: note = chr10:133949128-133949435
  misc_feature 1..307: note = Hypo
  source 1..307: mol_type = genomic DNA

SEQ ID NO: 105368 - DNA, 68 bp, Homo sapiens; identical to SEQ ID NO: 70768
  misc_feature 1..68: note = chr10:133949784-133949852
  misc_feature 1..68: note = Hypo
  source 1..68: mol_type = genomic DNA

SEQ ID NO: 105369 - DNA, 556 bp, Homo sapiens; identical to SEQ ID NO: 42735
  misc_feature 1..556: note = chr10:133951469-133952025
  misc_feature 1..556: note = Hypo
  source 1..556: mol_type = genomic DNA

SEQ ID NO: 105370 - DNA, 144 bp, Homo sapiens; identical to SEQ ID NO: 70770
  misc_feature 1..144: note = chr10:133952229-133952373
  misc_feature 1..144: note = Hypo
  source 1..144: mol_type = genomic DNA

SEQ ID NO: 105371 - DNA, 85 bp, Homo sapiens; identical to SEQ ID NO: 70771
  misc_feature 1..85: note = chr10:133955427-133955512
  misc_feature 1..85: note = Hypo
  source 1..85: mol_type = genomic DNA

SEQ ID NO: 105372 - DNA, 228 bp, Homo sapiens; identical to SEQ ID NO: 70772
  misc_feature 1..228: note = chr10:133962619-133962847
  misc_feature 1..228: note = Hypo
  source 1..228: mol_type = genomic DNA

SEQ ID NO: 105373 - DNA, 65 bp, Homo sapiens; identical to SEQ ID NO: 70773
  misc_feature 1..65: note = chr10:133979162-133979227
  misc_feature 1..65: note = Hypo
  source 1..65: mol_type = genomic DNA

SEQ ID NO: 105374 - DNA, 152 bp, Homo sapiens; identical to SEQ ID NO: 70774
  misc_feature 1..152: note = chr10:133982809-133982961
  misc_feature 1..152: note = Hypo
  source 1..152: mol_type = genomic DNA

SEQ ID NO: 105375 - DNA, 201 bp, Homo sapiens; identical to SEQ ID NO: 70775
  misc_feature 1..201: note = chr10:133984033-133984234
  misc_feature 1..201: note = Hypo
  source 1..201: mol_type = genomic DNA

SEQ ID NO: 105376 - DNA, 1656 bp, Homo sapiens
  misc_feature 1..1656: note = chr10:133999769-134001425
  misc_feature 1..1656: note = Hyper
  source 1..1656: mol_type = genomic DNA
acccccgcgaggtcccgcccaccaccgcgtcccggtccctggggagcgcgtgcgcctccttctgtctctctctctctctctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagagcgtcgcggcccggggttgactggctcggaatcccggggccttgggcgcctcgcgtctcctgggacctgggttccgcgctggagggcagcgggggcgcgggcggggcctggcaggacgtggccggactctctccctcgcctccccggggtgcaaaccccgcgcacatcagctggagcaggttgaaatccccacccagcgctcgtccgcgggtctgcgcgggggcccggggtgcagagatcagaccctgcagcggttccagcgctgggggggctttaaagcgaaggagtggctgagggcgggggcggggctgatgggcggggtgaggcggggctcgggctggggcgggccctatcgggggcggggcctgccgggggcggagccggggtgggggcggggcccagcgggggcgggaccggaacggagccgtgcggccccgcgcgctcgcagtctgtctcccgccgtccccacgcacgcgtcccggctcacgcgtccccccgcccgcccgcccgcccgcccgcccccgcttgtgccgcccctaccagagacccccaggagcaggatgtccttccagggcaagaaaagcatcccccggatcacggtgagcccggtcccgcttcgcccggcgccccctgcccgccgcccggagtggggcctggacgccgggcggaccctcctggtcttgtgcgtgggtggggggtccctgcctttgcgtctggtccctgtcctggcgcccgcccttccctgctcggctccttcgcgccccagggtccgagagtccccgctagcgccgcgcagacccccttaaggagcggggcgcccaggcccggcccggcccggccctgcccggccctgccgggccctgccgggccctgcccggccttgcccggccttgccggcttccgggagcctcggctgcgcccggggagaacccggggccgggcggcctgtccctcggagcgctagcggctcctttctcccacggcggtcgggtggcgaggcgggcggacgcggccctttgttggcccgggctggtccggggcgcggggagatgccgttcccggcgcagcccgtgggtcgcccgccccttggacgcactggcgctgcgtcgggagctctttgtccgagacaaagcgatttagccccggccgctctggccggagtccctggtggccccgaacccttccagtaacctgggttcagcgactccaaggaaagcgagcggtcaagggccactggccgggaaccctggcagcccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatgg

SEQ ID NO: 105377 - DNA, 168 bp, Homo sapiens; identical to SEQ ID NO: 70782
  misc_feature 1..168: note = chr10:134010456-134010624
  misc_feature 1..168: note = Hypo
  source 1..168: mol_type = genomic DNA

SEQ ID NO: 105378 - DNA, 354 bp, Homo sapiens; identical to SEQ ID NO: 70783
  misc_feature 1..354: note = chr10:134012163-134012517
  misc_feature 1..354: note = Hypo
  source 1..354: mol_type = genomic DNA

SEQ ID NO: 105379 - DNA, 342 bp, Homo sapiens; identical to SEQ ID NO: 70784
  misc_feature 1..342: note = chr10:134014286-134014628
  misc_feature 1..342: note = Hypo
  source 1..342: mol_type = genomic DNA

SEQ ID NO: 105380 - DNA, 341 bp, Homo sapiens; identical to SEQ ID NO: 70785
  misc_feature 1..341: note = chr10:134016098-134016439
  misc_feature 1..341: note = Hypo
  source 1..341: mol_type = genomic DNA

SEQ ID NO: 105381 - DNA, 152 bp, Homo sapiens; identical to SEQ ID NO: 70786
  misc_feature 1..152: note = chr10:134016763-134016915
  misc_feature 1..152: note = Hypo
  source 1..152: mol_type = genomic DNA

SEQ ID NO: 105382 - DNA, 48 bp, Homo sapiens; identical to SEQ ID NO: 70787
  misc_feature 1..48: note = chr10:134018023-134018071
  misc_feature 1..48: note = Hypo
  source 1..48: mol_type = genomic DNA

SEQ ID NO: 105383 - DNA, 30 bp, Homo sapiens; identical to SEQ ID NO: 42745
  misc_feature 1..30: note = chr10:134019334-134019364
  misc_feature 1..30: note = Hypo
  source 1..30: mol_type = genomic DNA

SEQ ID NO: 105384 - DNA, 328 bp, Homo sapiens; identical to SEQ ID NO: 70789
  misc_feature 1..328: note = chr10:134022624-134022952
  misc_feature 1..328: note = Hypo
  source 1..328: mol_type = genomic DNA

SEQ ID NO: 105385 - DNA, 257 bp, Homo sapiens; identical to SEQ ID NO: 70790
  misc_feature 1..257: note = chr10:134040240-134040497
  misc_feature 1..257: note = Hypo
  source 1..257: mol_type = genomic DNA

SEQ ID NO: 105386 - DNA, 41 bp, Homo sapiens; identical to SEQ ID NO: 70793
  misc_feature 1..41: note = chr10:134058780-134058821
  misc_feature 1..41: note = Hypo
  source 1..41: mol_type = genomic DNA

SEQ ID NO: 105387 - DNA, 63 bp, Homo sapiens; identical to SEQ ID NO: 70794
  misc_feature 1..63: note = chr10:134063725-134063788
  misc_feature 1..63: note = Hypo
  source 1..63: mol_type = genomic DNA

SEQ ID NO: 105388 - DNA, 30 bp, Homo sapiens; identical to SEQ ID NO: 70795
  misc_feature 1..30: note = chr10:134064125-134064155
  misc_feature 1..30: note = Hypo
  source 1..30: mol_type = genomic DNA

SEQ ID NO: 105389 - DNA, 42 bp, Homo sapiens; identical to SEQ ID NO: 70796
  misc_feature 1..42: note = chr10:134066350-134066392
  misc_feature 1..42: note = Hypo
  source 1..42: mol_type = genomic DNA

SEQ ID NO: 105390 - DNA, 849 bp, Homo sapiens; identical to SEQ ID NO: 70797
  misc_feature 1..849: note = chr10:134093628-134094477
  misc_feature 1..849: note = Hypo
  source 1..849: mol_type = genomic DNA

SEQ ID NO: 105391 - DNA, 385 bp, Homo sapiens; identical to SEQ ID NO: 70798
  misc_feature 1..385: note = chr10:134095563-134095948
  misc_feature 1..385: note = Hypo
  source 1..385: mol_type = genomic DNA

SEQ ID NO: 105392 - DNA, 17 bp, Homo sapiens
  misc_feature 1..17: note = chr10:134099613-134099630
  misc_feature 1..17: note = Hypo
  source 1..17: mol_type = genomic DNA
agcgagactctgtctca

SEQ ID NO: 105393 - DNA, 30 bp, Homo sapiens; identical to SEQ ID NO: 42751
  misc_feature 1..30: note = chr10:134118399-134118429
  misc_feature 1..30: note = Hypo
  source 1..30: mol_type = genomic DNA

SEQ ID NO: 105394 - DNA, 132 bp, Homo sapiens; identical to SEQ ID NO: 70801
  misc_feature 1..132: note = chr10:134119982-134120114
  misc_feature 1..132: note = Hypo
  source 1..132: mol_type = genomic DNA

SEQ ID NO: 105395 - DNA, 308 bp, Homo sapiens; identical to SEQ ID NO: 70802
  misc_feature 1..308: note = chr10:134120706-134121014
  misc_feature 1..308: note = Hyper
  source 1..308: mol_type = genomic DNA

SEQ ID NO: 105396 - DNA, 658 bp, Homo sapiens; identical to SEQ ID NO: 70803
  misc_feature 1..658: note = chr10:134121693-134122351
  misc_feature 1..658: note = Hyper
  source 1..658: mol_type = genomic DNA

SEQ ID NO: 105397 - DNA, 230 bp, Homo sapiens; identical to SEQ ID NO: 42752
  misc_feature 1..230: note = chr10:134123040-134123270
  misc_feature 1..230: note = Hypo
  source 1..230: mol_type = genomic DNA

SEQ ID NO: 105398 - DNA, 30 bp, Homo sapiens; identical to SEQ ID NO: 70805
  misc_feature 1..30: note = chr10:134126884-134126914
  misc_feature 1..30: note = Hypo
  source 1..30: mol_type = genomic DNA

SEQ ID NO: 105399 - DNA, 37 bp, Homo sapiens; identical to SEQ ID NO: 70806
  misc_feature 1..37: note = chr10:134209613-134209650
  misc_feature 1..37: note = Hyper
  source 1..37: mol_type = genomic DNA

SEQ ID NO: 105400 - DNA, 30 bp, Homo sapiens; identical to SEQ ID NO: 70807
  misc_feature 1..30: note = chr10:134232907-134232937
  misc_feature 1..30: note = Hypo
  source 1..30: mol_type = genomic DNA

SEQ ID NO: 105401 - DNA, 237 bp, Homo sapiens; identical to SEQ ID NO: 70809
  misc_feature 1..237: note = chr10:134272641-134272878
  misc_feature 1..237: note = Hypo
  source 1..237: mol_type = genomic DNA

SEQ ID NO: 105402 - DNA, 30 bp, Homo sapiens; identical to SEQ ID NO: 70810
  misc_feature 1..30: note = chr10:134281135-134281165
  misc_feature 1..30: note = Hypo
  source 1..30: mol_type = genomic DNA

SEQ ID NO: 105403 - DNA, 145 bp, Homo sapiens; identical to SEQ ID NO: 70811
  misc_feature 1..145: note = chr10:134292484-134292629
  misc_feature 1..145: note = Hypo
  source 1..145: mol_type = genomic DNA

SEQ ID NO: 105404 - DNA, 299 bp, Homo sapiens; identical to SEQ ID NO: 42755
  misc_feature 1..299: note = chr10:134301017-134301316
  misc_feature 1..299: note = Hypo
  source 1..299: mol_type = genomic DNA

SEQ ID NO: 105405 - DNA, 30 bp, Homo sapiens; identical to SEQ ID NO: 70813
  misc_feature 1..30: note = chr10:134316646-134316676
  misc_feature 1..30: note = Hypo
  source 1..30: mol_type = genomic DNA

SEQ ID NO: 105406 - DNA, 37 bp, Homo sapiens; identical to SEQ ID NO: 70814
  misc_feature 1..37: note = chr10:134341480-134341517
  misc_feature 1..37: note = Hypo
  source 1..37: mol_type = genomic DNA

SEQ ID NO: 105407 - DNA, 371 bp, Homo sapiens; identical to SEQ ID NO: 42758
  misc_feature 1..371: note = chr10:134481125-134481496
  misc_feature 1..371: note = Hypo
  source 1..371: mol_type = genomic DNA

SEQ ID NO: 105408 - DNA, 36 bp, Homo sapiens; identical to SEQ ID NO: 70816
  misc_feature 1..36: note = chr10:134489067-134489103
  misc_feature 1..36: note = Hypo
  source 1..36: mol_type = genomic DNA

SEQ ID NO: 105409 - DNA, 205 bp, Homo sapiens; identical to SEQ ID NO: 70817
  misc_feature 1..205: note = chr10:134499328-134499533
  misc_feature 1..205: note = Hypo
  source 1..205: mol_type = genomic DNA

SEQ ID NO: 105410 - DNA, 30 bp, Homo sapiens; identical to SEQ ID NO: 70818
  misc_feature 1..30: note = chr10:134516665-134516695
  misc_feature 1..30: note = Hypo
  source 1..30: mol_type = genomic DNA

SEQ ID NO: 105411 - DNA, 167 bp, Homo sapiens; identical to SEQ ID NO: 42760
  misc_feature 1..167: note = chr10:134518611-134518778
  misc_feature 1..167: note = Hypo
  source 1..167: mol_type = genomic DNA

SEQ ID NO: 105412 - DNA, 60 bp, Homo sapiens; identical to SEQ ID NO: 42761
  misc_feature 1..60: note = chr10:134542152-134542212
  misc_feature 1..60: note = Hypo
  source 1..60: mol_type = genomic DNA

SEQ ID NO: 105413 - DNA, 127 bp, Homo sapiens; identical to SEQ ID NO: 70821
  misc_feature 1..127: note = chr10:134557418-134557545
  misc_feature 1..127: note = Hypo
  source 1..127: mol_type = genomic DNA

SEQ ID NO: 105414 - DNA, 64 bp, Homo sapiens; identical to SEQ ID NO: 70822
  misc_feature 1..64: note = chr10:134562719-134562783
  misc_feature 1..64: note = Hypo
  source 1..64: mol_type = genomic DNA

SEQ ID NO: 105415 - DNA, 30 bp, Homo sapiens; identical to SEQ ID NO: 70823
  misc_feature 1..30: note = chr10:134565567-134565597
  misc_feature 1..30: note = Hypo
  source 1..30: mol_type = genomic DNA

SEQ ID NO: 105416 - DNA, 196 bp, Homo sapiens; identical to SEQ ID NO: 70824
  misc_feature 1..196: note = chr10:134566161-134566357
  misc_feature 1..196: note = Hypo
  source 1..196: mol_type = genomic DNA

SEQ ID NO: 105417 - DNA, 142 bp, Homo sapiens; identical to SEQ ID NO: 70825
  misc_feature 1..142: note = chr10:134581976-134582118
  misc_feature 1..142: note = Hypo
  source 1..142: mol_type = genomic DNA

SEQ ID NO: 105418 - DNA, 30 bp, Homo sapiens; identical to SEQ ID NO: 70826
  misc_feature 1..30: note = chr10:134589397-134589427
  misc_feature 1..30: note = Hypo
  source 1..30: mol_type = genomic DNA

SEQ ID NO: 105419 - DNA, 137 bp, Homo sapiens
  misc_feature 1..137: note = chr10:134597657-134597794
  misc_feature 1..137: note = Hyper
  source 1..137: mol_type = genomic DNA
accccgcgtgacccacgggaggccccgccgctccgcgggcggaattatttcggatttctctttgcggtcctagttcggaagaaactgctttccaccgcgggaagatctggcgggatggtgaccgaagggcctccgtg

SEQ ID NO: 105420 - DNA, 613 bp, Homo sapiens
  misc_feature 1..613: note = chr10:134598087-134598700
  misc_feature 1..613: note = Hyper
  source 1..613: mol_type = genomic DNA
gtcccgggctcctggcggctgtcgctgcggttccttcccgcgggccgggccccttccctgcgccttcgccgcctcctcgcgcctgcccggggcccgcagcctccgcaccgggaacccggaggacccgaggcgggcgcaggggcgaagccggggccggggaggggccgcctcgctccgggttcgagacggaagaaacacgcggcgcaggctccggagcgacggctccgacggggacccgttaaataatttattgatgatacaaagcgactcgcgcccacccggggccgcccccggattctgcaaaaatagattcgcccccaccccgcgggtcctcacaaggcgtcccccgcgccgccgccgcacgggctgaccagcgccaagttcgagggtttgtgcttcttgagcagccgcgtgatcttctcgtcgtccgagttggggtccaggggccggttgtattcgtcgtcgtcctccgcgtccgagccgcccaccttcagcttctcggcgtccgagtcctgcttcttcttggccgacgccatctccaccgcgtgccgcttgcgccacttggtccggcggttctggaaccagacctgggagtggacggggcggtcaggcg

SEQ ID NO: 105421 - DNA, 1941 bp, Homo sapiens
  misc_feature 1..1941: note = chr10:134599032-134600973
  misc_feature 1..1941: note = Hyper
  source 1..1941: mol_type = genomic DNA
cgcgggccactcacccgggccagccagacgcgggtccctccagggcgcgccctgcaccacgccgggccagaagatgggcgggcgccccggcagctcggccaggggcttggggtagccgcgcgccacagcggccgcgggcccgaagtaaacgccggcggacgacgcgagcccgttgagccggggcagcccccccaggaggcccccgcccgccgcgcccacgggccggcccaggatgtcgctgatgccgtgcggggtcccgagcgggagctgcgcgcccaggccccccagcgcgggcgccttgaagccggccggaccctgcagcgcgtaggggaacagcgacgtcttcatctcggccatgttgtgcagcgcggccagcggggcactgctcagcacgaacgcgcccgggcggttagtgtccatgggcgccgccgccgccggcccgggctcccatccgggccccgccgccgccgcccctgcccgccggcccgggaagtttgcgcgcggcccgggcgggcgtcggctgcagcgcggggcgcggggcgcggggggcgggcgggcggctccggcgcggggcgggcgggcgggcggcggcggcggcggctccggggccggtcggagcggcgccgcgcgggacggacgcgctgataacgggggctccccggggcgcggcgcgcgcgctgattggctgcggaccccgcggtccggccattggccggcgccccccccccgcccgcgcgcccccgccggccgcgcactccatgaagggcccattagcgcggcaggtgcctcccgggctgtaaattcgccccgatttatctccccggggacgaaataaatccagcttggatgggagtgtagttaggcaaaggttttcatgcgaaatcaggaaaaaatacgagaacgtattttattaacggaaagaatgcagatttgaggacccgcccgcgcgctcggagcgccccactcggggaagagtcccggcccgcgtcccagtcgcgactgctccgccgcccgtggctggggtgggtgtgagcggcagcggacgccggcggggaacgcgctccgggcaggtcggggccacaggagggcggaggacgcgggcctcgagtccacggaatccacgggcctcacggccgggcgaggctcgcacggagctgcctctggtttcgccgacacgcggccggcgcggtggaggagtgaggcaggcgggagcggggcggggaggcgggtcccgggaccacacgcgcggctcggcacttccccgtcatcggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccgcagaccgggcggtgagatgactccgagccccgcgcacggcggccgcgagcaaacgctccgacgtctgtggtgacgtctcgtattgatttagggacacggggcggctgtggctgtggcccacggctcgtggggagcccgagtctgtgcgcagggaacgccgctgcgtggcctctctcgggcctgtgccgcggaggaaggcggcgcccggggttcggggccggggtctcacgtccgccccctcgcccccctccagcgtccgttttcgttttgtgcaggtcgaggcggggacttggcgccgtcggccgctcctggatggcggcttggaaaagccacctgcggccaaactccggggcagtggtgcggccgccgggtgtgtgcgcgctcggggctgccccggcggcttccggctccactgaggt

SEQ ID NO: 105422 - DNA, 1210 bp, Homo sapiens
  misc_feature 1..1210: note = chr10:134601204-134602414
  misc_feature 1..1210: note = Hyper
  source 1..1210: mol_type = genomic DNA
cccagcaccccaaggcgacggcgcccgcgcccaaggctcgggctctgagctgagacgcgggaactgcggggccggggggggcgggcagggggagttgggggcgggggctgctgtcgccctgggatcccccactctgcgcggccgggcagaccctgggcgggccgggaggggtgcgggtcgcccgaactgaggcccaggaggcgcgcgcgggcggaacggcgggaggaagccgcgctcgggacaggctctggctcttctcacagcctggaggggcggggcagggggcgtcgctagcgctgttttatggctgaggaaacatggacctggaggcgctgcgctgcggcccgataaaccctgggtctgtctgcgccccccggtcctccctgggctgccgagggaacgcgtggggtcgcgggtggggctggcgtgtcactggctgcggagcgcgcggctctccagggctcaggggcgcgggatgaggggccagggtgagttgggggcgcagaggagccgggtaagggggggtccctctcccacgttcttgtaagccgtggaagtcttggcgcgctccgcaggtgccgcgtcctacccggctccccggcctgcgccccacgcgctttcccgccctcctcctcgcggagctgcgcgtgggtccggtggcttcacctcctacgcttcccggcgcccactccgggccccgtcccctctccggcccccgcccgcaccttttctcctgcgtcccccggtgccgccctctcggaaaccaccgaggcaactccccctcctcccgggaaggtccgagcgcctccgaccgcgatgtctttgcctgggctccgccgcccggcggccccgctgcctggagaggtccgcgatgccacctcctggcccgcgagcagatgtcccgcgaggaaggctgccggcatcggcgccgacgctccgcgctggaaaaccgagagcgcggggtttggcagaggccattcaagtttgttttactcgttcagcctgtatttgtggggctcctaccgcgcccgggctgtccggggggtgcaccgtgaacgcagcgggctccggcccgggcgcgggcgggtcagagcagcaaacgcgctcccccggcacccccgcggcgtctgcaggggagcgggcgacggggaggacggcgggggtgtcggcccggaaggagagccggcctaggccccggtgtccccgcgct

SEQ ID NO: 105423 - DNA, 364 bp, Homo sapiens; identical to SEQ ID NO: 70834
  misc_feature 1..364: note = chr10:134607832-134608196
  misc_feature 1..364: note = Hypo
  source 1..364: mol_type = genomic DNA

SEQ ID NO: 105424 - DNA, 387 bp, Homo sapiens; identical to SEQ ID NO: 70835
  misc_feature 1..387: note = chr10:134610574-134610961
  misc_feature 1..387: note = Hypo
  source 1..387: mol_type = genomic DNA

SEQ ID NO: 105425 - DNA, 30 bp, Homo sapiens; identical to SEQ ID NO: 70836
  misc_feature 1..30: note = chr10:134611744-134611774
  misc_feature 1..30: note = Hypo
  source 1..30: mol_type = genomic DNA

SEQ ID NO: 105426 - DNA, 32 bp, Homo sapiens; identical to SEQ ID NO: 70837
  misc_feature 1..32: note = chr10:134613038-134613070
  misc_feature 1..32: note = Hypo
  source 1..32: mol_type = genomic DNA

SEQ ID NO: 105427 - DNA, 60 bp, Homo sapiens; identical to SEQ ID NO: 70838
  misc_feature 1..60: note = chr10:134621273-134621333
  misc_feature 1..60: note = Hypo
  source 1..60: mol_type = genomic DNA

SEQ ID NO: 105428 - DNA, 102 bp, Homo sapiens; identical to SEQ ID NO: 70839
  misc_feature 1..102: note = chr10:134623057-134623159
  misc_feature 1..102: note = Hypo
  source 1..102: mol_type = genomic DNA

SEQ ID NO: 105429 - DNA, 81 bp, Homo sapiens; identical to SEQ ID NO: 70840
  misc_feature 1..81: note = chr10:134624068-134624149
  misc_feature 1..81: note = Hypo
  source 1..81: mol_type = genomic DNA

SEQ ID NO: 105430 - DNA, 42 bp, Homo sapiens; identical to SEQ ID NO: 70841
  misc_feature 1..42: note = chr10:134626641-134626683
  misc_feature 1..42: note = Hypo
  source 1..42: mol_type = genomic DNA

SEQ ID NO: 105431 - DNA, 142 bp, Homo sapiens; identical to SEQ ID NO: 70842
  misc_feature 1..142: note = chr10:134629717-134629859
  misc_feature 1..142: note = Hypo
  source 1..142: mol_type = genomic DNA

SEQ ID NO: 105432 - DNA, 37 bp, Homo sapiens; identical to SEQ ID NO: 70843
  misc_feature 1..37: note = chr10:134640686-134640723
  misc_feature 1..37: note = Hypo
  source 1..37: mol_type = genomic DNA

SEQ ID NO: 105433 - DNA, 123 bp, Homo sapiens; identical to SEQ ID NO: 70844
  misc_feature 1..123: note = chr10:134647633-134647756
  misc_feature 1..123: note = Hypo
  source 1..123: mol_type = genomic DNA

SEQ ID NO: 105434 - DNA, 57 bp, Homo sapiens; identical to SEQ ID NO: 42767
  misc_feature 1..57: note = chr10:134648015-134648072
  misc_feature 1..57: note = Hypo
  source 1..57: mol_type = genomic DNA

SEQ ID NO: 105435 - DNA, 30 bp, Homo sapiens; identical to SEQ ID NO: 70846
  misc_feature 1..30: note = chr10:134651763-134651793
  misc_feature 1..30: note = Hypo
  source 1..30: mol_type = genomic DNA

SEQ ID NO: 105436 - DNA, 74 bp, Homo sapiens; identical to SEQ ID NO: 70847
  misc_feature 1..74: note = chr10:134659532-134659606
  misc_feature 1..74: note = Hypo
  source 1..74: mol_type = genomic DNA

SEQ ID NO: 105437 - DNA, 87 bp, Homo sapiens; identical to SEQ ID NO: 42768
  misc_feature 1..87: note = chr10:134662545-134662632
  misc_feature 1..87: note = Hypo
  source 1..87: mol_type = genomic DNA

SEQ ID NO: 105438 - DNA, 55 bp, Homo sapiens; identical to SEQ ID NO: 70849
  misc_feature 1..55: note = chr10:134663367-134663422
  misc_feature 1..55: note = Hypo
  source 1..55: mol_type = genomic DNA

SEQ ID NO: 105439 - DNA, 193 bp, Homo sapiens; identical to SEQ ID NO: 70850
  misc_feature 1..193: note = chr10:134664613-134664806
  misc_feature 1..193: note = Hypo
  source 1..193: mol_type = genomic DNA

SEQ ID NO: 105440 - DNA, 406 bp, Homo sapiens; identical to SEQ ID NO: 70851
  misc_feature 1..406: note = chr10:134665007-134665413
  misc_feature 1..406: note = Hypo
  source 1..406: mol_type = genomic DNA

SEQ ID NO: 105441 - DNA, 153 bp, Homo sapiens; identical to SEQ ID NO: 70852
  misc_feature 1..153: note = chr10:134671588-134671741
  misc_feature 1..153: note = Hypo
  source 1..153: mol_type = genomic DNA

SEQ ID NO: 105442 - DNA, 128 bp, Homo sapiens; identical to SEQ ID NO: 70853
  misc_feature 1..128: note = chr10:134672396-134672524
  misc_feature 1..128: note = Hypo
  source 1..128: mol_type = genomic DNA

SEQ ID NO: 105443 - DNA, 315 bp, Homo sapiens; identical to SEQ ID NO: 70854
  misc_feature 1..315: note = chr10:134676338-134676653
  misc_feature 1..315: note = Hyper
  source 1..315: mol_type = genomic DNA

SEQ ID NO: 105444 - DNA, 52 bp, Homo sapiens; identical to SEQ ID NO: 70855
  misc_feature 1..52: note = chr10:134679419-134679471
  misc_feature 1..52: note = Hypo
  source 1..52: mol_type = genomic DNA

SEQ ID NO: 105445 - DNA, 30 bp, Homo sapiens; identical to SEQ ID NO: 70856
  misc_feature 1..30: note = chr10:134679999-134680029
  misc_feature 1..30: note = Hypo
  source 1..30: mol_type = genomic DNA

SEQ ID NO: 105446 - DNA, 230 bp, Homo sapiens; identical to SEQ ID NO: 70857
  misc_feature 1..230: note = chr10:134682617-134682847
  misc_feature 1..230: note = Hypo
  source 1..230: mol_type = genomic DNA

SEQ ID NO: 105447 - DNA, 56 bp, Homo sapiens; identical to SEQ ID NO: 70858
  misc_feature 1..56: note = chr10:134683657-134683713
  misc_feature 1..56: note = Hypo
  source 1..56: mol_type = genomic DNA

SEQ ID NO: 105448 - DNA, 41 bp, Homo sapiens; identical to SEQ ID NO: 70859
  misc_feature 1..41: note = chr10:134684038-134684079
  misc_feature 1..41: note = Hypo
  source 1..41: mol_type = genomic DNA

SEQ ID NO: 105449 - DNA, 65 bp, Homo sapiens; identical to SEQ ID NO: 70860
  misc_feature 1..65: note = chr10:134690483-134690548
  misc_feature 1..65: note = Hypo
  source 1..65: mol_type = genomic DNA

SEQ ID NO: 105450 - DNA, 164 bp, Homo sapiens; identical to SEQ ID NO: 70861
  misc_feature 1..164: note = chr10:134692244-134692408
  misc_feature 1..164: note = Hypo
  source 1..164: mol_type = genomic DNA

SEQ ID NO: 105451 - DNA, 183 bp, Homo sapiens; identical to SEQ ID NO: 70862
  misc_feature 1..183: note = chr10:134693583-134693766
  misc_feature 1..183: note = Hypo
  source 1..183: mol_type = genomic DNA

SEQ ID NO: 105452 - DNA, 60 bp, Homo sapiens; identical to SEQ ID NO: 70863
  misc_feature 1..60: note = chr10:134699346-134699406
  misc_feature 1..60: note = Hypo
  source 1..60: mol_type = genomic DNA

SEQ ID NO: 105453 - DNA, 425 bp, Homo sapiens; identical to SEQ ID NO: 70864
  misc_feature 1..425: note = chr10:134699648-134700073
  misc_feature 1..425: note = Hypo
  source 1..425: mol_type = genomic DNA

SEQ ID NO: 105454 - DNA, 99 bp, Homo sapiens; identical to SEQ ID NO: 70865
  misc_feature 1..99: note = chr10:134720606-134720705
  misc_feature 1..99: note = Hypo
  source 1..99: mol_type = genomic DNA

SEQ ID NO: 105455 - DNA, 70 bp, Homo sapiens; identical to SEQ ID NO: 70866
  misc_feature 1..70: note = chr10:134726229-134726299
  misc_feature 1..70: note = Hypo
  source 1..70: mol_type = genomic DNA

SEQ ID NO: 105456 - DNA, 63 bp, Homo sapiens; identical to SEQ ID NO: 70867
  misc_feature 1..63: note = chr10:134729962-134730025
  misc_feature 1..63: note = Hypo
  source 1..63: mol_type = genomic DNA

SEQ ID NO: 105457 - DNA, 170 bp, Homo sapiens; identical to SEQ ID NO: 70868
  misc_feature 1..170: note = chr10:134730580-134730750
  misc_feature 1..170: note = Hypo
  source 1..170: mol_type = genomic DNA

SEQ ID NO: 105458 - DNA, 30 bp, Homo sapiens; identical to SEQ ID NO: 70869
  misc_feature 1..30: note = chr10:134730962-134730992
  misc_feature 1..30: note = Hypo
  source 1..30: mol_type = genomic DNA

SEQ ID NO: 105459 - DNA, 177 bp, Homo sapiens; identical to SEQ ID NO: 42783
  misc_feature 1..177: note = chr10:134731838-134732015
  misc_feature 1..177: note = Hypo
  source 1..177: mol_type = genomic DNA

SEQ ID NO: 105460 - DNA, 1043 bp, Homo sapiens; identical to SEQ ID NO: 70871
  misc_feature 1..1043: note = chr10:134732792-134733835
  misc_feature 1..1043: note = Hypo
  source 1..1043: mol_type = genomic DNA

SEQ ID NO: 105461 - DNA, 205 bp, Homo sapiens; identical to SEQ ID NO: 70872
  misc_feature 1..205: note = chr10:134734065-134734270
  misc_feature 1..205: note = Hypo
  source 1..205: mol_type = genomic DNA

SEQ ID NO: 105462 - DNA, 339 bp, Homo sapiens; identical to SEQ ID NO: 70873
  misc_feature 1..339: note = chr10:134734696-134735035
  misc_feature 1..339: note = Hypo
  source 1..339: mol_type = genomic DNA

SEQ ID NO: 105463 - DNA, 30 bp, Homo sapiens; identical to SEQ ID NO: 70874
  misc_feature 1..30: note = chr10:134735976-134736006
  misc_feature 1..30: note = Hypo
  source 1..30: mol_type = genomic DNA

SEQ ID NO: 105464 - DNA, 543 bp, Homo sapiens; identical to SEQ ID NO: 42786
  misc_feature 1..543: note = chr10:134738145-134738688
  misc_feature 1..543: note = Hypo
  source 1..543: mol_type = genomic DNA

SEQ ID NO: 105465 - DNA, 286 bp, Homo sapiens; identical to SEQ ID NO: 70876
  misc_feature 1..286: note = chr10:134739166-134739452
  misc_feature 1..286: note = Hypo
  source 1..286: mol_type = genomic DNA

SEQ ID NO: 105466 - DNA, 37 bp, Homo sapiens; identical to SEQ ID NO: 70877
  misc_feature 1..37: note = chr10:134739723-134739760
  misc_feature 1..37: note = Hypo
  source 1..37: mol_type = genomic DNA

SEQ ID NO: 105467 - DNA, 53 bp, Homo sapiens; identical to SEQ ID NO: 70878
  misc_feature 1..53: note = chr10:134740858-134740911
  misc_feature 1..53: note = Hypo
  source 1..53: mol_type = genomic DNA

SEQ ID NO: 105468 - DNA, 34 bp, Homo sapiens; identical to SEQ ID NO: 70879
  misc_feature 1..34: note = chr10:134754790-134754824
  misc_feature 1..34: note = Hypo
  source 1..34: mol_type = genomic DNA

SEQ ID NO: 105469 - DNA, 332 bp, Homo sapiens; identical to SEQ ID NO: 70880
  misc_feature 1..332: note = chr10:134755846-134756178
  misc_feature 1..332: note = Hyper
  source 1..332: mol_type = genomic DNA

SEQ ID NO: 105470 - DNA, 30 bp, Homo sapiens; identical to SEQ ID NO: 42788
  misc_feature 1..30: note = chr10:134757661-134757691
  misc_feature 1..30: note = Hypo
  source 1..30: mol_type = genomic DNA

SEQ ID NO: 105471 - DNA, 30 bp, Homo sapiens; identical to SEQ ID NO: 70882
  misc_feature 1..30: note = chr10:134771907-134771937
  misc_feature 1..30: note = Hypo
  source 1..30: mol_type = genomic DNA

SEQ ID NO: 105472 - DNA, 179 bp, Homo sapiens; identical to SEQ ID NO: 70883
  misc_feature 1..179: note = chr10:134772301-134772480
  misc_feature 1..179: note = Hypo
  source 1..179: mol_type = genomic DNA

SEQ ID NO: 105473 - DNA, 30 bp, Homo sapiens; identical to SEQ ID NO: 70884
  misc_feature 1..30: note = chr10:134773161-134773191
  misc_feature 1..30: note = Hypo
  source 1..30: mol_type = genomic DNA

SEQ ID NO: 105474 - DNA, 147 bp, Homo sapiens; identical to SEQ ID NO: 70885
  misc_feature 1..147: note = chr10:134773880-134774027
  misc_feature 1..147: note = Hypo
  source 1..147: mol_type = genomic DNA

SEQ ID NO: 105475 - DNA, 33 bp, Homo sapiens; identical to SEQ ID NO: 70886
  misc_feature 1..33: note = chr10:134777879-134777912
  misc_feature 1..33: note = Hypo
  source 1..33: mol_type = genomic DNA

SEQ ID NO: 105476 - DNA, 90 bp, Homo sapiens; identical to SEQ ID NO: 70887
  misc_feature 1..90: note = chr10:134787026-134787116
  misc_feature 1..90: note = Hypo
  source 1..90: mol_type = genomic DNA

SEQ ID NO: 105477 - DNA, 87 bp, Homo sapiens; identical to SEQ ID NO: 70888
  misc_feature 1..87: note = chr10:134788030-134788117
  misc_feature 1..87: note = Hypo
  source 1..87: mol_type = genomic DNA

SEQ ID NO: 105478 - DNA, 30 bp, Homo sapiens; identical to SEQ ID NO: 70889
  misc_feature 1..30: note = chr10:134789538-134789568
  misc_feature 1..30: note = Hypo
  source 1..30: mol_type = genomic DNA

SEQ ID NO: 105479 - DNA, 36 bp, Homo sapiens; identical to SEQ ID NO: 70890
  misc_feature 1..36: note = chr10:134793932-134793968
  misc_feature 1..36: note = Hypo
  source 1..36: mol_type = genomic DNA

SEQ ID NO: 105480 - DNA, 98 bp, Homo sapiens; identical to SEQ ID NO: 70891
  misc_feature 1..98: note = chr10:134794346-134794444
  misc_feature 1..98: note = Hypo
  source 1..98: mol_type = genomic DNA

SEQ ID NO: 105481 - DNA, 54 bp, Homo sapiens; identical to SEQ ID NO: 70892
  misc_feature 1..54: note = chr10:134794878-134794932
  misc_feature 1..54: note = Hypo
  source 1..54: mol_type = genomic DNA

SEQ ID NO: 105482 - DNA, 176 bp, Homo sapiens; identical to SEQ ID NO: 70893
  misc_feature 1..176: note = chr10:134795866-134796042
  misc_feature 1..176: note = Hypo
  source 1..176: mol_type = genomic DNA

SEQ ID NO: 105483 - DNA, 161 bp, Homo sapiens; identical to SEQ ID NO: 70894
  misc_feature 1..161: note = chr10:134797569-134797730
  misc_feature 1..161: note = Hypo
  source 1..161: mol_type = genomic DNA

SEQ ID NO: 105484 - DNA, 41 bp, Homo sapiens; identical to SEQ ID NO: 70895
  misc_feature 1..41: note = chr10:134800646-134800687
  misc_feature 1..41: note = Hypo
  source 1..41: mol_type = genomic DNA

SEQ ID NO: 105485 - DNA, 30 bp, Homo sapiens; identical to SEQ ID NO: 70896
  misc_feature 1..30: note = chr10:134806473-134806503
  misc_feature 1..30: note = Hypo
  source 1..30: mol_type = genomic DNA

SEQ ID NO: 105486 - DNA, 51 bp, Homo sapiens; identical to SEQ ID NO: 70897
  misc_feature 1..51: note = chr10:134807256-134807307
  misc_feature 1..51: note = Hypo
  source 1..51: mol_type = genomic DNA

SEQ ID NO: 105487 - DNA, 54 bp, Homo sapiens; identical to SEQ ID NO: 70898
  misc_feature 1..54: note = chr10:134809821-134809875
  misc_feature 1..54: note = Hypo
  source 1..54: mol_type = genomic DNA

SEQ ID NO: 105488 - DNA, 30 bp, Homo sapiens; identical to SEQ ID NO: 70899
  misc_feature 1..30: note = chr10:134818621-134818651
  misc_feature 1..30: note = Hypo
  source 1..30: mol_type = genomic DNA

SEQ ID NO: 105489 - DNA, 30 bp, Homo sapiens; identical to SEQ ID NO: 70900
  misc_feature 1..30: note = chr10:134823987-134824017
  misc_feature 1..30: note = Hypo
  source 1..30: mol_type = genomic DNA

SEQ ID NO: 105490 - DNA, 119 bp, Homo sapiens; identical to SEQ ID NO: 70901
  misc_feature 1..119: note = chr10:134826512-134826631
  misc_feature 1..119: note = Hypo
  source 1..119: mol_type = genomic DNA

SEQ ID NO: 105491 - DNA, 37 bp, Homo sapiens; identical to SEQ ID NO: 70902
  misc_feature 1..37: note = chr10:134830634-134830671
  misc_feature 1..37: note = Hypo
  source 1..37: mol_type = genomic DNA

SEQ ID NO: 105492 - DNA, 87 bp, Homo sapiens; identical to SEQ ID NO: 70903
  misc_feature 1..87: note = chr10:134832028-134832115
  misc_feature 1..87: note = Hypo
  source 1..87: mol_type = genomic DNA

SEQ ID NO: 105493 - DNA, 30 bp, Homo sapiens; identical to SEQ ID NO: 70904
  misc_feature 1..30: note = chr10:134833453-134833483
  misc_feature 1..30: note = Hypo
  source 1..30: mol_type = genomic DNA

SEQ ID NO: 105494 - DNA, 84 bp, Homo sapiens; identical to SEQ ID NO: 70905
  misc_feature 1..84: note = chr10:134834266-134834350
  misc_feature 1..84: note = Hypo
  source 1..84: mol_type = genomic DNA

SEQ ID NO: 105495 - DNA, 395 bp, Homo sapiens; identical to SEQ ID NO: 70906
  misc_feature 1..395: note = chr10:134834562-134834957
  misc_feature 1..395: note = Hypo
  source 1..395: mol_type = genomic DNA

SEQ ID NO: 105496 - DNA, 30 bp, Homo sapiens; identical to SEQ ID NO: 70907
  misc_feature 1..30: note = chr10:134837231-134837261
  misc_feature 1..30: note = Hypo
  source 1..30: mol_type = genomic DNA

SEQ ID NO: 105497 - DNA, 58 bp, Homo sapiens
  misc_feature 1..58: note = chr10:134844792-134844850
  misc_feature 1..58: note = Hypo
  source 1..58: mol_type = genomic DNA
gcgaggtgcttctgccggtttctcctccgctggggacgcaggccgggagtttgctgct

SEQ ID NO: 105498 - DNA, 103 bp, Homo sapiens; identical to SEQ ID NO: 70908
  misc_feature 1..103: note = chr10:134855666-134855769
  misc_feature 1..103: note = Hypo
  source 1..103: mol_type = genomic DNA

SEQ ID NO: 105499 - DNA, 30 bp, Homo sapiens; identical to SEQ ID NO: 70909
  misc_feature 1..30: note = chr10:134860784-134860814
  misc_feature 1..30: note = Hypo
  source 1..30: mol_type = genomic DNA

SEQ ID NO: 105500 - DNA, 30 bp, Homo sapiens; identical to SEQ ID NO: 70910
  misc_feature 1..30: note = chr10:134863667-134863697
  misc_feature 1..30: note = Hypo
  source 1..30: mol_type = genomic DNA

SEQ ID NO: 105501 - DNA, 343 bp, Homo sapiens; identical to SEQ ID NO: 70911
  misc_feature 1..343: note = chr10:134875810-134876153
  misc_feature 1..343: note = Hypo
  source 1..343: mol_type = genomic DNA

SEQ ID NO: 105502 - DNA, 258 bp, Homo sapiens; identical to SEQ ID NO: 70912
  misc_feature 1..258: note = chr10:134886068-134886326
  misc_feature 1..258: note = Hypo
  source 1..258: mol_type = genomic DNA

SEQ ID NO: 105503 - DNA, 144 bp, Homo sapiens; identical to SEQ ID NO: 70913
  misc_feature 1..144: note = chr10:134886921-134887065
  misc_feature 1..144: note = Hypo
  source 1..144: mol_type = genomic DNA

SEQ ID NO: 105504 - DNA, 38 bp, Homo sapiens; identical to SEQ ID NO: 70914
  misc_feature 1..38: note = chr10:134890001-134890039
  misc_feature 1..38: note = Hypo
  source 1..38: mol_type = genomic DNA

SEQ ID NO: 105505 - DNA, 30 bp, Homo sapiens; identical to SEQ ID NO: 70915
  misc_feature 1..30: note = chr10:134894556-134894586
  misc_feature 1..30: note = Hypo
  source 1..30: mol_type = genomic DNA

SEQ ID NO: 105506 - DNA, 165 bp, Homo sapiens; identical to SEQ ID NO: 70916
  misc_feature 1..165: note = chr10:134895279-134895444
  misc_feature 1..165: note = Hypo
  source 1..165: mol_type = genomic DNA

SEQ ID NO: 105507 - DNA, 30 bp, Homo sapiens; identical to SEQ ID NO: 70917
  misc_feature 1..30: note = chr10:134897792-134897822
  misc_feature 1..30: note = Hypo
  source 1..30: mol_type = genomic DNA

SEQ ID NO: 105508 - DNA, 354 bp, Homo sapiens; identical to SEQ ID NO: 70918
  misc_feature 1..354: note = chr10:134898266-134898620
  misc_feature 1..354: note = Hypo
  source 1..354: mol_type = genomic DNA

SEQ ID NO: 105509 - DNA, 1078 bp, Homo sapiens
  misc_feature 1..1078: note = chr10:134901183-134902261
  misc_feature 1..1078: note = Hyper
  source 1..1078: mol_type = genomic DNA
ggaataacacagggtcgtgcagtccgcccggcggcgttttcgggcgagggtctggtgctggggagcgagcgcggagcgaggtgtctctttaaatacgctctgcagtgtgacggcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaagctcgcgccccgaggtgacactggccgcgaggaaagcagctccgagtaactttcggctccgctggggcgggaggcgccacggataatccagggcccccgccccgcgcgcccggcccggagctcgagccacatccaggcagagcaggcgccgcggccgggctggggcgggcgggtcactcggtgccggttcccggtgcaaaccccccggcgcgcctctggctttgtgcagcccgagatggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccgcggctgctccctggcggggtcggggctgcgagctgccctccgcggggaccctccgcccgccccgctgaccgccgctgtcttcacagatgggagcagctcccggactgcgcccgccccgccgcggtcaccctgaggc

SEQ ID NO: 105510 - DNA, 91 bp, Homo sapiens; identical to SEQ ID NO: 70922
  misc_feature 1..91: note = chr10:134907606-134907697
  misc_feature 1..91: note = Hypo
  source 1..91: mol_type = genomic DNA

SEQ ID NO: 105511 - DNA, 218 bp, Homo sapiens; identical to SEQ ID NO: 70923
  misc_feature 1..218: note = chr10:134912118-134912336
  misc_feature 1..218: note = Hypo
  source 1..218: mol_type = genomic DNA

SEQ ID NO: 105512 - DNA, 354 bp, Homo sapiens; identical to SEQ ID NO: 70924
  misc_feature 1..354: note = chr10:134913693-134914047
  misc_feature 1..354: note = Hypo
  source 1..354: mol_type = genomic DNA

SEQ ID NO: 105513 - DNA, 60 bp, Homo sapiens; identical to SEQ ID NO: 42804
  misc_feature 1..60: note = chr10:134916714-134916774
  misc_feature 1..60: note = Hypo
  source 1..60: mol_type = genomic DNA

SEQ ID NO: 105514 - DNA, 30 bp, Homo sapiens; identical to SEQ ID NO: 70926
  misc_feature 1..30: note = chr10:134928644-134928674
  misc_feature 1..30: note = Hypo
  source 1..30: mol_type = genomic DNA

SEQ ID NO: 105515 - DNA, 202 bp, Homo sapiens; identical to SEQ ID NO: 70927
  misc_feature 1..202: note = chr10:134930863-134931065
  misc_feature 1..202: note = Hypo
  source 1..202: mol_type = genomic DNA

SEQ ID NO: 105516 - DNA, 269 bp, Homo sapiens; identical to SEQ ID NO: 70928
  misc_feature 1..269: note = chr10:134937581-134937850
  misc_feature 1..269: note = Hypo
  source 1..269: mol_type = genomic DNA

SEQ ID NO: 105517 - DNA, 569 bp, Homo sapiens; identical to SEQ ID NO: 70929
  misc_feature 1..569: note = chr10:134940715-134941284
  misc_feature 1..569: note = Hypo
  source 1..569: mol_type = genomic DNA

SEQ ID NO: 105518 - DNA, 248 bp, Homo sapiens; identical to SEQ ID NO: 70930
  misc_feature 1..248: note = chr10:134941647-134941895
  misc_feature 1..248: note = Hypo
  source 1..248: mol_type = genomic DNA

SEQ ID NO: 105519 - DNA, 687 bp, Homo sapiens; identical to SEQ ID NO: 70931
  misc_feature 1..687: note = chr10:134942452-134943139
  misc_feature 1..687: note = Hypo
  source 1..687: mol_type = genomic DNA

SEQ ID NO: 105520 - DNA, 64 bp, Homo sapiens; identical to SEQ ID NO: 70932
  misc_feature 1..64: note = chr10:134943548-134943612
  misc_feature 1..64: note = Hypo
  source 1..64: mol_type = genomic DNA

SEQ ID NO: 105521 - DNA, 201 bp, Homo sapiens; identical to SEQ ID NO: 70933
  misc_feature 1..201: note = chr10:134944571-134944772
  misc_feature 1..201: note = Hypo
  source 1..201: mol_type = genomic DNA

SEQ ID NO: 105522 - DNA, 30 bp, Homo sapiens; identical to SEQ ID NO: 42811
  misc_feature 1..30: note = chr10:134945693-134945723
  misc_feature 1..30: note = Hypo
  source 1..30: mol_type = genomic DNA

SEQ ID NO: 105523 - DNA, 150 bp, Homo sapiens; identical to SEQ ID NO: 70935
  misc_feature 1..150: note = chr10:134955035-134955185
  misc_feature 1..150: note = Hypo
  source 1..150: mol_type = genomic DNA

SEQ ID NO: 105524 - DNA, 52 bp, Homo sapiens; identical to SEQ ID NO: 70936
  misc_feature 1..52: note = chr10:134955660-134955712
  misc_feature 1..52: note = Hypo
  source 1..52: mol_type = genomic DNA

SEQ ID NO: 105525 - DNA, 30 bp, Homo sapiens; identical to SEQ ID NO: 70937
  misc_feature 1..30: note = chr10:134968447-134968477
  misc_feature 1..30: note = Hypo
  source 1..30: mol_type = genomic DNA

SEQ ID NO: 105526 - DNA, 30 bp, Homo sapiens; identical to SEQ ID NO: 42813
  misc_feature 1..30: note = chr10:134970630-134970660
  misc_feature 1..30: note = Hypo
  source 1..30: mol_type = genomic DNA

SEQ ID NO: 105527 - DNA, 565 bp, Homo sapiens
  misc_feature 1..565: note = chr10:134973889-134974454
  misc_feature 1..565: note = Hyper
  source 1..565: mol_type = genomic DNA
tccatggagccagggcgcgcgtagccgagcccagcccagcccagccggaggccccgggggcggtgcgcggcgcggccgcaggatgcaggccatggacccggccgcggcggatctttacgaggaggacggcaaagacctggacttctacgacttcgagccgctgcccaccctccccgaggacgaggtgagcccccggccccactggggggccccttccgccgccgaggggtccgcggagagcgcccggggggaggacccgggaggggctgtgagctcccgcctccccaggcgccctccatggccgaggggttcccaccgccgttctcagcccccgcgttaggattttcacccggaggggacagcacccccgaatgcgcacgggacggcggcgggtgggcagcccctgcagaagttggtgcgcggtagctcctggtggaaaccctggcgggacagtgtgggggcagcaaggaggacggaggggggtctgcttactccctgccgggccccaggaggccagcggggtgcagagcagcagagtccaatcaggcgccgctcaggagctggg

SEQ ID NO: 105528 - DNA, 166 bp, Homo sapiens; identical to SEQ ID NO: 70941
  misc_feature 1..166: note = chr10:134980970-134981136
  misc_feature 1..166: note = Hypo
  source 1..166: mol_type = genomic DNA

SEQ ID NO: 105529 - DNA, 107 bp, Homo sapiens; identical to SEQ ID NO: 70942
  misc_feature 1..107: note = chr10:134992393-134992500
  misc_feature 1..107: note = Hypo
  source 1..107: mol_type = genomic DNA

SEQ ID NO: 105530 - DNA, 651 bp, Homo sapiens; identical to SEQ ID NO: 42815
  misc_feature 1..651: note = chr10:134996258-134996909
  misc_feature 1..651: note = Hypo
  source 1..651: mol_type = genomic DNA

SEQ ID NO: 105531 - DNA, 248 bp, Homo sapiens; identical to SEQ ID NO: 70944
  misc_feature 1..248: note = chr10:135001179-135001427
  misc_feature 1..248: note = Hypo
  source 1..248: mol_type = genomic DNA

SEQ ID NO: 105532 - DNA, 230 bp, Homo sapiens; identical to SEQ ID NO: 70945
  misc_feature 1..230: note = chr10:135001972-135002202
  misc_feature 1..230: note = Hypo
  source 1..230: mol_type = genomic DNA

SEQ ID NO: 105533 - DNA, 99 bp, Homo sapiens; identical to SEQ ID NO: 70946
  misc_feature 1..99: note = chr10:135002734-135002833
  misc_feature 1..99: note = Hypo
  source 1..99: mol_type = genomic DNA

SEQ ID NO: 105534 - DNA, 23 bp, Homo sapiens
  misc_feature 1..23: note = chr10:135004548-135004571
  misc_feature 1..23: note = Hypo
  source 1..23: mol_type = genomic DNA
taagccccaactggccgggcatg

SEQ ID NO: 105535 - DNA, 36 bp, Homo sapiens; identical to SEQ ID NO: 70948
  misc_feature 1..36: note = chr10:135008797-135008833
  misc_feature 1..36: note = Hypo
  source 1..36: mol_type = genomic DNA

SEQ ID NO: 105536 - DNA, 121 bp, Homo sapiens; identical to SEQ ID NO: 70949
  misc_feature 1..121: note = chr10:135010570-135010691
  misc_feature 1..121: note = Hypo
  source 1..121: mol_type = genomic DNA

SEQ ID NO: 105537 - DNA, 330 bp, Homo sapiens; identical to SEQ ID NO: 70950
  misc_feature 1..330: note = chr10:135011761-135012091
  misc_feature 1..330: note = Hypo
  source 1..330: mol_type = genomic DNA

SEQ ID NO: 105538 - DNA, 398 bp, Homo sapiens; identical to SEQ ID NO: 70951
  misc_feature 1..398: note = chr10:135012320-135012718
  misc_feature 1..398: note = Hypo
  source 1..398: mol_type = genomic DNA

SEQ ID NO: 105539 - DNA, 716 bp, Homo sapiens; identical to SEQ ID NO: 70952
  misc_feature 1..716: note = chr10:135014688-135015404
  misc_feature 1..716: note = Hypo
  source 1..716: mol_type = genomic DNA

SEQ ID NO: 105540 - DNA, 217 bp, Homo sapiens; identical to SEQ ID NO: 70953
  misc_feature 1..217: note = chr10:135016590-135016807
  misc_feature 1..217: note = Hypo
  source 1..217: mol_type = genomic DNA

SEQ ID NO: 105541 - DNA, 563 bp, Homo sapiens; identical to SEQ ID NO: 70954
  misc_feature 1..563: note = chr10:135017049-135017612
  misc_feature 1..563: note = Hypo
  source 1..563: mol_type = genomic DNA

SEQ ID NO: 105542 - DNA, 35 bp, Homo sapiens; identical to SEQ ID NO: 70955
  misc_feature 1..35: note = chr10:135018010-135018045
  misc_feature 1..35: note = Hypo
  source 1..35: mol_type = genomic DNA

SEQ ID NO: 105543 - DNA, 47 bp, Homo sapiens; identical to SEQ ID NO: 70956
  misc_feature 1..47: note = chr10:135018352-135018399
  misc_feature 1..47: note = Hypo
  source 1..47: mol_type = genomic DNA

SEQ ID NO: 105544 - DNA, 167 bp, Homo sapiens; identical to SEQ ID NO: 70957
  misc_feature 1..167: note = chr10:135018825-135018992
  misc_feature 1..167: note = Hypo
  source 1..167: mol_type = genomic DNA

SEQ ID NO: 105545 - DNA, 208 bp, Homo sapiens; identical to SEQ ID NO: 70958
  misc_feature 1..208: note = chr10:135020704-135020912
  misc_feature 1..208: note = Hypo
  source 1..208: mol_type = genomic DNA

SEQ ID NO: 105546 - DNA, 30 bp, Homo sapiens; identical to SEQ ID NO: 70959
  misc_feature 1..30: note = chr10:135022018-135022048
  misc_feature 1..30: note = Hypo
  source 1..30: mol_type = genomic DNA

SEQ ID NO: 105547 - DNA, 573 bp, Homo sapiens; identical to SEQ ID NO: 70960
  misc_feature 1..573: note = chr10:135023063-135023636
  misc_feature 1..573: note = Hypo
  source 1..573: mol_type = genomic DNA

SEQ ID NO: 105548 - DNA, 33 bp, Homo sapiens; identical to SEQ ID NO: 70961
  misc_feature 1..33: note = chr10:135025715-135025748
  misc_feature 1..33: note = Hypo
  source 1..33: mol_type = genomic DNA

SEQ ID NO: 105549 - DNA, 30 bp, Homo sapiens; identical to SEQ ID NO: 70962
  misc_feature 1..30: note = chr10:135029314-135029344
  misc_feature 1..30: note = Hypo
  source 1..30: mol_type = genomic DNA

SEQ ID NO: 105550 - DNA, 382 bp, Homo sapiens; identical to SEQ ID NO: 70963
  misc_feature 1..382: note = chr10:135030573-135030955
  misc_feature 1..382: note = Hypo
  source 1..382: mol_type = genomic DNA

SEQ ID NO: 105551 - DNA, 62 bp, Homo sapiens; identical to SEQ ID NO: 70964
  misc_feature 1..62: note = chr10:135032634-135032696
  misc_feature 1..62: note = Hypo
  source 1..62: mol_type = genomic DNA

SEQ ID NO: 105552 - DNA, 428 bp, Homo sapiens; identical to SEQ ID NO: 70965
  misc_feature 1..428: note = chr10:135035009-135035437
  misc_feature 1..428: note = Hypo
  source 1..428: mol_type = genomic DNA

SEQ ID NO: 105553 - DNA, 77 bp, Homo sapiens; identical to SEQ ID NO: 70966
  misc_feature 1..77: note = chr10:135037520-135037597
  misc_feature 1..77: note = Hypo
  source 1..77: mol_type = genomic DNA

SEQ ID NO: 105554 - DNA, 30 bp, Homo sapiens
  misc_feature 1..30: note = chr10:135040234-135040264
  misc_feature 1..30: note = Hyper
  source 1..30: mol_type = genomic DNA
aacagcctaaaagaacggactcccgtaacc

SEQ ID NO: 105555 - DNA, 1633 bp, Homo sapiens
  misc_feature 1..1633: note = chr10:135043162-135044795
  misc_feature 1..1633: note = Hyper
  source 1..1633: mol_type = genomic DNA
gatgctggctgcagacgcgctgcagatggaagaagttcagattttaaaagctacttctgcgagcgcgtgaattccgacacccattcccgcggctggcgtggcttctcctcggacccatcccctggcctggcgactccccctgggacccgggtcggtcctccggacccctcgcgtgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacccggcgggcggggcggggcgcgcggggcggggcggggatggtgggagggtcgcgtagacccggctgggacggagggacggcggcgcgggatgctcagaacgcgtgtgggcggcccgggcggcgtctggccctctccccatcctcgcgcgccgcgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaaccgggggctgccgagggctgcgggggaggggcgggcgcgccccgcgaaaatccgcccgaccgcctgctccgcgttcccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacat

SEQ ID NO: 105556 - DNA, 635 bp, Homo sapiens; identical to SEQ ID NO: 70970
  misc_feature 1..635: note = chr10:135048782-135049417
  misc_feature 1..635: note = Hyper
  source 1..635: mol_type = genomic DNA

SEQ ID NO: 105557 - DNA, 1183 bp, Homo sapiens
  misc_feature 1..1183: note = chr10:135049727-135050910
  misc_feature 1..1183: note = Hyper
  source 1..1183: mol_type = genomic DNA
aggcatctgggccctcgctgcccctggccgggacacactgccggtcctgtgcagtggctcaaagcccctctaccgggggtgacccggtctctccggagatgaagtgcagcgggggtctaggccggcttcctggccccccacccctcctggctttacccccgaggccacgtccaaagcccccagcgccccacccccgccagcctcccccttgagggcccagtgacctaactgggccggcagggtccgaggaagaccagggtcagcggcggcacggtccgttccgcgacccctctcctgtgaccccaggtaggccgccgatcggttcccggctgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccgccggagacgccgtgcggaccccaagccagtgcgcggaagacaccgtcctaccctcggcatggctgcctcccacccggtcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccctcggttcctgcgcggccgcacagcctggacgcagcgcacgcggg

SEQ ID NO: 105558 - DNA, 50 bp, Homo sapiens; identical to SEQ ID NO: 70973
  misc_feature 1..50: note = chr10:135064477-135064527
  misc_feature 1..50: note = Hypo
  source 1..50: mol_type = genomic DNA

SEQ ID NO: 105559 - DNA, 30 bp, Homo sapiens; identical to SEQ ID NO: 70974
  misc_feature 1..30: note = chr10:135066354-135066384
  misc_feature 1..30: note = Hypo
  source 1..30: mol_type = genomic DNA

SEQ ID NO: 105560 - DNA, 165 bp, Homo sapiens; identical to SEQ ID NO: 70975
  misc_feature 1..165: note = chr10:135069783-135069948
  misc_feature 1..165: note = Hypo
  source 1..165: mol_type = genomic DNA

SEQ ID NO: 105561 - DNA, 202 bp, Homo sapiens; identical to SEQ ID NO: 70976
  misc_feature 1..202: note = chr10:135076386-135076588
  misc_feature 1..202: note = Hypo
  source 1..202: mol_type = genomic DNA

SEQ ID NO: 105562 - DNA, 81 bp, Homo sapiens; identical to SEQ ID NO: 70977
  misc_feature 1..81: note = chr10:135078929-135079010
  misc_feature 1..81: note = Hypo
  source 1..81: mol_type = genomic DNA

SEQ ID NO: 105563 - DNA, 47 bp, Homo sapiens; identical to SEQ ID NO: 70978
  misc_feature 1..47: note = chr10:135084770-135084817
  misc_feature 1..47: note = Hypo
  source 1..47: mol_type = genomic DNA

SEQ ID NO: 105564 - DNA, 90 bp, Homo sapiens; identical to SEQ ID NO: 70979
  misc_feature 1..90: note = chr10:135086744-135086834
  misc_feature 1..90: note = Hypo
  source 1..90: mol_type = genomic DNA

SEQ ID NO: 105565 - DNA, 233 bp, Homo sapiens; identical to SEQ ID NO: 70980
  misc_feature 1..233: note = chr10:135087412-135087645
  misc_feature 1..233: note = Hypo
  source 1..233: mol_type = genomic DNA

SEQ ID NO: 105566 - DNA, 227 bp, Homo sapiens
  misc_feature 1..227: note = chr10:135121807-135122034
  misc_feature 1..227: note = Hyper
  source 1..227: mol_type = genomic DNA
tttcacgggagctgcggggactggagaggtcgacaggaccccgacaaaccaggaaagggcctttgaactaaagtaacgggaagtcacccaagggctttaaattaaaaacggttacaataaaactggagtcactttggctccagttcgcgactggtttagagggaacaagatccagggactgcagcgggagacgacaggcggggcaaggcggacgggagagggcgtgc

SEQ ID NO: 105567 - DNA, 205 bp, Homo sapiens; identical to SEQ ID NO: 70981
  misc_feature 1..205: note = chr10:135124038-135124243
  misc_feature 1..205: note = Hypo
  source 1..205: mol_type = genomic DNA

SEQ ID NO: 105568 - DNA, 40 bp, Homo sapiens; identical to SEQ ID NO: 70982
  misc_feature 1..40: note = chr10:135133094-135133134
  misc_feature 1..40: note = Hypo
  source 1..40: mol_type = genomic DNA

SEQ ID NO: 105569 - DNA, 810 bp, Homo sapiens; identical to SEQ ID NO: 70983
  misc_feature 1..810: note = chr10:135138920-135139730
  misc_feature 1..810: note = Hyper
  source 1..810: mol_type = genomic DNA

SEQ ID NO: 105570 - DNA, 319 bp, Homo sapiens; identical to SEQ ID NO: 70984
  misc_feature 1..319: note = chr10:135148783-135149102
  misc_feature 1..319: note = Hyper
  source 1..319: mol_type = genomic DNA

SEQ ID NO: 105571 - DNA, 253 bp, Homo sapiens; identical to SEQ ID NO: 70985
  misc_feature 1..253: note = chr10:135150325-135150578
  misc_feature 1..253: note = Hyper
  source 1..253: mol_type = genomic DNA

SEQ ID NO: 105572 - DNA, 79 bp, Homo sapiens; identical to SEQ ID NO: 70986
  misc_feature 1..79: note = chr10:135159573-135159652
  misc_feature 1..79: note = Hypo
  source 1..79: mol_type = genomic DNA

SEQ ID NO: 105573 - DNA, 30 bp, Homo sapiens; identical to SEQ ID NO: 42836
  misc_feature 1..30: note = chr10:135162912-135162942
  misc_feature 1..30: note = Hypo
  source 1..30: mol_type = genomic DNA

SEQ ID NO: 105574 - DNA, 115 bp, Homo sapiens; identical to SEQ ID NO: 70988
  misc_feature 1..115: note = chr10:135170721-135170836
  misc_feature 1..115: note = Hyper
  source 1..115: mol_type = genomic DNA

SEQ ID NO: 105575 - DNA, 43 bp, Homo sapiens; identical to SEQ ID NO: 70989
  misc_feature 1..43: note = chr10:135208594-135208637
  misc_feature 1..43: note = Hypo
  source 1..43: mol_type = genomic DNA

SEQ ID NO: 105576 - DNA, 345 bp, Homo sapiens; identical to SEQ ID NO: 33566
  misc_feature 1..345: note = chr10:135236927-135237272
  misc_feature 1..345: note = Hyper
  source 1..345: mol_type = genomic DNA

SEQ ID NO: 105577 - DNA, 30 bp, Homo sapiens; identical to SEQ ID NO: 70991
  misc_feature 1..30: note = chr10:135269174-135269204
  misc_feature 1..30: note = Hypo
  source 1..30: mol_type = genomic DNA

SEQ ID NO: 105578 - DNA, 30 bp, Homo sapiens; identical to SEQ ID NO: 42838
  misc_feature 1..30: note = chr11:197439-197469
  misc_feature 1..30: note = Hypo
  source 1..30: mol_type = genomic DNA

SEQ ID NO: 105579 - DNA, 94 bp, Homo sapiens; identical to SEQ ID NO: 72602
  misc_feature 1..94: note = chr11:232918-233012
  misc_feature 1..94: note = Hypo
  source 1..94: mol_type = genomic DNA

SEQ ID NO: 105580 - DNA, 114 bp, Homo sapiens; identical to SEQ ID NO: 72648
  misc_feature 1..114: note = chr11:279418-279532
  misc_feature 1..114: note = Hyper
  source 1..114: mol_type = genomic DNA

SEQ ID NO: 105581 - DNA, 152 bp, Homo sapiens
  misc_feature 1..152: note = chr11:280108-280260
  misc_feature 1..152: note = Hyper
  source 1..152: mol_type = genomic DNA
cgtgctgcagctgcacgctcgggtgaaggagaggaacgcccgctccgtgaagatcaccaagcgcttcaccaagctgctcatcgcgcccgagagcgccgccccggaggaggcgatggggcccgcggaagagcctgagccggggcgcgcgcggc

SEQ ID NO: 105582 - DNA, 39 bp, Homo sapiens; identical to SEQ ID NO: 72665
  misc_feature 1..39: note = chr11:299379-299418
  misc_feature 1..39: note = Hypo
  source 1..39: mol_type = genomic DNA

SEQ ID NO: 105583 - DNA, 156 bp, Homo sapiens
  misc_feature 1..156: note = chr11:308110-308266
  misc_feature 1..156: note = Hyper
  source 1..156: mol_type = genomic DNA
aaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggagga

SEQ ID NO: 105584 - DNA, 36 bp, Homo sapiens; identical to SEQ ID NO: 72680
  misc_feature 1..36: note = chr11:308326-308362
  misc_feature 1..36: note = Hyper
  source 1..36: mol_type = genomic DNA

SEQ ID NO: 105585 - DNA, 195 bp, Homo sapiens; identical to SEQ ID NO: 72754
  misc_feature 1..195: note = chr11:327113-327308
  misc_feature 1..195: note = Hyper
  source 1..195: mol_type = genomic DNA

SEQ ID NO: 105586 - DNA, 858 bp, Homo sapiens; identical to SEQ ID NO: 72809
  misc_feature 1..858: note = chr11:369415-370273
  misc_feature 1..858: note = Hyper
  source 1..858: mol_type = genomic DNA

SEQ ID NO: 105587 - DNA, 30 bp, Homo sapiens; identical to SEQ ID NO: 72814
  misc_feature 1..30: note = chr11:392634-392664
  misc_feature 1..30: note = Hypo
  source 1..30: mol_type = genomic DNA

SEQ ID NO: 105588 - DNA, 356 bp, Homo sapiens; identical to SEQ ID NO: 72815
  misc_feature 1..356: note = chr11:394701-395057
  misc_feature 1..356: note = Hypo
  source 1..356: mol_type = genomic DNA

SEQ ID NO: 105589 - DNA, 448 bp, Homo sapiens; identical to SEQ ID NO: 72821
  misc_feature 1..448: note = chr11:406722-407170
  misc_feature 1..448: note = Hyper
  source 1..448: mol_type = genomic DNA

SEQ ID NO: 105590 - DNA, 142 bp, Homo sapiens; identical to SEQ ID NO: 72822
  misc_feature 1..142: note = chr11:407389-407531
  misc_feature 1..142: note = Hyper
  source 1..142: mol_type = genomic DNA

SEQ ID NO: 105591 - DNA, 47 bp, Homo sapiens
  misc_feature 1..47: note = chr11:416550-416597
  misc_feature 1..47: note = Hyper
  source 1..47: mol_type = genomic DNA
ctcagacccagccagcgtcctcggtccgcggccgcccctgcccggtg

SEQ ID NO: 105592 - DNA, 293 bp, Homo sapiens; identical to SEQ ID NO: 72826
  misc_feature 1..293: note = chr11:429466-429759
  misc_feature 1..293: note = Hypo
  source 1..293: mol_type = genomic DNA

SEQ ID NO: 105593 - DNA, 362 bp, Homo sapiens; identical to SEQ ID NO: 72870
  misc_feature 1..362: note = chr11:445925-446287
  misc_feature 1..362: note = Hypo
  source 1..362: mol_type = genomic DNA

SEQ ID NO: 105594 - DNA, 120 bp, Homo sapiens; identical to SEQ ID NO: 72877
  misc_feature 1..120: note = chr11:447598-447718
  misc_feature 1..120: note = Hypo
  source 1..120: mol_type = genomic DNA

SEQ ID NO: 105595 - DNA, 41 bp, Homo sapiens; identical to SEQ ID NO: 72883
  misc_feature 1..41: note = chr11:449336-449377
  misc_feature 1..41: note = Hypo
  source 1..41: mol_type = genomic DNA

SEQ ID NO: 105596 - DNA, 85 bp, Homo sapiens; identical to SEQ ID NO: 72885
  misc_feature 1..85: note = chr11:449589-449674
  misc_feature 1..85: note = Hypo
  source 1..85: mol_type = genomic DNA

SEQ ID NO: 105597 - DNA, 82 bp, Homo sapiens; identical to SEQ ID NO: 72936
  misc_feature 1..82: note = chr11:486013-486095
  misc_feature 1..82: note = Hypo
  source 1..82: mol_type = genomic DNA

SEQ ID NO: 105598 - DNA, 245 bp, Homo sapiens; identical to SEQ ID NO: 42846
  misc_feature 1..245: note = chr11:487303-487548
  misc_feature 1..245: note = Hypo
  source 1..245: mol_type = genomic DNA

SEQ ID NO: 105599 - DNA, 30 bp, Homo sapiens; identical to SEQ ID NO: 72938
  misc_feature 1..30: note = chr11:487827-487857
  misc_feature 1..30: note = Hypo
  source 1..30: mol_type = genomic DNA

SEQ ID NO: 105600 - DNA, 54 bp, Homo sapiens; identical to SEQ ID NO: 42847
  misc_feature 1..54: note = chr11:493145-493199
  misc_feature 1..54: note = Hypo
  source 1..54: mol_type = genomic DNA

SEQ ID NO: 105601 - DNA, 157 bp, Homo sapiens; identical to SEQ ID NO: 72946
  misc_feature 1..157: note = chr11:507665-507822
  misc_feature 1..157: note = Hyper
  source 1..157: mol_type = genomic DNA

SEQ ID NO: 105602 - DNA, 39 bp, Homo sapiens; identical to SEQ ID NO: 72948
  misc_feature 1..39: note = chr11:518894-518933
  misc_feature 1..39: note = Hyper
  source 1..39: mol_type = genomic DNA

SEQ ID NO: 105603 - DNA, 44 bp, Homo sapiens; identical to SEQ ID NO: 72951
  misc_feature 1..44: note = chr11:520975-521019
  misc_feature 1..44: note = Hypo
  source 1..44: mol_type = genomic DNA

SEQ ID NO: 105604 - DNA, 30 bp, Homo sapiens; identical to SEQ ID NO: 72952
  misc_feature 1..30: note = chr11:528361-528391
  misc_feature 1..30: note = Hypo
  source 1..30: mol_type = genomic DNA

SEQ ID NO: 105605 - DNA, 303 bp, Homo sapiens
  misc_feature 1..303: note = chr11:536871-537174
  misc_feature 1..303: note = Hyper
  source 1..303: mol_type = genomic DNA
cggtcccgggggtcccgcctgccgtccgtccaccgcgcggtcgcagtcagagctcggctcggggcggacacgcatgaacgcgagtgagaagcggcgactggacggcgggcggcagcgtgtcccgcgggccgggcactcgggtgcgctccggcgtccggtgtgtgtttcctggtcctcgggggcgcttcccccggtgcttccttttgccgtcggcctcacttccaaccgaaggtcaggacggcaggcctcggccccaggggcgacccttccacctgggaaaggtgggcgcgagcctccagcaga

SEQ ID NO: 105606 - DNA, 30 bp, Homo sapiens; identical to SEQ ID NO: 72958
  misc_feature 1..30: note = chr11:548977-549007
  misc_feature 1..30: note = Hypo
  source 1..30: mol_type = genomic DNA

SEQ ID NO: 105607 - DNA, 638 bp, Homo sapiens; identical to SEQ ID NO: 72965
  misc_feature 1..638: note = chr11:562246-562884
  misc_feature 1..638: note = Hypo
  source 1..638: mol_type = genomic DNA

SEQ ID NO: 105608 - DNA, 30 bp, Homo sapiens; identical to SEQ ID NO: 72967
  misc_feature 1..30: note = chr11:567232-567262
  misc_feature 1..30: note = Hypo
  source 1..30: mol_type = genomic DNA

SEQ ID NO: 105609 - DNA, 30 bp, Homo sapiens; identical to SEQ ID NO: 42849
  misc_feature 1..30: note = chr11:571791-571821
  misc_feature 1..30: note = Hypo
  source 1..30: mol_type = genomic DNA

SEQ ID NO: 105610 - DNA, 30 bp, Homo sapiens; identical to SEQ ID NO: 73023
  misc_feature 1..30: note = chr11:605782-605812
  misc_feature 1..30: note = Hypo
  source 1..30: mol_type = genomic DNA

SEQ ID NO: 105611 - DNA, 30 bp, Homo sapiens; identical to SEQ ID NO: 73027
  misc_feature 1..30: note = chr11:607280-607310
  misc_feature 1..30: note = Hypo
  source 1..30: mol_type = genomic DNA

SEQ ID NO: 105612 - DNA, 285 bp, Homo sapiens
  misc_feature 1..285: note = chr11:615700-615985
  misc_feature 1..285: note = Hyper
  source 1..285: mol_type = genomic DNA
aaacctaaacagtggcgcttcgcaccctcctcgatcccaccccgtccggttctcagctccgcggaaccccgcctccgcctccgcctccctccccgcccgaccctcatctctcaggctcccccagctcttggctctacccctccggggtcacggagcccccacggaggctctcgctcccggcctgcaccgcgtgggtctggggtccccagtacctgggtgccagagccgccgggacgggaagtttcgtctcgcggggaagcggagggccggcgcttttatggtggc

SEQ ID NO: 105613 - DNA, 105 bp, Homo sapiens; identical to SEQ ID NO: 73067
  misc_feature 1..105: note = chr11:616542-616647
  misc_feature 1..105: note = Hypo
  source 1..105: mol_type = genomic DNA

SEQ ID NO: 105614 - DNA, 585 bp, Homo sapiens
  misc_feature 1..585: note = chr11:626863-627448
  misc_feature 1..585: note = Hyper
  source 1..585: mol_type = genomic DNA
accccccaccccacccggcctcacctgcgcttccccaccaggccctgtagcagccgctggagccgcgcgccctcccgcaggcggctgagctcgctggtgaacgtcccgtctgagtgtcgccgggccctgcgggcggtcgggggtcggggtcagggcgcactgggggcgggtggggcccggggggcgggcgggcctggcgggcggctcacctggggggcgcggggcgcgcggcggagcccccgaggagcagcagcagcagcaggaggggccggggggccatggcggggtcggggcgcaggagctgagcgctgcggccacggccccgggcccccgcaaggcccctttatggcggcgcccggaaaggggacggcccggccgcgcccagcgatcccgggaaggtcagggccgcccccccagctgtcgccccggcccggcctcccgccccctccgccgcgctggcgcccctcggccggctgggggagggggacgtcccggcctggggggcgaacggagcgcgggcctgggacccgcagagggaaccgcaccgcgaagcctcggagcctgcgggggcggaggggccggagg

SEQ ID NO: 105615 - DNA, 30 bp, Homo sapiens
  misc_feature 1..30: note = chr11:636895-636925
  misc_feature 1..30: note = Hyper
  source 1..30: mol_type = genomic DNA
actagggtgagcgcccgagggccgggacgc

SEQ ID NO: 105616 - DNA, 325 bp, Homo sapiens
  misc_feature 1..325: note = chr11:637176-637501
  misc_feature 1..325: note = Hyper
  source 1..325: mol_type = genomic DNA
ggggcccccctgagccggggcgggtcgggggcgggaccagggtccggccggggcgtgcccgaggggagggactccccggcttgcgacccggcgttgtccgcggtgctcagcgcccgcccgggcgcgccatggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgca

SEQ ID NO: 105617 - DNA, 218 bp, Homo sapiens
  misc_feature 1..218: note = chr11:640069-640287
  misc_feature 1..218: note = Hyper
  source 1..218: mol_type = genomic DNA
gcggccccgactgtgcgcccgccgcgcccagcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagg

SEQ ID NO: 105618 - DNA, 30 bp, Homo sapiens; identical to SEQ ID NO: 73358
  misc_feature 1..30: note = chr11:698834-698864
  misc_feature 1..30: note = Hypo
  source 1..30: mol_type = genomic DNA

SEQ ID NO: 105619 - DNA, 66 bp, Homo sapiens; identical to SEQ ID NO: 73367
  misc_feature 1..66: note = chr11:707906-707972
  misc_feature 1..66: note = Hypo
  source 1..66: mol_type = genomic DNA

SEQ ID NO: 105620 - DNA, 19 bp, Homo sapiens
  misc_feature 1..19: note = chr11:713388-713407
  misc_feature 1..19: note = Hypo
  source 1..19: mol_type = genomic DNA
tttgtgtgtttgagacgga

SEQ ID NO: 105621 - DNA, 203 bp, Homo sapiens; identical to SEQ ID NO: 33582
  misc_feature 1..203: note = chr11:726307-726510
  misc_feature 1..203: note = Hyper
  source 1..203: mol_type = genomic DNA

SEQ ID NO: 105622 - DNA, 266 bp, Homo sapiens; identical to SEQ ID NO: 73413
  misc_feature 1..266: note = chr11:736495-736761
  misc_feature 1..266: note = Hypo
  source 1..266: mol_type = genomic DNA

SEQ ID NO: 105623 - DNA, 38 bp, Homo sapiens; identical to SEQ ID NO: 73455
  misc_feature 1..38: note = chr11:762939-762977
  misc_feature 1..38: note = Hypo
  source 1..38: mol_type = genomic DNA

SEQ ID NO: 105624 - DNA, 716 bp, Homo sapiens; identical to SEQ ID NO: 73456
  misc_feature 1..716: note = chr11:763302-764018
  misc_feature 1..716: note = Hypo
  source 1..716: mol_type = genomic DNA

SEQ ID NO: 105625 - DNA, 443 bp, Homo sapiens; identical to SEQ ID NO: 73468
  misc_feature 1..443: note = chr11:782133-782576
  misc_feature 1..443: note = Hypo
  source 1..443: mol_type = genomic DNA

SEQ ID NO: 105626 - DNA, 181 bp, Homo sapiens; identical to SEQ ID NO: 73474
  misc_feature 1..181: note = chr11:787323-787504
  misc_feature 1..181: note = Hypo
  source 1..181: mol_type = genomic DNA

SEQ ID NO: 105627 - DNA, 41 bp, Homo sapiens; identical to SEQ ID NO: 73485
  misc_feature 1..41: note = chr11:796141-796182
  misc_feature 1..41: note = Hyper
  source 1..41: mol_type = genomic DNA

SEQ ID NO: 105628 - DNA, 30 bp, Homo sapiens; identical to SEQ ID NO: 73487
  misc_feature 1..30: note = chr11:804039-804069
  misc_feature 1..30: note = Hypo
  source 1..30: mol_type = genomic DNA

SEQ ID NO: 105629 - DNA, 30 bp, Homo sapiens; identical to SEQ ID NO: 73497
  misc_feature 1..30: note = chr11:823464-823494
  misc_feature 1..30: note = Hypo
  source 1..30: mol_type = genomic DNA

SEQ ID NO: 105630 - DNA, 481 bp, Homo sapiens
  misc_feature 1..481: note = chr11:823903-824384
  misc_feature 1..481: note = Hypo
  source 1..481: mol_type = genomic DNA
agagagaggagaggacggtgagcaggggagggaagccgagcgggtcctgggccccgctgcctccactggccgccgacctcccgcccacccgcagccctgctggaggcctgcgtggagcccacggacctgctgaccaccctctccaacatgctgcctgtgcgtctggccacggccatgatggtgccctacacgctgccgctggagagcgctctgtccttcaccatccggtgtgagggctggggggtcgggagaggggcccaggggacggactttgggatcatccgcgagtgatggttaccagggaaggtggggtggggtgagcagtgccaagtcagggcacagacagggcccggcgggtgggcatgtgggtctggccaagtccctgaacgcgccgctcgccctgtccccagcttgctggagtggctgcccgacgttcccgaggacatccggtggatgaaggagcagacgggcagcatctgcc

SEQ ID NO: 105631 - DNA, 156 bp, Homo sapiens; identical to SEQ ID NO: 73501
  misc_feature 1..156: note = chr11:824828-824984
  misc_feature 1..156: note = Hypo
  source 1..156: mol_type = genomic DNA

SEQ ID NO: 105632 - DNA, 1041 bp, Homo sapiens
  misc_feature 1..1041: note = chr11:829531-830572
  misc_feature 1..1041: note = Hyper
  source 1..1041: mol_type = genomic DNA
cctgggcaagtgagtcggcgctggccccgctcccactgcccgctctgctgtttctctgcctgcatgctgtctgcccttgtcacccgagtgctggttctgcacagggtctctaggccgggtcaggcccagcctagcgtcagctgcgattccctgggagggacccggcatgatttcccgcagaatttgcatttcatgaggcagcagccagggctgcagggaggaggggcagcgccgggcgcggggccacataccggcactgcccagggtacacacacctcaccgaccacgcacgccgggcaggggcgaaagcgctcacgggagggatgccctgcacgcagcaagtgctcctgtcctgcccaggggcgaagaagtctcctaagggtttgctgctggcggagggaagcctgcttcccgcttctgccagctccagcctcagttcccgcccgccctccaggcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggtgagggccggggtggggtatgggggccaatggagggcctcagggcagcagcagaggcggtgccagggggctgtagcgctggcaagttctcatccggggtcgcccggtcccccgaaggcgcgagagcgagcacgagagggaggtgcgcgctctgtacgaggagacggagcagcttcgggagcagagccggcgcccgccgagtcaggtgggcctcgggccccgcccctcccgccaggcccaatcccacctcgctggcctccctggctccgccttctctgaattaatccctccccgacggccccacctccgcgggtccaggctgccctcagcccgaggagatcccactgggcctcacgtatcacccccgtccggtcttctccacccgaccccgctccgcccgggcccactcccagcccctggccctccgtgtacctcttttg

SEQ ID NO: 105633 - DNA, 30 bp, Homo sapiens; identical to SEQ ID NO: 73515
  misc_feature 1..30: note = chr11:847531-847561
  misc_feature 1..30: note = Hypo
  source 1..30: mol_type = genomic DNA

SEQ ID NO: 105634 - DNA, 561 bp, Homo sapiens; identical to SEQ ID NO: 73516
  misc_feature 1..561: note = chr11:850546-851107
  misc_feature 1..561: note = Hypo
  source 1..561: mol_type = genomic DNA

SEQ ID NO: 105635 - DNA, 30 bp, Homo sapiens; identical to SEQ ID NO: 73520
  misc_feature 1..30: note = chr11:854103-854133
  misc_feature 1..30: note = Hypo
  source 1..30: mol_type = genomic DNA

SEQ ID NO: 105636 - DNA, 199 bp, Homo sapiens; identical to SEQ ID NO: 73523
  misc_feature 1..199: note = chr11:858423-858622
  misc_feature 1..199: note = Hypo
  source 1..199: mol_type = genomic DNA

SEQ ID NO: 105637 - DNA, 399 bp, Homo sapiens; identical to SEQ ID NO: 73524
  misc_feature 1..399: note = chr11:858987-859386
  misc_feature 1..399: note = Hypo
  source 1..399: mol_type = genomic DNA

SEQ ID NO: 105638 - DNA, 33 bp, Homo sapiens; identical to SEQ ID NO: 42861
  misc_feature 1..33: note = chr11:860888-860921
  misc_feature 1..33: note = Hypo
  source 1..33: mol_type = genomic DNA

SEQ ID NO: 105639 - DNA, 140 bp, Homo sapiens; identical to SEQ ID NO: 73530
  misc_feature 1..140: note = chr11:861908-862048
  misc_feature 1..140: note = Hypo
  source 1..140: mol_type = genomic DNA

SEQ ID NO: 105640 - DNA, 476 bp, Homo sapiens; identical to SEQ ID NO: 42862
  misc_feature 1..476: note = chr11:862616-863092
  misc_feature 1..476: note = Hypo
  source 1..476: mol_type = genomic DNA

SEQ ID NO: 105641 - DNA, 101 bp, Homo sapiens; identical to SEQ ID NO: 73534
  misc_feature 1..101: note = chr11:864732-864833
  misc_feature 1..101: note = Hypo
  source 1..101: mol_type = genomic DNA

SEQ ID NO: 105642 - DNA, 470 bp, Homo sapiens; identical to SEQ ID NO: 42864
  misc_feature 1..470: note = chr11:865657-866127
  misc_feature 1..470: note = Hypo
  source 1..470: mol_type = genomic DNA

SEQ ID NO: 105643 - DNA, 42 bp, Homo sapiens; identical to SEQ ID NO: 73537
  misc_feature 1..42: note = chr11:866956-866998
  misc_feature 1..42: note = Hypo
  source 1..42: mol_type = genomic DNA

SEQ ID NO: 105644 - DNA, 30 bp, Homo sapiens; identical to SEQ ID NO: 73538
  misc_feature 1..30: note = chr11:868485-868515
  misc_feature 1..30: note = Hypo
  source 1..30: mol_type = genomic DNA

SEQ ID NO: 105645 - DNA, 265 bp, Homo sapiens; identical to SEQ ID NO: 73539
  misc_feature 1..265: note = chr11:869823-870088
  misc_feature 1..265: note = Hypo
  source 1..265: mol_type = genomic DNA

SEQ ID NO: 105646 - DNA, 141 bp, Homo sapiens; identical to SEQ ID NO: 73540
  misc_feature 1..141: note = chr11:875376-875517
  misc_feature 1..141: note = Hypo
  source 1..141: mol_type = genomic DNA

SEQ ID NO: 105647 - DNA, 39 bp, Homo sapiens; identical to SEQ ID NO: 73549
  misc_feature 1..39: note = chr11:891173-891212
  misc_feature 1..39: note = Hypo
  source 1..39: mol_type = genomic DNA

SEQ ID NO: 105648 - DNA, 35 bp, Homo sapiens; identical to SEQ ID NO: 73600
  misc_feature 1..35: note = chr11:971825-971860
  misc_feature 1..35: note = Hypo
  source 1..35: mol_type = genomic DNA

SEQ ID NO: 105649 - DNA, 199 bp, Homo sapiens; identical to SEQ ID NO: 73604
  misc_feature 1..199: note = chr11:985267-985466
  misc_feature 1..199: note = Hypo
  source 1..199: mol_type = genomic DNA

SEQ ID NO: 105650 - DNA, 146 bp, Homo sapiens; identical to SEQ ID NO: 73606
  misc_feature 1..146: note = chr11:986867-987013
  misc_feature 1..146: note = Hypo
  source 1..146: mol_type = genomic DNA

SEQ ID NO: 105651 - DNA, 53 bp, Homo sapiens; identical to SEQ ID NO: 71882
  misc_feature 1..53: note = chr11:1001969-1002022
  misc_feature 1..53: note = Hypo
  source 1..53: mol_type = genomic DNA

SEQ ID NO: 105652 - DNA, 50 bp, Homo sapiens; identical to SEQ ID NO: 71883
  misc_feature 1..50: note = chr11:1008075-1008125
  misc_feature 1..50: note = Hypo
  source 1..50: mol_type = genomic DNA

SEQ ID NO: 105653 - DNA, 140 bp, Homo sapiens; identical to SEQ ID NO: 71884
  misc_feature 1..140: note = chr11:1008417-1008557
  misc_feature 1..140: note = Hypo
  source 1..140: mol_type = genomic DNA

SEQ ID NO: 105654 - DNA, 43 bp, Homo sapiens; identical to SEQ ID NO: 71889
  misc_feature 1..43: note = chr11:1011399-1011442
  misc_feature 1..43: note = Hypo
  source 1..43: mol_type = genomic DNA

SEQ ID NO: 105655 - DNA, 96 bp, Homo sapiens; identical to SEQ ID NO: 71897
  misc_feature 1..96: note = chr11:1024000-1024096
  misc_feature 1..96: note = Hypo
  source 1..96: mol_type = genomic DNA

SEQ ID NO: 105656 - DNA, 344 bp, Homo sapiens; identical to SEQ ID NO: 42870
  misc_feature 1..344: note = chr11:1024866-1025210
  misc_feature 1..344: note = Hypo
  source 1..344: mol_type = genomic DNA

SEQ ID NO: 105657 - DNA, 308 bp, Homo sapiens; identical to SEQ ID NO: 71899
  misc_feature 1..308: note = chr11:1025881-1026189
  misc_feature 1..308: note = Hypo
  source 1..308: mol_type = genomic DNA

SEQ ID NO: 105658 - DNA, 305 bp, Homo sapiens; identical to SEQ ID NO: 71900
  misc_feature 1..305: note = chr11:1027283-1027588
  misc_feature 1..305: note = Hypo
  source 1..305: mol_type = genomic DNA

SEQ ID NO: 105659 - DNA, 125 bp, Homo sapiens; identical to SEQ ID NO: 71901
  misc_feature 1..125: note = chr11:1028245-1028370
  misc_feature 1..125: note = Hypo
  source 1..125: mol_type = genomic DNA

SEQ ID NO: 105660 - DNA, 447 bp, Homo sapiens; identical to SEQ ID NO: 71902
  misc_feature 1..447: note = chr11:1029178-1029625
  misc_feature 1..447: note = Hypo
  source 1..447: mol_type = genomic DNA

SEQ ID NO: 105661 - DNA, 177 bp, Homo sapiens; identical to SEQ ID NO: 71905
  misc_feature 1..177: note = chr11:1030131-1030308
  misc_feature 1..177: note = Hypo
  source 1..177: mol_type = genomic DNA

SEQ ID NO: 105662 - DNA, 30 bp, Homo sapiens; identical to SEQ ID NO: 71906
  misc_feature 1..30: note = chr11:1030716-1030746
  misc_feature 1..30: note = Hypo
  source 1..30: mol_type = genomic DNA

SEQ ID NO: 105663 - DNA, 51 bp, Homo sapiens; identical to SEQ ID NO: 71914
  misc_feature 1..51: note = chr11:1043870-1043921
  misc_feature 1..51: note = Hypo
  source 1..51: mol_type = genomic DNA

SEQ ID NO: 105664 - DNA, 39 bp, Homo sapiens; identical to SEQ ID NO: 71919
  misc_feature 1..39: note = chr11:1053231-1053270
  misc_feature 1..39: note = Hypo
  source 1..39: mol_type = genomic DNA

SEQ ID NO: 105665 - DNA, 30 bp, Homo sapiens; identical to SEQ ID NO: 71925
  misc_feature 1..30: note = chr11:1055284-1055314
  misc_feature 1..30: note = Hypo
  source 1..30: mol_type = genomic DNA

SEQ ID NO: 105666 - DNA, 30 bp, Homo sapiens; identical to SEQ ID NO: 71926
  misc_feature 1..30: note = chr11:1056507-1056537
  misc_feature 1..30: note = Hypo
  source 1..30: mol_type = genomic DNA

SEQ ID NO: 105667 - DNA, 212 bp, Homo sapiens; identical to SEQ ID NO: 71931
  misc_feature 1..212: note = chr11:1075735-1075947
  misc_feature 1..212: note = Hypo
  source 1..212: mol_type = genomic DNA

SEQ ID NO: 105668 - DNA, 203 bp, Homo sapiens; identical to SEQ ID NO: 71932
  misc_feature 1..203: note = chr11:1077565-1077768
  misc_feature 1..203: note = Hypo
  source 1..203: mol_type = genomic DNA

SEQ ID NO: 105669 - DNA, 18 bp, Homo sapiens
  misc_feature 1..18: note = chr11:1078768-1078786
  misc_feature 1..18: note = Hypo
  source 1..18: mol_type = genomic DNA
tggggggacactcaccgc

SEQ ID NO: 105670 - DNA, 102 bp, Homo sapiens; identical to SEQ ID NO: 71935
  misc_feature 1..102: note = chr11:1079561-1079663
  misc_feature 1..102: note = Hypo
  source 1..102: mol_type = genomic DNA

SEQ ID NO: 105671 - DNA, 126 bp, Homo sapiens; identical to SEQ ID NO: 71936
  misc_feature 1..126: note = chr11:1080203-1080329
  misc_feature 1..126: note = Hypo
  source 1..126: mol_type = genomic DNA

SEQ ID NO: 105672 - DNA, 208 bp, Homo sapiens; identical to SEQ ID NO: 71939
  misc_feature 1..208: note = chr11:1081640-1081848
  misc_feature 1..208: note = Hypo
  source 1..208: mol_type = genomic DNA

SEQ ID NO: 105673 - DNA, 30 bp, Homo sapiens; identical to SEQ ID NO: 71940
  misc_feature 1..30: note = chr11:1082664-1082694
  misc_feature 1..30: note = Hypo
  source 1..30: mol_type = genomic DNA

SEQ ID NO: 105674 - DNA, 68 bp, Homo sapiens; identical to SEQ ID NO: 71942
  misc_feature 1..68: note = chr11:1083440-1083508
  misc_feature 1..68: note = Hypo
  source 1..68: mol_type = genomic DNA

SEQ ID NO: 105675 - DNA, 30 bp, Homo sapiens; identical to SEQ ID NO: 42882
  misc_feature 1..30: note = chr11:1085664-1085694
  misc_feature 1..30: note = Hypo
  source 1..30: mol_type = genomic DNA

SEQ ID NO: 105676 - DNA, 44 bp, Homo sapiens; identical to SEQ ID NO: 71952
  misc_feature 1..44: note = chr11:1094014-1094058
  misc_feature 1..44: note = Hypo
  source 1..44: mol_type = genomic DNA

SEQ ID NO: 105677 - DNA, 219 bp, Homo sapiens; identical to SEQ ID NO: 71953
  misc_feature 1..219: note = chr11:1094942-1095161
  misc_feature 1..219: note = Hypo
  source 1..219: mol_type = genomic DNA

SEQ ID NO: 105678 - DNA, 118 bp, Homo sapiens; identical to SEQ ID NO: 71955
  misc_feature 1..118: note = chr11:1095551-1095669
  misc_feature 1..118: note = Hypo
  source 1..118: mol_type = genomic DNA

SEQ ID NO: 105679 - DNA, 240 bp, Homo sapiens; identical to SEQ ID NO: 71960
  misc_feature 1..240: note = chr11:1103974-1104214
  misc_feature 1..240: note = Hypo
  source 1..240: mol_type = genomic DNA

SEQ ID NO: 105680 - DNA, 133 bp, Homo sapiens; identical to SEQ ID NO: 71976
  misc_feature 1..133: note = chr11:1115098-1115231
  misc_feature 1..133: note = Hypo
  source 1..133: mol_type = genomic DNA

SEQ ID NO: 105681 - DNA, 30 bp, Homo sapiens; identical to SEQ ID NO: 71977
  misc_feature 1..30: note = chr11:1120833-1120863
  misc_feature 1..30: note = Hypo
  source 1..30: mol_type = genomic DNA

SEQ ID NO: 105682 - DNA, 112 bp, Homo sapiens; identical to SEQ ID NO: 71994
  misc_feature 1..112: note = chr11:1140450-1140562
  misc_feature 1..112: note = Hypo
  source 1..112: mol_type = genomic DNA

SEQ ID NO: 105683 - DNA, 173 bp, Homo sapiens; identical to SEQ ID NO: 71999
  misc_feature 1..173: note = chr11:1142462-1142635
  misc_feature 1..173: note = Hypo
  source 1..173: mol_type = genomic DNA

SEQ ID NO: 105684 - DNA, 81 bp, Homo sapiens; identical to SEQ ID NO: 72004
  misc_feature 1..81: note = chr11:1148113-1148194
  misc_feature 1..81: note = Hypo
  source 1..81: mol_type = genomic DNA

SEQ ID NO: 105685 - DNA, 54 bp, Homo sapiens; identical to SEQ ID NO: 42890
  misc_feature 1..54: note = chr11:1151771-1151825
  misc_feature 1..54: note = Hypo
  source 1..54: mol_type = genomic DNA

SEQ ID NO: 105686 - DNA, 249 bp, Homo sapiens; identical to SEQ ID NO: 72006
  misc_feature 1..249: note = chr11:1152416-1152665
  misc_feature 1..249: note = Hypo
  source 1..249: mol_type = genomic DNA

SEQ ID NO: 105687 - DNA, 175 bp, Homo sapiens; identical to SEQ ID NO: 72010
  misc_feature 1..175: note = chr11:1155055-1155230
  misc_feature 1..175: note = Hypo
  source 1..175: mol_type = genomic DNA

SEQ ID NO: 105688 - DNA, 203 bp, Homo sapiens; identical to SEQ ID NO: 72013
  misc_feature 1..203: note = chr11:1155596-1155799
  misc_feature 1..203: note = Hypo
  source 1..203: mol_type = genomic DNA

SEQ ID NO: 105689 - DNA, 30 bp, Homo sapiens; identical to SEQ ID NO: 72022
  misc_feature 1..30: note = chr11:1157863-1157893
  misc_feature 1..30: note = Hypo
  source 1..30: mol_type = genomic DNA

SEQ ID NO: 105690 - DNA, 319 bp, Homo sapiens; identical to SEQ ID NO: 72102
  misc_feature 1..319: note = chr11:1214648-1214967
  misc_feature 1..319: note = Hypo
  source 1..319: mol_type = genomic DNA

SEQ ID NO: 105691 - DNA, 34 bp, Homo sapiens; identical to SEQ ID NO: 72103
  misc_feature 1..34: note = chr11:1215395-1215429
  misc_feature 1..34: note = Hypo
  source 1..34: mol_type = genomic DNA

SEQ ID NO: 105692 - DNA, 329 bp, Homo sapiens; identical to SEQ ID NO: 72105
  misc_feature 1..329: note = chr11:1215733-1216062
  misc_feature 1..329: note = Hypo
  source 1..329: mol_type = genomic DNA

SEQ ID NO: 105693 - DNA, 120 bp, Homo sapiens; identical to SEQ ID NO: 72107
  misc_feature 1..120: note = chr11:1216277-1216397
  misc_feature 1..120: note = Hypo
  source 1..120: mol_type = genomic DNA

SEQ ID NO: 105694 - DNA, 50 bp, Homo sapiens; identical to SEQ ID NO: 72108
  misc_feature 1..50: note = chr11:1216937-1216987
  misc_feature 1..50: note = Hypo
  source 1..50: mol_type = genomic DNA

SEQ ID NO: 105695 - DNA, 35 bp, Homo sapiens; identical to SEQ ID NO: 72109
  misc_feature 1..35: note = chr11:1217246-1217281
  misc_feature 1..35: note = Hypo
  source 1..35: mol_type = genomic DNA

SEQ ID NO: 105696 - DNA, 30 bp, Homo sapiens; identical to SEQ ID NO: 72110
  misc_feature 1..30: note = chr11:1217534-1217564
  misc_feature 1..30: note = Hypo
  source 1..30: mol_type = genomic DNA

SEQ ID NO: 105697 - DNA, 161 bp, Homo sapiens; identical to SEQ ID NO: 72112
  misc_feature 1..161: note = chr11:1219739-1219900
  misc_feature 1..161: note = Hypo
  source 1..161: mol_type = genomic DNA

SEQ ID NO: 105698 - DNA, 173 bp, Homo sapiens; identical to SEQ ID NO: 72113
  misc_feature 1..173: note = chr11:1221703-1221876
  misc_feature 1..173: note = Hypo
  source 1..173: mol_type = genomic DNA

SEQ ID NO: 105699 - DNA, 53 bp, Homo sapiens; identical to SEQ ID NO: 72132
  misc_feature 1..53: note = chr11:1228830-1228883
  misc_feature 1..53: note = Hypo
  source 1..53: mol_type = genomic DNA

SEQ ID NO: 105700 - DNA, 36 bp, Homo sapiens; identical to SEQ ID NO: 72134
  misc_feature 1..36: note = chr11:1229945-1229981
  misc_feature 1..36: note = Hypo
  source 1..36: mol_type = genomic DNA

SEQ ID NO: 105701 - DNA, 30 bp, Homo sapiens; identical to SEQ ID NO: 42898
  misc_feature 1..30: note = chr11:1241768-1241798
  misc_feature 1..30: note = Hypo
  source 1..30: mol_type = genomic DNA

SEQ ID NO: 105702 - DNA, 30 bp, Homo sapiens; identical to SEQ ID NO: 72156
  misc_feature 1..30: note = chr11:1243139-1243169
  misc_feature 1..30: note = Hypo
  source 1..30: mol_type = genomic DNA

SEQ ID NO: 105703 - DNA, 199 bp, Homo sapiens; identical to SEQ ID NO: 72157
  misc_feature 1..199: note = chr11:1244348-1244547
  misc_feature 1..199: note = Hypo
  source 1..199: mol_type = genomic DNA

SEQ ID NO: 105704 - DNA, 337 bp, Homo sapiens; identical to SEQ ID NO: 72175
  misc_feature 1..337: note = chr11:1247782-1248119
  misc_feature 1..337: note = Hypo
  source 1..337: mol_type = genomic DNA

SEQ ID NO: 105705 - DNA, 30 bp, Homo sapiens; identical to SEQ ID NO: 72178
  misc_feature 1..30: note = chr11:1249828-1249858
  misc_feature 1..30: note = Hypo
  source 1..30: mol_type = genomic DNA

SEQ ID NO: 105706 - DNA, 571 bp, Homo sapiens; identical to SEQ ID NO: 72182
  misc_feature 1..571: note = chr11:1250780-1251351
  misc_feature 1..571: note = Hypo
  source 1..571: mol_type = genomic DNA

SEQ ID NO: 105707 - DNA, 33 bp, Homo sapiens; identical to SEQ ID NO: 72184
  misc_feature 1..33: note = chr11:1251802-1251835
  misc_feature 1..33: note = Hypo
  source 1..33: mol_type = genomic DNA

SEQ ID NO: 105708 - DNA, 255 bp, Homo sapiens; identical to SEQ ID NO: 72189
  misc_feature 1..255: note = chr11:1252832-1253087
  misc_feature 1..255: note = Hypo
  source 1..255: mol_type = genomic DNA

SEQ ID NO: 105709 - DNA, 30 bp, Homo sapiens; identical to SEQ ID NO: 72192
  misc_feature 1..30: note = chr11:1253832-1253862
  misc_feature 1..30: note = Hypo
  source 1..30: mol_type = genomic DNA

SEQ ID NO: 105710 - DNA, 84 bp, Homo sapiens; identical to SEQ ID NO: 72193
  misc_feature 1..84: note = chr11:1254339-1254423
  misc_feature 1..84: note = Hypo
  source 1..84: mol_type = genomic DNA

SEQ ID NO: 105711 - DNA, 321 bp, Homo sapiens; identical to SEQ ID NO: 42904
  misc_feature 1..321: note = chr11:1254973-1255294
  misc_feature 1..321: note = Hypo
  source 1..321: mol_type = genomic DNA

SEQ ID NO: 105712 - DNA, 164 bp, Homo sapiens; identical to SEQ ID NO: 72195
  misc_feature 1..164: note = chr11:1256353-1256517
  misc_feature 1..164: note = Hypo
  source 1..164: mol_type = genomic DNA

SEQ ID NO: 105713 - DNA, 256 bp, Homo sapiens; identical to SEQ ID NO: 72199
  misc_feature 1..256: note = chr11:1257652-1257908
  misc_feature 1..256: note = Hypo
  source 1..256: mol_type = genomic DNA

SEQ ID NO: 105714 - DNA, 30 bp, Homo sapiens; identical to SEQ ID NO: 72203
  misc_feature 1..30: note = chr11:1260620-1260650
  misc_feature 1..30: note = Hypo
  source 1..30: mol_type = genomic DNA

SEQ ID NO: 105715 - DNA, 584 bp, Homo sapiens; identical to SEQ ID NO: 72211
  misc_feature 1..584: note = chr11:1263180-1263764
  misc_feature 1..584: note = Hypo
  source 1..584: mol_type = genomic DNA

SEQ ID NO: 105716 - DNA, 44 bp, Homo sapiens; identical to SEQ ID NO: 72226
  misc_feature 1..44: note = chr11:1273678-1273722
  misc_feature 1..44: note = Hypo
  source 1..44: mol_type = genomic DNA

SEQ ID NO: 105717 - DNA, 281 bp, Homo sapiens; identical to SEQ ID NO: 72227
  misc_feature 1..281: note = chr11:1274002-1274283
  misc_feature 1..281: note = Hypo
  source 1..281: mol_type = genomic DNA

SEQ ID NO: 105718 - DNA, 152 bp, Homo sapiens; identical to SEQ ID NO: 72229
  misc_feature 1..152: note = chr11:1275246-1275398
  misc_feature 1..152: note = Hypo
  source 1..152: mol_type = genomic DNA

SEQ ID NO: 105719 - DNA, 119 bp, Homo sapiens; identical to SEQ ID NO: 72230
  misc_feature 1..119: note = chr11:1275636-1275755
  misc_feature 1..119: note = Hypo
  source 1..119: mol_type = genomic DNA

SEQ ID NO: 105720 - DNA, 509 bp, Homo sapiens; identical to SEQ ID NO: 72231
  misc_feature 1..509: note = chr11:1276280-1276789
  misc_feature 1..509: note = Hypo
  source 1..509: mol_type = genomic DNA

SEQ ID NO: 105721 - DNA, 232 bp, Homo sapiens; identical to SEQ ID NO: 72232
  misc_feature 1..232: note = chr11:1278648-1278880
  misc_feature 1..232: note = Hypo
  source 1..232: mol_type = genomic DNA

SEQ ID NO: 105722 - DNA, 30 bp, Homo sapiens; identical to SEQ ID NO: 72233
  misc_feature 1..30: note = chr11:1279716-1279746
  misc_feature 1..30: note = Hypo
  source 1..30: mol_type = genomic DNA

SEQ ID NO: 105723 - DNA, 30 bp, Homo sapiens; identical to SEQ ID NO: 72355
  misc_feature 1..30: note = chr11:1357330-1357360
  misc_feature 1..30: note = Hyper
  source 1..30: mol_type = genomic DNA

SEQ ID NO: 105724 - DNA, 38 bp, Homo sapiens
  misc_feature 1..38: note = chr11:1358384-1358422
  misc_feature 1..38: note = Hyper
  source 1..38: mol_type = genomic DNA
gtccggcccccgcctcgcgctcccgcttctccaggaag

SEQ ID NO: 105725 - DNA, 37 bp, Homo sapiens; identical to SEQ ID NO: 72357
  misc_feature 1..37: note = chr11:1359722-1359759
  misc_feature 1..37: note = Hypo
  source 1..37: mol_type = genomic DNA

SEQ ID NO: 105726 - DNA, 81 bp, Homo sapiens; identical to SEQ ID NO: 72358
  misc_feature 1..81: note = chr11:1368283-1368364
  misc_feature 1..81: note = Hypo
  source 1..81: mol_type = genomic DNA

SEQ ID NO: 105727 - DNA, 30 bp, Homo sapiens; identical to SEQ ID NO: 72360
  misc_feature 1..30: note = chr11:1371601-1371631
  misc_feature 1..30: note = Hypo
  source 1..30: mol_type = genomic DNA

SEQ ID NO: 105728 - DNA, 155 bp, Homo sapiens; identical to SEQ ID NO: 72361
  misc_feature 1..155: note = chr11:1374898-1375053
  misc_feature 1..155: note = Hypo
  source 1..155: mol_type = genomic DNA

SEQ ID NO: 105729 - DNA, 30 bp, Homo sapiens; identical to SEQ ID NO: 72362
  misc_feature 1..30: note = chr11:1375352-1375382
  misc_feature 1..30: note = Hypo
  source 1..30: mol_type = genomic DNA

SEQ ID NO: 105730 - DNA, 183 bp, Homo sapiens; identical to SEQ ID NO: 42915
  misc_feature 1..183: note = chr11:1382225-1382408
  misc_feature 1..183: note = Hypo
  source 1..183: mol_type = genomic DNA

SEQ ID NO: 105731 - DNA, 30 bp, Homo sapiens; identical to SEQ ID NO: 72364
  misc_feature 1..30: note = chr11:1392807-1392837
  misc_feature 1..30: note = Hypo
  source 1..30: mol_type = genomic DNA

SEQ ID NO: 105732 - DNA, 120 bp, Homo sapiens; identical to SEQ ID NO: 42916
  misc_feature 1..120: note = chr11:1393300-1393420
  misc_feature 1..120: note = Hypo
  source 1..120: mol_type = genomic DNA

SEQ ID NO: 105733 - DNA, 250 bp, Homo sapiens; identical to SEQ ID NO: 33583
  misc_feature 1..250: note = chr11:1410104-1410354
  misc_feature 1..250: note = Hyper
  source 1..250: mol_type = genomic DNA

SEQ ID NO: 105734 - DNA, 917 bp, Homo sapiens
  misc_feature 1..917: note = chr11:1411442-1412359
  misc_feature 1..917: note = Hyper
  source 1..917: mol_type = genomic DNA
cgggcggacgctgggcggcccctccctgcccgcgcgcccgggcgcccctggccggcgccgggccccagagcgatgacatcgacggggaaggacggcggcgcgcagcacgcgcagtatgttgggccctaccggctggagaagacgctgggcaaggggcagacaggtgcgtgcggccggggcggggaccggggccggggaggccgcgctggcagcgcgctgggtggggggcgcccgagggaggccccggccgcgaagccgcaggcccggcccgggccccggccgcgaacaatgggcggcccgtgcgcccccgtccgctcgtgcgccccggttccgccgcggatcccgcaggccgcttggctgcggtcggccgggcgcggcccaaggacacgcggcgcggcgcggggcgcgcaggcggacaggggcgcacgggacggcgcccctcgggccccgctgcaggtgcgcggcccgggccgcattgtgcgccccagcgaccgggcccattgtgccgcgggaggagggggccgcgcgggcgcccatctgccgtctgccgcggccgcgctaataggcgtgctgcccgagcagctgcgcccccggcgggactcccacctccgcgcgccggccaccggggcctccgggcaggcccgatctccctccgcggtgggggcgggagagtgcggggacctgcagagggctggacagcgccttgcgctgctccggctcgggctcgggcgggcggagcgtctgtgacctgcattcccacggggcagggagaggccattggtgctgggaccagaagtgcgtgggacctgacccgtggagcagccccgcggcctgccggtggagggggcttcccggtggggcctggctgtcattctagggaacaggccgggtccctgcggggccgaacccaggccaga

SEQ ID NO: 105735 - DNA, 30 bp, Homo sapiens; identical to SEQ ID NO: 42917
  misc_feature 1..30: note = chr11:1420766-1420796
  misc_feature 1..30: note = Hypo
  source 1..30: mol_type = genomic DNA

SEQ ID NO: 105736 - DNA, 78 bp, Homo sapiens; identical to SEQ ID NO: 72371
  misc_feature 1..78: note = chr11:1422084-1422162
  misc_feature 1..78: note = Hypo
  source 1..78: mol_type = genomic DNA

SEQ ID NO: 105737 - DNA, 512 bp, Homo sapiens; identical to SEQ ID NO: 72372
  misc_feature 1..512: note = chr11:1430689-1431201
  misc_feature 1..512: note = Hypo
  source 1..512: mol_type = genomic DNA

SEQ ID NO: 105738 - DNA, 110 bp, Homo sapiens
  misc_feature 1..110: note = chr11:1431728-1431838
  misc_feature 1..110: note = Hypo
  source 1..110: mol_type = genomic DNA
tgggcccgcagacttcggtgcttcaaaggcctcactgctgagcacgagacgccgcttttgatgtcgtcaggctctctggtccccgggagtggactcgggggctccgagtg

SEQ ID NO: 105739 - DNA, 288 bp, Homo sapiens; identical to SEQ ID NO: 72373
  misc_feature 1..288: note = chr11:1432883-1433171
  misc_feature 1..288: note = Hypo
  source 1..288: mol_type = genomic DNA

SEQ ID NO: 105740 - DNA, 193 bp, Homo sapiens; identical to SEQ ID NO: 72374
  misc_feature 1..193: note = chr11:1433665-1433858
  misc_feature 1..193: note = Hypo
  source 1..193: mol_type = genomic DNA

SEQ ID NO: 105741 - DNA, 41 bp, Homo sapiens; identical to SEQ ID NO: 72375
  misc_feature 1..41: note = chr11:1434266-1434307
  misc_feature 1..41: note = Hypo
  source 1..41: mol_type = genomic DNA

SEQ ID NO: 105742 - DNA, 160 bp, Homo sapiens; identical to SEQ ID NO: 72376
  misc_feature 1..160: note = chr11:1442699-1442859
  misc_feature 1..160: note = Hypo
  source 1..160: mol_type = genomic DNA

SEQ ID NO: 105743 - DNA, 373 bp, Homo sapiens; identical to SEQ ID NO: 42923
  misc_feature 1..373: note = chr11:1444579-1444952
  misc_feature 1..373: note = Hypo
  source 1..373: mol_type = genomic DNA

SEQ ID NO: 105744 - DNA, 70 bp, Homo sapiens; identical to SEQ ID NO: 72378
  misc_feature 1..70: note = chr11:1446330-1446400
  misc_feature 1..70: note = Hypo
  source 1..70: mol_type = genomic DNA

SEQ ID NO: 105745 - DNA, 135 bp, Homo sapiens; identical to SEQ ID NO: 72379
  misc_feature 1..135: note = chr11:1447374-1447509
  misc_feature 1..135: note = Hypo
  source 1..135: mol_type = genomic DNA

SEQ ID NO: 105746 - DNA, 24 bp, Homo sapiens
  misc_feature 1..24: note = chr11:1450725-1450749
  misc_feature 1..24: note = Hypo
  source 1..24: mol_type = genomic DNA
gccctgctgctctgtcgccagcat

SEQ ID NO: 105747 - DNA, 87 bp, Homo sapiens; identical to SEQ ID NO: 72383
  misc_feature 1..87: note = chr11:1455198-1455285
  misc_feature 1..87: note = Hypo
  source 1..87: mol_type = genomic DNA

SEQ ID NO: 105748 - DNA, 75 bp, Homo sapiens; identical to SEQ ID NO: 72384
  misc_feature 1..75: note = chr11:1455520-1455595
  misc_feature 1..75: note = Hypo
  source 1..75: mol_type = genomic DNA

SEQ ID NO: 105749 - DNA, 124 bp, Homo sapiens; identical to SEQ ID NO: 72386
  misc_feature 1..124: note = chr11:1456146-1456270
  misc_feature 1..124: note = Hypo
  source 1..124: mol_type = genomic DNA

SEQ ID NO: 105750 - DNA, 54 bp, Homo sapiens; identical to SEQ ID NO: 72388
  misc_feature 1..54: note = chr11:1459467-1459521
  misc_feature 1..54: note = Hypo
  source 1..54: mol_type = genomic DNA

SEQ ID NO: 105751 - DNA, 65 bp, Homo sapiens; identical to SEQ ID NO: 42929
  misc_feature 1..65: note = chr11:1461955-1462020
  misc_feature 1..65: note = Hypo
  source 1..65: mol_type = genomic DNA

SEQ ID NO: 105752 - DNA, 35 bp, Homo sapiens; identical to SEQ ID NO: 72390
  misc_feature 1..35: note = chr11:1463756-1463791
  misc_feature 1..35: note = Hypo
  source 1..35: mol_type = genomic DNA

SEQ ID NO: 105753 - DNA, 794 bp, Homo sapiens; identical to SEQ ID NO: 72391
  misc_feature 1..794: note = chr11:1464177-1464971
  misc_feature 1..794: note = Hypo
  source 1..794: mol_type = genomic DNA

SEQ ID NO: 105754 - DNA, 508 bp, Homo sapiens; identical to SEQ ID NO: 72396
  misc_feature 1..508: note = chr11:1466703-1467211
  misc_feature 1..508: note = Hypo
  source 1..508: mol_type = genomic DNA

SEQ ID NO: 105755 - DNA, 510 bp, Homo sapiens; identical to SEQ ID NO: 42933
  misc_feature 1..510: note = chr11:1469123-1469633
  misc_feature 1..510: note = Hypo
  source 1..510: mol_type = genomic DNA

SEQ ID NO: 105756 - DNA, 136 bp, Homo sapiens; identical to SEQ ID NO: 72398
  misc_feature 1..136: note = chr11:1471324-1471460
  misc_feature 1..136: note = Hypo
  source 1..136: mol_type = genomic DNA

SEQ ID NO: 105757 - DNA, 193 bp, Homo sapiens; identical to SEQ ID NO: 42935
  misc_feature 1..193: note = chr11:1471865-1472058
  misc_feature 1..193: note = Hypo
  source 1..193: mol_type = genomic DNA

SEQ ID NO: 105758 - DNA, 150 bp, Homo sapiens; identical to SEQ ID NO: 72400
  misc_feature 1..150: note = chr11:1473510-1473660
  misc_feature 1..150: note = Hypo
  source 1..150: mol_type = genomic DNA

SEQ ID NO: 105759 - DNA, 108 bp, Homo sapiens; identical to SEQ ID NO: 72401
  misc_feature 1..108: note = chr11:1475964-1476072
  misc_feature 1..108: note = Hypo
  source 1..108: mol_type = genomic DNA

SEQ ID NO: 105760 - DNA, 595 bp, Homo sapiens; identical to SEQ ID NO: 72402
  misc_feature 1..595: note = chr11:1477752-1478347
  misc_feature 1..595: note = Hypo
  source 1..595: mol_type = genomic DNA

SEQ ID NO: 105761 - DNA, 47 bp, Homo sapiens; identical to SEQ ID NO: 72403
  misc_feature 1..47: note = chr11:1482019-1482066
  misc_feature 1..47: note = Hypo
  source 1..47: mol_type = genomic DNA

SEQ ID NO: 105762 - DNA, 432 bp, Homo sapiens; identical to SEQ ID NO: 72404
  misc_feature 1..432: note = chr11:1483506-1483938
  misc_feature 1..432: note = Hypo
  source 1..432: mol_type = genomic DNA

SEQ ID NO: 105763 - DNA, 30 bp, Homo sapiens; identical to SEQ ID NO: 42940
  misc_feature 1..30: note = chr11:1517598-1517628
  misc_feature 1..30: note = Hypo
  source 1..30: mol_type = genomic DNA

SEQ ID NO: 105764 - DNA, 36 bp, Homo sapiens; identical to SEQ ID NO: 72409
  misc_feature 1..36: note = chr11:1536547-1536583
  misc_feature 1..36: note = Hypo
  source 1..36: mol_type = genomic DNA

SEQ ID NO: 105765 - DNA, 154 bp, Homo sapiens; identical to SEQ ID NO: 72410
  misc_feature 1..154: note = chr11:1553679-1553833
  misc_feature 1..154: note = Hypo
  source 1..154: mol_type = genomic DNA

SEQ ID NO: 105766 - DNA, 35 bp, Homo sapiens; identical to SEQ ID NO: 42942
  misc_feature 1..35: note = chr11:1560806-1560841
  misc_feature 1..35: note = Hypo
  source 1..35: mol_type = genomic DNA

SEQ ID NO: 105767 - DNA, 148 bp, Homo sapiens; identical to SEQ ID NO: 72412
  misc_feature 1..148: note = chr11:1585143-1585291
  misc_feature 1..148: note = Hypo
  source 1..148: mol_type = genomic DNA

SEQ ID NO: 105768 - DNA, 222 bp, Homo sapiens; identical to SEQ ID NO: 72424
  misc_feature 1..222: note = chr11:1669519-1669741
  misc_feature 1..222: note = Hypo
  source 1..222: mol_type = genomic DNA

SEQ ID NO: 105769 - DNA, 30 bp, Homo sapiens; identical to SEQ ID NO: 72432
  misc_feature 1..30: note = chr11:1742866-1742896
  misc_feature 1..30: note = Hypo
  source 1..30: mol_type = genomic DNA

SEQ ID NO: 105770 - DNA, 84 bp, Homo sapiens; identical to SEQ ID NO: 42944
  misc_feature 1..84: note = chr11:1760346-1760430
  misc_feature 1..84: note = Hypo
  source 1..84: mol_type = genomic DNA

SEQ ID NO: 105771 - DNA, 851 bp, Homo sapiens
  misc_feature 1..851: note = chr11:1769868-1770719
  misc_feature 1..851: note = Hyper
  source 1..851: mol_type = genomic DNA
gcgcacccgcgggcgcgctcagagccattgacgagtaaacaactccccacacaaggcgatgcaggctcagccacgagcaccaagaaccggcacaggtgcggggtctccaactcgtgcgcaccgccccccacctccaacctggggaccccaagcgcgcacacttgcccggagccacgcacccccgggccatacatagacgcacaataacaggctgtgaaatgaacacttctccaacgaggcaccaagtcgctcgcgctctgcgccaccccgcgttcccagctcccgtgcggcgctcgccggggggtctgcggccgaggctctgcagcccccagccccatccgggtctgccgcagccccccggacggcgcctcctcacctacaagcgactcctcggcgcgcggccggaccccctgagcctcggtgcgcgcgtccttccgccgtcccgcgggccgctgtctgtccactgatccgcctcccagcggcccaaccttgagggggtggggagcgcgcggggctcggcggcggcgccgctgcctcccccgccgcctgcgctccctccgcagcgccagaccggccgcgcggctgcagcccagagcctgactcacggcggcagcgggcacagccacctccccgcctccgcctcctcctgccaggagggtgggggcctcggaagccgcgaccctggggagttgcaaggtcccgcagggatgggacccctacagcccccgaccagggtgtccgcgccacctccatctccccggacccactgcgtcttcctccccaccccacccggccccatccctctcgcggagcccccagccccgtggaagactggacgctcccggaaccct

SEQ ID NO: 105772 - DNA, 30 bp, Homo sapiens; identical to SEQ ID NO: 72458
  misc_feature 1..30: note = chr11:1788149-1788179
  misc_feature 1..30: note = Hypo
  source 1..30: mol_type = genomic DNA

SEQ ID NO: 105773 - DNA, 59 bp, Homo sapiens; identical to SEQ ID NO: 72459
  misc_feature 1..59: note = chr11:1788433-1788492
  misc_feature 1..59: note = Hypo
  source 1..59: mol_type = genomic DNA

SEQ ID NO: 105774 - DNA, 62 bp, Homo sapiens; identical to SEQ ID NO: 72460
  misc_feature 1..62: note = chr11:1790206-1790268
  misc_feature 1..62: note = Hypo
  source 1..62: mol_type = genomic DNA

SEQ ID NO: 105775 - DNA, 91 bp, Homo sapiens; identical to SEQ ID NO: 42946
  misc_feature 1..91: note = chr11:1795195-1795286
  misc_feature 1..91: note = Hypo
  source 1..91: mol_type = genomic DNA

SEQ ID NO: 105776 - DNA, 30 bp, Homo sapiens; identical to SEQ ID NO: 42947
  misc_feature 1..30: note = chr11:1801108-1801138
  misc_feature 1..30: note = Hypo
  source 1..30: mol_type = genomic DNA

SEQ ID NO: 105777 - DNA, 141 bp, Homo sapiens; identical to SEQ ID NO: 72465
  misc_feature 1..141: note = chr11:1824116-1824257
  misc_feature 1..141: note = Hypo
  source 1..141: mol_type = genomic DNA

SEQ ID NO: 105778 - DNA, 102 bp, Homo sapiens; identical to SEQ ID NO: 72466
  misc_feature 1..102: note = chr11:1825171-1825273
  misc_feature 1..102: note = Hypo
  source 1..102: mol_type = genomic DNA

SEQ ID NO: 105779 - DNA, 30 bp, Homo sapiens; identical to SEQ ID NO: 72467
  misc_feature 1..30: note = chr11:1826914-1826944
  misc_feature 1..30: note = Hypo
  source 1..30: mol_type = genomic DNA

SEQ ID NO: 105780 - DNA, 36 bp, Homo sapiens; identical to SEQ ID NO: 72468
  misc_feature 1..36: note = chr11:1829914-1829950
  misc_feature 1..36: note = Hypo
  source 1..36: mol_type = genomic DNA

SEQ ID NO: 105781 - DNA, 62 bp, Homo sapiens; identical to SEQ ID NO: 72469
  misc_feature 1..62: note = chr11:1847259-1847321
  misc_feature 1..62: note = Hypo
  source 1..62: mol_type = genomic DNA

SEQ ID NO: 105782 - DNA, 57 bp, Homo sapiens; identical to SEQ ID NO: 42949
  misc_feature 1..57: note = chr11:1856532-1856589
  misc_feature 1..57: note = Hypo
  source 1..57: mol_type = genomic DNA

SEQ ID NO: 105783 - DNA, 335 bp, Homo sapiens; identical to SEQ ID NO: 72472
  misc_feature 1..335: note = chr11:1857210-1857545
  misc_feature 1..335: note = Hypo
  source 1..335: mol_type = genomic DNA

SEQ ID NO: 105784 - DNA, 60 bp, Homo sapiens; identical to SEQ ID NO: 72473
  misc_feature 1..60: note = chr11:1857873-1857933
  misc_feature 1..60: note = Hypo
  source 1..60: mol_type = genomic DNA

SEQ ID NO: 105785 - DNA, 63 bp, Homo sapiens; identical to SEQ ID NO: 72474
  misc_feature 1..63: note = chr11:1858589-1858652
  misc_feature 1..63: note = Hypo
  source 1..63: mol_type = genomic DNA

SEQ ID NO: 105786 - DNA, 30 bp, Homo sapiens; identical to SEQ ID NO: 72475
  misc_feature 1..30: note = chr11:1862756-1862786
  misc_feature 1..30: note = Hypo
  source 1..30: mol_type = genomic DNA

SEQ ID NO: 105787 - DNA, 30 bp, Homo sapiens; identical to SEQ ID NO: 42952
  misc_feature 1..30: note = chr11:1863098-1863128
  misc_feature 1..30: note = Hypo
  source 1..30: mol_type = genomic DNA

SEQ ID NO: 105788 - DNA, 30 bp, Homo sapiens; identical to SEQ ID NO: 72477
  misc_feature 1..30: note = chr11:1864366-1864396
  misc_feature 1..30: note = Hypo
  source 1..30: mol_type = genomic DNA

SEQ ID NO: 105789 - DNA, 30 bp, Homo sapiens; identical to SEQ ID NO: 72478
  misc_feature 1..30: note = chr11:1864932-1864962
  misc_feature 1..30: note = Hypo
  source 1..30: mol_type = genomic DNA

SEQ ID NO: 105790 - DNA, 123 bp, Homo sapiens; identical to SEQ ID NO: 72480
  misc_feature 1..123: note = chr11:1867693-1867816
  misc_feature 1..123: note = Hypo
  source 1..123: mol_type = genomic DNA

SEQ ID NO: 105791 - DNA, 271 bp, Homo sapiens; identical to SEQ ID NO: 72481
  misc_feature 1..271: note = chr11:1868053-1868324
  misc_feature 1..271: note = Hypo
  source 1..271: mol_type = genomic DNA

SEQ ID NO: 105792 - DNA, 81 bp, Homo sapiens; identical to SEQ ID NO: 72482
  misc_feature 1..81: note = chr11:1868863-1868944
  misc_feature 1..81: note = Hypo
  source 1..81: mol_type = genomic DNA

SEQ ID NO: 105793 - DNA, 30 bp, Homo sapiens; identical to SEQ ID NO: 72483
  misc_feature 1..30: note = chr11:1869458-1869488
  misc_feature 1..30: note = Hypo
  source 1..30: mol_type = genomic DNA

SEQ ID NO: 105794 - DNA, 30 bp, Homo sapiens; identical to SEQ ID NO: 72486
  misc_feature 1..30: note = chr11:1878638-1878668
  misc_feature 1..30: note = Hypo
  source 1..30: mol_type = genomic DNA

SEQ ID NO: 105795 - DNA, 80 bp, Homo sapiens; identical to SEQ ID NO: 72489
  misc_feature 1..80: note = chr11:1884451-1884531
  misc_feature 1..80: note = Hypo
  source 1..80: mol_type = genomic DNA

SEQ ID NO: 105796 - DNA, 51 bp, Homo sapiens; identical to SEQ ID NO: 72490
  misc_feature 1..51: note = chr11:1889039-1889090
  misc_feature 1..51: note = Hypo
  source 1..51: mol_type = genomic DNA

SEQ ID NO: 105797 - DNA, 30 bp, Homo sapiens; identical to SEQ ID NO: 72491
  misc_feature 1..30: note = chr11:1891550-1891580
  misc_feature 1..30: note = Hypo
  source 1..30: mol_type = genomic DNA

SEQ ID NO: 105798 - DNA, 152 bp, Homo sapiens; identical to SEQ ID NO: 72493
  misc_feature 1..152: note = chr11:1907948-1908100
  misc_feature 1..152: note = Hypo
  source 1..152: mol_type = genomic DNA

SEQ ID NO: 105799 - DNA, 30 bp, Homo sapiens; identical to SEQ ID NO: 72496
  misc_feature 1..30: note = chr11:1934662-1934692
  misc_feature 1..30: note = Hypo
  source 1..30: mol_type = genomic DNA

SEQ ID NO: 105800 - DNA, 78 bp, Homo sapiens; identical to SEQ ID NO: 72497
  misc_feature 1..78: note = chr11:1935022-1935100
  misc_feature 1..78: note = Hypo
  source 1..78: mol_type = genomic DNA

SEQ ID NO: 105801 - DNA, 88 bp, Homo sapiens; identical to SEQ ID NO: 72503
  misc_feature 1..88: note = chr11:1940385-1940473
  misc_feature 1..88: note = Hypo
  source 1..88: mol_type = genomic DNA

SEQ ID NO: 105802 - DNA, 298 bp, Homo sapiens; identical to SEQ ID NO: 72504
  misc_feature 1..298: note = chr11:1945862-1946160
  misc_feature 1..298: note = Hypo
  source 1..298: mol_type = genomic DNA

SEQ ID NO: 105803 - DNA, 34 bp, Homo sapiens; identical to SEQ ID NO: 72505
  misc_feature 1..34: note = chr11:1947562-1947596
  misc_feature 1..34: note = Hypo
  source 1..34: mol_type = genomic DNA

SEQ ID NO: 105804 - DNA, 39 bp, Homo sapiens; identical to SEQ ID NO: 72506
  misc_feature 1..39: note = chr11:1949943-1949982
  misc_feature 1..39: note = Hypo
  source 1..39: mol_type = genomic DNA

SEQ ID NO: 105805 - DNA, 284 bp, Homo sapiens; identical to SEQ ID NO: 72507
  misc_feature 1..284: note = chr11:1950350-1950634
  misc_feature 1..284: note = Hypo
  source 1..284: mol_type = genomic DNA

SEQ ID NO: 105806 - DNA, 240 bp, Homo sapiens; identical to SEQ ID NO: 72508
  misc_feature 1..240: note = chr11:1955151-1955391
  misc_feature 1..240: note = Hypo
  source 1..240: mol_type = genomic DNA

SEQ ID NO: 105807 - DNA, 1139 bp, Homo sapiens; identical to SEQ ID NO: 72510
  misc_feature 1..1139: note = chr11:1957221-1958360
  misc_feature 1..1139: note = Hypo
  source 1..1139: mol_type = genomic DNA

SEQ ID NO: 105808 - DNA, 605 bp, Homo sapiens; identical to SEQ ID NO: 72511
  misc_feature 1..605: note = chr11:1958714-1959319
  misc_feature 1..605: note = Hypo
  source 1..605: mol_type = genomic DNA

SEQ ID NO: 105809 - DNA, 123 bp, Homo sapiens; identical to SEQ ID NO: 72512
  misc_feature 1..123: note = chr11:1959951-1960074
  misc_feature 1..123: note = Hypo
  source 1..123: mol_type = genomic DNA

SEQ ID NO: 105810 - DNA, 30 bp, Homo sapiens; identical to SEQ ID NO: 72513
  misc_feature 1..30: note = chr11:1963030-1963060
  misc_feature 1..30: note = Hypo
  source 1..30: mol_type = genomic DNA

SEQ ID NO: 105811 - DNA, 105 bp, Homo sapiens; identical to SEQ ID NO: 72518
  misc_feature 1..105: note = chr11:1975964-1976069
  misc_feature 1..105: note = Hypo
  source 1..105: mol_type = genomic DNA

SEQ ID NO: 105812 - DNA, 30 bp, Homo sapiens; identical to SEQ ID NO: 72519
  misc_feature 1..30: note = chr11:1977320-1977350
  misc_feature 1..30: note = Hypo
  source 1..30: mol_type = genomic DNA

SEQ ID NO: 105813 - DNA, 35 bp, Homo sapiens; identical to SEQ ID NO: 72520
  misc_feature 1..35: note = chr11:1980528-1980563
  misc_feature 1..35: note = Hypo
  source 1..35: mol_type = genomic DNA

SEQ ID NO: 105814 - DNA, 335 bp, Homo sapiens; identical to SEQ ID NO: 42963
  misc_feature 1..335: note = chr11:1981002-1981337
  misc_feature 1..335: note = Hypo
  source 1..335: mol_type = genomic DNA

SEQ ID NO: 105815 - DNA, 30 bp, Homo sapiens; identical to SEQ ID NO: 72522
  misc_feature 1..30: note = chr11:1981581-1981611
  misc_feature 1..30: note = Hypo
  source 1..30: mol_type = genomic DNA

SEQ ID NO: 105816 - DNA, 30 bp, Homo sapiens; identical to SEQ ID NO: 72523
  misc_feature 1..30: note = chr11:1983138-1983168
  misc_feature 1..30: note = Hypo
  source 1..30: mol_type = genomic DNA

SEQ ID NO: 105817 - DNA, 61 bp, Homo sapiens; identical to SEQ ID NO: 72524
  misc_feature 1..61: note = chr11:1983778-1983839
  misc_feature 1..61: note = Hypo
  source 1..61: mol_type = genomic DNA

SEQ ID NO: 105818 - DNA, 30 bp, Homo sapiens; identical to SEQ ID NO: 72525
  misc_feature 1..30: note = chr11:1984105-1984135
  misc_feature 1..30: note = Hypo
  source 1..30: mol_type = genomic DNA

SEQ ID NO: 105819 - DNA, 76 bp, Homo sapiens; identical to SEQ ID NO: 72526
  misc_feature 1..76: note = chr11:1986000-1986076
  misc_feature 1..76: note = Hypo
  source 1..76: mol_type = genomic DNA

SEQ ID NO: 105820 - DNA, 30 bp, Homo sapiens; identical to SEQ ID NO: 72527
  misc_feature 1..30: note = chr11:1992236-1992266
  misc_feature 1..30: note = Hypo
  source 1..30: mol_type = genomic DNA

SEQ ID NO: 105821 - DNA, 35 bp, Homo sapiens; identical to SEQ ID NO: 72528
  misc_feature 1..35: note = chr11:1993637-1993672
  misc_feature 1..35: note = Hypo
  source 1..35: mol_type = genomic DNA

SEQ ID NO: 105822 - DNA, 116 bp, Homo sapiens; identical to SEQ ID NO: 72529
  misc_feature 1..116: note = chr11:1996568-1996684
  misc_feature 1..116: note = Hypo
  source 1..116: mol_type = genomic DNA

SEQ ID NO: 105823 - DNA, 30 bp, Homo sapiens; identical to SEQ ID NO: 72530
  misc_feature 1..30: note = chr11:2000619-2000649
  misc_feature 1..30: note = Hypo
  source 1..30: mol_type = genomic DNA

SEQ ID NO: 105824 - DNA, 30 bp, Homo sapiens; identical to SEQ ID NO: 72531
  misc_feature 1..30: note = chr11:2011824-2011854
  misc_feature 1..30: note = Hypo
  source 1..30: mol_type = genomic DNA

SEQ ID NO: 105825 - DNA, 205 bp, Homo sapiens; identical to SEQ ID NO: 72547
  misc_feature 1..205: note = chr11:2036933-2037138
  misc_feature 1..205: note = Hypo
  source 1..205: mol_type = genomic DNA

SEQ ID NO: 105826 - DNA, 182 bp, Homo sapiens; identical to SEQ ID NO: 72549
  misc_feature 1..182: note = chr11:2040029-2040211
  misc_feature 1..182: note = Hypo
  source 1..182: mol_type = genomic DNA

SEQ ID NO: 105827 - DNA, 249 bp, Homo sapiens; identical to SEQ ID NO: 72550
  misc_feature 1..249: note = chr11:2042252-2042501
  misc_feature 1..249: note = Hypo
  source 1..249: mol_type = genomic DNA

SEQ ID NO: 105828 - DNA, 83 bp, Homo sapiens; identical to SEQ ID NO: 72552
  misc_feature 1..83: note = chr11:2048975-2049058
  misc_feature 1..83: note = Hypo
  source 1..83: mol_type = genomic DNA

SEQ ID NO: 105829 - DNA, 55 bp, Homo sapiens; identical to SEQ ID NO: 72569
  misc_feature 1..55: note = chr11:2108054-2108109
  misc_feature 1..55: note = Hypo
  source 1..55: mol_type = genomic DNA

SEQ ID NO: 105830 - DNA, 30 bp, Homo sapiens; identical to SEQ ID NO: 72570
  misc_feature 1..30: note = chr11:2109282-2109312
  misc_feature 1..30: note = Hypo
  source 1..30: mol_type = genomic DNA

SEQ ID NO: 105831 - DNA, 132 bp, Homo sapiens; identical to SEQ ID NO: 72571
  misc_feature 1..132: note = chr11:2109525-2109657
  misc_feature 1..132: note = Hypo
  source 1..132: mol_type = genomic DNA

SEQ ID NO: 105832 - DNA, 30 bp, Homo sapiens; identical to SEQ ID NO: 42969
  misc_feature 1..30: note = chr11:2110642-2110672
  misc_feature 1..30: note = Hypo
  source 1..30: mol_type = genomic DNA

SEQ ID NO: 105833 - DNA, 132 bp, Homo sapiens; identical to SEQ ID NO: 72573
  misc_feature 1..132: note = chr11:2122361-2122493
  misc_feature 1..132: note = Hypo
  source 1..132: mol_type = genomic DNA

SEQ ID NO: 105834 - DNA, 153 bp, Homo sapiens; identical to SEQ ID NO: 72574
  misc_feature 1..153: note = chr11:2131777-2131930
  misc_feature 1..153: note = Hypo
  source 1..153: mol_type = genomic DNA

SEQ ID NO: 105835 - DNA, 61 bp, Homo sapiens; identical to SEQ ID NO: 72575
  misc_feature 1..61: note = chr11:2133266-2133327
  misc_feature 1..61: note = Hypo
  source 1..61: mol_type = genomic DNA

SEQ ID NO: 105836 - DNA, 58 bp, Homo sapiens; identical to SEQ ID NO: 72576
  misc_feature 1..58: note = chr11:2150685-2150743
  misc_feature 1..58: note = Hypo
  source 1..58: mol_type = genomic DNA

SEQ ID NO: 105837 - DNA, 170 bp, Homo sapiens; identical to SEQ ID NO: 72577
  misc_feature 1..170: note = chr11:2151064-2151234
  misc_feature 1..170: note = Hypo
  source 1..170: mol_type = genomic DNA

SEQ ID NO: 105838 - DNA, 322 bp, Homo sapiens; identical to SEQ ID NO: 72578
  misc_feature 1..322: note = chr11:2152269-2152591
  misc_feature 1..322: note = Hypo
  source 1..322: mol_type = genomic DNA

SEQ ID NO: 105839 - DNA, 95 bp, Homo sapiens; identical to SEQ ID NO: 72579
  misc_feature 1..95: note = chr11:2156024-2156119
  misc_feature 1..95: note = Hypo
  source 1..95: mol_type = genomic DNA

SEQ ID NO: 105840 - DNA, 82 bp, Homo sapiens; identical to SEQ ID NO: 72580
  misc_feature 1..82: note = chr11:2187516-2187598
  misc_feature 1..82: note = Hyper
  source 1..82: mol_type = genomic DNA

SEQ ID NO: 105841 - DNA, 572 bp, Homo sapiens; identical to SEQ ID NO: 72581
  misc_feature 1..572: note = chr11:2209843-2210415
  misc_feature 1..572: note = Hypo
  source 1..572: mol_type = genomic DNA

SEQ ID NO: 105842 - DNA, 139 bp, Homo sapiens; identical to SEQ ID NO: 72583
  misc_feature 1..139: note = chr11:2224689-2224828
  misc_feature 1..139: note = Hypo
  source 1..139: mol_type = genomic DNA

SEQ ID NO: 105843 - DNA, 30 bp, Homo sapiens; identical to SEQ ID NO: 42976
  misc_feature 1..30: note = chr11:2226048-2226078
  misc_feature 1..30: note = Hypo
  source 1..30: mol_type = genomic DNA

SEQ ID NO: 105844 - DNA, 517 bp, Homo sapiens; identical to SEQ ID NO: 72593
  misc_feature 1..517: note = chr11:2278322-2278839
  misc_feature 1..517: note = Hypo
  source 1..517: mol_type = genomic DNA

SEQ ID NO: 105845 - DNA, 30 bp, Homo sapiens; identical to SEQ ID NO: 72594
  misc_feature 1..30: note = chr11:2287971-2288001
  misc_feature 1..30: note = Hypo
  source 1..30: mol_type = genomic DNA

SEQ ID NO: 105846 - DNA, 96 bp, Homo sapiens; identical to SEQ ID NO: 72595
  misc_feature 1..96: note = chr11:2289204-2289300
  misc_feature 1..96: note = Hypo
  source 1..96: mol_type = genomic DNA

SEQ ID NO: 105847 - DNA, 1841 bp, Homo sapiens
  misc_feature 1..1841: note = chr11:2290937-2292778
  misc_feature 1..1841: note = Hyper
  source 1..1841: mol_type = genomic DNA
ctcctccctgcctcccggctgttacctcataggtcgagggcgctcagtagccccctaaccagctggagaagtcgagtagctcgcgctccgcaggactcagcgcgccttcgcagccgctgtcgtccgacgagtaggcggaacgcggggagccgggctccgagctgcccccgcggcccggggacgaagaagcgcgggagggcgaggcggcgaccggggtggtccctggcggcccgcggggcgcagacggccgcacggcctgcggcctcagccctcccgccagcgcgttgcgcacggcgtcgtgctcggccagcaggcgctgcagcgcgcggatgtactccacggctgagcgcagcgtctccaccttgctcagcttcttgctggcgccgccgtgcggcacgtgctgccgcagcgcctggaagcccaagttcaccagcttcacgcggttgcgctcgcgctcattgcgccgcgctacggccgctgcgccgcctccggtctctgcggtggccggtcgccgccgccggctgcagcgcaacagttccggggacgcgggtctccgccgggcagcgcagccgacagggacggggggcgcagggggcgcggacctgggcagtgtgccgccgtccatcgcgcctgcatccacccgcccgctccaggtcccggcgcgccgcaggaaggtgcaggcagaggaaccggaggcgacggggaaaactgtggcgccccaagggggcttctggcacggcgccgccaggcaactccccagggcacgcgtcctaggtcgtctggagcccggggataggaggcctagtggtggcaggccgtacgcgccagggagcgtgggacgctcgtgtcccgcgcgtgcggccggactctcccaggtctccgcaggcgcggcgcaggcggctggtttttaaatgtatagataaccctcctccgcgccgccgccgtcgcctttctcacgccctccttccttcgcctcgccctcccgccacgcttcgccctccccctcgcgcgatcacattctgtaaggcccaaagcgtgcgcatgtccccctagcccatcccccggacgcagtccacagatccccagtgcgcccaactggcgaaatctgcgagttcccggtgcgccccctgctcccggcaggtgcttagtgcgcccccaaagcaaggtacgcaggtcctgggttgagccttcccgtacccccaccctaaccccgcgcgcagccccgccagtcccaagagccgccagaccttcgcacgcgcagcgcgcgctgtgggagggaaggcgcggccctggcgacaacacggctgttcgggaggcgcgcaagatccccgggggcagcacgcgccgcgcagcccacacccacgccccaccctcctggggccgaggaggcgggggccagggtctcagccaatcgtgggccacccgtttggccaatcgcgcagggcgcggctccacgcccggccccattgaggaagcgcgtacgcgtggcgcgtggctcacggggagcatcgctaacaaagctgggttcctgctgggccccgccctgctcctcgcccccgcgactgggctgggcgcgctgtcccctagcgcagctatgtcccgagcgcgcccccacctgtgcgttaatctactgggaatgggggtggactgcgccttacctggggcggggtggggcttaaggagtggtcgagactgaggcggggtgggaggttcaggttcccggggcgccttccccaacccgccccgctttccccgtccctccacgcgcaccctgcctgtggtttccgtgcgcccccggcctgagggctctgggcggcaccttaacccggagggcctggagg

SEQ ID NO: 105848 - DNA, 30 bp, Homo sapiens; identical to SEQ ID NO: 72603
  misc_feature 1..30: note = chr11:2329497-2329527
  misc_feature 1..30: note = Hypo
  source 1..30: mol_type = genomic DNA

SEQ ID NO: 105849 - DNA, 30 bp, Homo sapiens; identical to SEQ ID NO: 72604
  misc_feature 1..30: note = chr11:2329892-2329922
  misc_feature 1..30: note = Hypo
  source 1..30: mol_type = genomic DNA

SEQ ID NO: 105850 - DNA, 137 bp, Homo sapiens; identical to SEQ ID NO: 72606
  misc_feature 1..137: note = chr11:2398257-2398394
  misc_feature 1..137: note = Hyper
  source 1..137: mol_type = genomic DNA

SEQ ID NO: 105851 - DNA, 30 bp, Homo sapiens; identical to SEQ ID NO: 72607
  misc_feature 1..30: note = chr11:2425909-2425939
  misc_feature 1..30: note = Hypo
  source 1..30: mol_type = genomic DNA

SEQ ID NO: 105852 - DNA, 35 bp, Homo sapiens; identical to SEQ ID NO: 42979
  misc_feature 1..35: note = chr11:2428079-2428114
  misc_feature 1..35: note = Hypo
  source 1..35: mol_type = genomic DNA

SEQ ID NO: 105853 - DNA, 192 bp, Homo sapiens; identical to SEQ ID NO: 72609
  misc_feature 1..192: note = chr11:2435222-2435414
  misc_feature 1..192: note = Hypo
  source 1..192: mol_type = genomic DNA

SEQ ID NO: 105854 - DNA, 42 bp, Homo sapiens; identical to SEQ ID NO: 72610
  misc_feature 1..42: note = chr11:2435972-2436014
  misc_feature 1..42: note = Hypo
  source 1..42: mol_type = genomic DNA

SEQ ID NO: 105855 - DNA, 190 bp, Homo sapiens; identical to SEQ ID NO: 72611
  misc_feature 1..190: note = chr11:2436421-2436611
  misc_feature 1..190: note = Hypo
  source 1..190: mol_type = genomic DNA

SEQ ID NO: 105856 - DNA, 291 bp, Homo sapiens; identical to SEQ ID NO: 72612
  misc_feature 1..291: note = chr11:2437920-2438211
  misc_feature 1..291: note = Hypo
  source 1..291: mol_type = genomic DNA

SEQ ID NO: 105857 - DNA, 119 bp, Homo sapiens; identical to SEQ ID NO: 72613
  misc_feature 1..119: note = chr11:2439088-2439207
  misc_feature 1..119: note = Hypo
  source 1..119: mol_type = genomic DNA

SEQ ID NO: 105858 - DNA, 96 bp, Homo sapiens
  misc_feature 1..96: note = chr11:2465424-2465520
  misc_feature 1..96: note = Hyper
  source 1..96: mol_type = genomic DNA
ggccctggtgggaagcgacccgagcgtattcgccgcccgcagctcgcgcgcctgggcacccgggggcgctcacagtgatcgcggggccagcacacc

SEQ ID NO: 105859 - DNA, 390 bp, Homo sapiens; identical to SEQ ID NO: 72619
  misc_feature 1..390: note = chr11:2466441-2466831
  misc_feature 1..390: note = Hyper
  source 1..390: mol_type = genomic DNA

SEQ ID NO: 105860 - DNA, 140 bp, Homo sapiens; identical to SEQ ID NO: 72620
  misc_feature 1..140: note = chr11:2491342-2491482
  misc_feature 1..140: note = Hypo
  source 1..140: mol_type = genomic DNA

SEQ ID NO: 105861 - DNA, 161 bp, Homo sapiens; identical to SEQ ID NO: 72622
  misc_feature 1..161: note = chr11:2541198-2541359
  misc_feature 1..161: note = Hypo
  source 1..161: mol_type = genomic DNA

SEQ ID NO: 105862 - DNA, 202 bp, Homo sapiens; identical to SEQ ID NO: 72623
  misc_feature 1..202: note = chr11:2543263-2543465
  misc_feature 1..202: note = Hypo
  source 1..202: mol_type = genomic DNA

SEQ ID NO: 105863 - DNA, 30 bp, Homo sapiens; identical to SEQ ID NO: 72624
  misc_feature 1..30: note = chr11:2547325-2547355
  misc_feature 1..30: note = Hypo
  source 1..30: mol_type = genomic DNA

SEQ ID NO: 105864 - DNA, 79 bp, Homo sapiens; identical to SEQ ID NO: 72625
  misc_feature 1..79: note = chr11:2554518-2554597
  misc_feature 1..79: note = Hyper
  source 1..79: mol_type = genomic DNA

SEQ ID NO: 105865 - DNA, 145 bp, Homo sapiens; identical to SEQ ID NO: 72626
  misc_feature 1..145: note = chr11:2569001-2569146
  misc_feature 1..145: note = Hypo
  source 1..145: mol_type = genomic DNA

SEQ ID NO: 105866 - DNA, 313 bp, Homo sapiens; identical to SEQ ID NO: 72627
  misc_feature 1..313: note = chr11:2596433-2596746
  misc_feature 1..313: note = Hypo
  source 1..313: mol_type = genomic DNA

SEQ ID NO: 105867 - DNA, 32 bp, Homo sapiens; identical to SEQ ID NO: 72628
  misc_feature 1..32: note = chr11:2603413-2603445
  misc_feature 1..32: note = Hypo
  source 1..32: mol_type = genomic DNA

SEQ ID NO: 105868 - DNA, 36 bp, Homo sapiens; identical to SEQ ID NO: 72629
  misc_feature 1..36: note = chr11:2612777-2612813
  misc_feature 1..36: note = Hypo
  source 1..36: mol_type = genomic DNA

SEQ ID NO: 105869 - DNA, 32 bp, Homo sapiens; identical to SEQ ID NO: 72632
  misc_feature 1..32: note = chr11:2745363-2745395
  misc_feature 1..32: note = Hypo
  source 1..32: mol_type = genomic DNA

SEQ ID NO: 105870 - DNA, 276 bp, Homo sapiens; identical to SEQ ID NO: 72635
  misc_feature 1..276: note = chr11:2753764-2754040
  misc_feature 1..276: note = Hypo
  source 1..276: mol_type = genomic DNA

SEQ ID NO: 105871 - DNA, 39 bp, Homo sapiens; identical to SEQ ID NO: 72636
  misc_feature 1..39: note = chr11:2758828-2758867
  misc_feature 1..39: note = Hypo
  source 1..39: mol_type = genomic DNA

SEQ ID NO: 105872 - DNA, 30 bp, Homo sapiens; identical to SEQ ID NO: 42988
  misc_feature 1..30: note = chr11:2770653-2770683
  misc_feature 1..30: note = Hypo
  source 1..30: mol_type = genomic DNA

SEQ ID NO: 105873 - DNA, 35 bp, Homo sapiens; identical to SEQ ID NO: 72650
  misc_feature 1..35: note = chr11:2812777-2812812
  misc_feature 1..35: note = Hyper
  source 1..35: mol_type = genomic DNA

SEQ ID NO: 105874 - DNA, 199 bp, Homo sapiens; identical to SEQ ID NO: 72651
  misc_feature 1..199: note = chr11:2818195-2818394
  misc_feature 1..199: note = Hypo
  source 1..199: mol_type = genomic DNA

SEQ ID NO: 105875 - DNA, 30 bp, Homo sapiens; identical to SEQ ID NO: 15520
  misc_feature 1..30: note = chr11:2829204-2829234
  misc_feature 1..30: note = Hypo
  source 1..30: mol_type = genomic DNA

SEQ ID NO: 105876 - DNA, 50 bp, Homo sapiens; identical to SEQ ID NO: 72653
  misc_feature 1..50: note = chr11:2868750-2868800
  misc_feature 1..50: note = Hypo
  source 1..50: mol_type = genomic DNA

SEQ ID NO: 105877 - DNA, 430 bp, Homo sapiens; identical to SEQ ID NO: 72654
  misc_feature 1..430: note = chr11:2883606-2884036
  misc_feature 1..430: note = Hyper
  source 1..430: mol_type = genomic DNA

SEQ ID NO: 105878 - DNA, 47 bp, Homo sapiens; identical to SEQ ID NO: 72655
  misc_feature 1..47: note = chr11:2884253-2884300
  misc_feature 1..47: note = Hyper
  source 1..47: mol_type = genomic DNA

SEQ ID NO: 105879 - DNA, 118 bp, Homo sapiens; identical to SEQ ID NO: 72656
  misc_feature 1..118: note = chr11:2905392-2905510
  misc_feature 1..118: note = Hyper
  source 1..118: mol_type = genomic DNA

SEQ ID NO: 105880 - DNA, 177 bp, Homo sapiens; identical to SEQ ID NO: 72657
  misc_feature 1..177: note = chr11:2905859-2906036
  misc_feature 1..177: note = Hyper
  source 1..177: mol_type = genomic DNA

SEQ ID NO: 105881 - DNA, 275 bp, Homo sapiens; identical to SEQ ID NO: 72658
  misc_feature 1..275: note = chr11:2906305-2906580
  misc_feature 1..275: note = Hyper
  source 1..275: mol_type = genomic DNA

SEQ ID NO: 105882 - DNA, 190 bp, Homo sapiens; identical to SEQ ID NO: 72659
  misc_feature 1..190: note = chr11:2906781-2906971
  misc_feature 1..190: note = Hyper
  source 1..190: mol_type = genomic DNA

SEQ ID NO: 105883 - DNA, 235 bp, Homo sapiens; identical to SEQ ID NO: 72660
  misc_feature 1..235: note = chr11:2932722-2932957
  misc_feature 1..235: note = Hypo
  source 1..235: mol_type = genomic DNA

SEQ ID NO: 105884 - DNA, 135 bp, Homo sapiens; identical to SEQ ID NO: 72661
  misc_feature 1..135: note = chr11:2933495-2933630
  misc_feature 1..135: note = Hypo
  source 1..135: mol_type = genomic DNA

SEQ ID NO: 105885 - DNA, 30 bp, Homo sapiens; identical to SEQ ID NO: 72662
  misc_feature 1..30: note = chr11:2948107-2948137
  misc_feature 1..30: note = Hypo
  source 1..30: mol_type = genomic DNA

SEQ ID NO: 105886 - DNA, 460 bp, Homo sapiens; identical to SEQ ID NO: 72663
  misc_feature 1..460: note = chr11:2949947-2950407
  misc_feature 1..460: note = Hyper
  source 1..460: mol_type = genomic DNA

SEQ ID NO: 105887 - DNA, 100 bp, Homo sapiens; identical to SEQ ID NO: 72681
  misc_feature 1..100: note = chr11:3102365-3102465
  misc_feature 1..100: note = Hypo
  source 1..100: mol_type = genomic DNA

SEQ ID NO: 105888 - DNA, 32 bp, Homo sapiens; identical to SEQ ID NO: 72682
  misc_feature 1..32: note = chr11:3110963-3110995
  misc_feature 1..32: note = Hypo
  source 1..32: mol_type = genomic DNA

SEQ ID NO: 105889 - DNA, 30 bp, Homo sapiens; identical to SEQ ID NO: 72683
  misc_feature 1..30: note = chr11:3114134-3114164
  misc_feature 1..30: note = Hypo
  source 1..30: mol_type = genomic DNA

SEQ ID NO: 105890 - DNA, 30 bp, Homo sapiens; identical to SEQ ID NO: 42992
  misc_feature 1..30: note = chr11:3150813-3150843
  misc_feature 1..30: note = Hypo
  source 1..30: mol_type = genomic DNA

SEQ ID NO: 105891 - DNA, 402 bp, Homo sapiens; identical to SEQ ID NO: 72686
  misc_feature 1..402: note = chr11:3164552-3164954
  misc_feature 1..402: note = Hypo
  source 1..402: mol_type = genomic DNA

SEQ ID NO: 105892 - DNA, 99 bp, Homo sapiens; identical to SEQ ID NO: 72687
  misc_feature 1..99: note = chr11:3169788-3169887
  misc_feature 1..99: note = Hypo
  source 1..99: mol_type = genomic DNA

SEQ ID NO: 105893 - DNA, 83 bp, Homo sapiens; identical to SEQ ID NO: 72727
  misc_feature 1..83: note = chr11:3186228-3186311
  misc_feature 1..83: note = Hyper
  source 1..83: mol_type = genomic DNA

SEQ ID NO: 105894 - DNA, 170 bp, Homo sapiens; identical to SEQ ID NO: 72728
  misc_feature 1..170: note = chr11:3186601-3186771
  misc_feature 1..170: note = Hyper
  source 1..170: mol_type = genomic DNA

SEQ ID NO: 105895 - DNA, 48 bp, Homo sapiens; identical to SEQ ID NO: 42995
  misc_feature 1..48: note = chr11:3187905-3187953
  misc_feature 1..48: note = Hypo
  source 1..48: mol_type = genomic DNA

SEQ ID NO: 105896 - DNA, 100 bp, Homo sapiens; identical to SEQ ID NO: 72732
  misc_feature 1..100: note = chr11:3209774-3209874
  misc_feature 1..100: note = Hypo
  source 1..100: mol_type = genomic DNA

SEQ ID NO: 105897 - DNA, 67 bp, Homo sapiens; identical to SEQ ID NO: 72733
  misc_feature 1..67: note = chr11:3224699-3224766
  misc_feature 1..67: note = Hyper
  source 1..67: mol_type = genomic DNA

SEQ ID NO: 105898 - DNA, 265 bp, Homo sapiens; identical to SEQ ID NO: 72750
  misc_feature 1..265: note = chr11:3249604-3249869
  misc_feature 1..265: note = Hypo
  source 1..265: mol_type = genomic DNA

SEQ ID NO: 105899 - DNA, 153 bp, Homo sapiens; identical to SEQ ID NO: 72751
  misc_feature 1..153: note = chr11:3251585-3251738
  misc_feature 1..153: note = Hypo
  source 1..153: mol_type = genomic DNA

SEQ ID NO: 105900 - DNA, 82 bp, Homo sapiens; identical to SEQ ID NO: 72752
  misc_feature 1..82: note = chr11:3254436-3254518
  misc_feature 1..82: note = Hypo
  source 1..82: mol_type = genomic DNA

SEQ ID NO: 105901 - DNA, 30 bp, Homo sapiens; identical to SEQ ID NO: 72756
  misc_feature 1..30: note = chr11:3277135-3277165
  misc_feature 1..30: note = Hypo
  source 1..30: mol_type = genomic DNA

SEQ ID NO: 105902 - DNA, 30 bp, Homo sapiens; identical to SEQ ID NO: 42997
  misc_feature 1..30: note = chr11:3398724-3398754
  misc_feature 1..30: note = Hypo
  source 1..30: mol_type = genomic DNA

SEQ ID NO: 105903 - DNA, 30 bp, Homo sapiens; identical to SEQ ID NO: 72784
  misc_feature 1..30: note = chr11:3429178-3429208
  misc_feature 1..30: note = Hypo
  source 1..30: mol_type = genomic DNA

SEQ ID NO: 105904 - DNA, 30 bp, Homo sapiens; identical to SEQ ID NO: 72786
  misc_feature 1..30: note = chr11:3446939-3446969
  misc_feature 1..30: note = Hypo
  source 1..30: mol_type = genomic DNA

SEQ ID NO: 105905 - DNA, 30 bp, Homo sapiens; identical to SEQ ID NO: 72803
  misc_feature 1..30: note = chr11:3638442-3638472
  misc_feature 1..30: note = Hypo
  source 1..30: mol_type = genomic DNA

SEQ ID NO: 105906 - DNA, 110 bp, Homo sapiens; identical to SEQ ID NO: 72806
  misc_feature 1..110: note = chr11:3663415-3663525
  misc_feature 1..110: note = Hyper
  source 1..110: mol_type = genomic DNA

SEQ ID NO: 105907 - DNA, 93 bp, Homo sapiens; identical to SEQ ID NO: 42998
  misc_feature 1..93: note = chr11:3697398-3697491
  misc_feature 1..93: note = Hypo
  source 1..93: mol_type = genomic DNA

SEQ ID NO: 105908 - DNA, 30 bp, Homo sapiens; identical to SEQ ID NO: 42999
  misc_feature 1..30: note = chr11:3766731-3766761
  misc_feature 1..30: note = Hypo
  source 1..30: mol_type = genomic DNA

SEQ ID NO: 105909 - DNA, 159 bp, Homo sapiens; identical to SEQ ID NO: 43000
  misc_feature 1..159: note = chr11:3828803-3828962
  misc_feature 1..159: note = Hypo
  source 1..159: mol_type = genomic DNA

SEQ ID NO: 105910 - DNA, 29 bp, Homo sapiens
  misc_feature 1..29: note = chr11:4209105-4209134
  misc_feature 1..29: note = Hyper
  source 1..29: mol_type = genomic DNA
tgcaagttagtgggcggggagccagtagg

SEQ ID NO: 105911 - DNA, 44 bp, Homo sapiens; identical to SEQ ID NO: 72827
  misc_feature 1..44: note = chr11:4298908-4298952
  misc_feature 1..44: note = Hypo
  source 1..44: mol_type = genomic DNA

SEQ ID NO: 105912 - DNA, 30 bp, Homo sapiens; identical to SEQ ID NO: 72845
  misc_feature 1..30: note = chr11:4361455-4361485
  misc_feature 1..30: note = Hypo
  source 1..30: mol_type = genomic DNA

SEQ ID NO: 105913 - DNA, 30 bp, Homo sapiens; identical to SEQ ID NO: 72852
  misc_feature 1..30: note = chr11:4399994-4400024
  misc_feature 1..30: note = Hypo
  source 1..30: mol_type = genomic DNA

SEQ ID NO: 105914 - DNA, 21 bp, Homo sapiens
  misc_feature 1..21: note = chr11:4785810-4785831
  misc_feature 1..21: note = Hypo
  source 1..21: mol_type = genomic DNA
gaatactgggcagggcgcagt

SEQ ID NO: 105915 - DNA, 30 bp, Homo sapiens; identical to SEQ ID NO: 72935
  misc_feature 1..30: note = chr11:4792115-4792145
  misc_feature 1..30: note = Hypo
  source 1..30: mol_type = genomic DNA

SEQ ID NO: 105916 - DNA, 26 bp, Homo sapiens
  misc_feature 1..26: note = chr11:5169023-5169049
  misc_feature 1..26: note = Hypo
  source 1..26: mol_type = genomic DNA
tttttttttttttttcggagacagag

SEQ ID NO: 105917 - DNA, 159 bp, Homo sapiens; identical to SEQ ID NO: 15524
  misc_feature 1..159: note = chr11:5192016-5192175
  misc_feature 1..159: note = Hypo
  source 1..159: mol_type = genomic DNA

SEQ ID NO: 105918 - DNA, 41 bp, Homo sapiens; identical to SEQ ID NO: 72950
  misc_feature 1..41: note = chr11:5192457-5192498
  misc_feature 1..41: note = Hypo
  source 1..41: mol_type = genomic DNA

SEQ ID NO: 105919 - DNA, 136 bp, Homo sapiens; identical to SEQ ID NO: 72953
  misc_feature 1..136: note = chr11:5330681-5330817
  misc_feature 1..136: note = Hypo
  source 1..136: mol_type = genomic DNA

SEQ ID NO: 105920 - DNA, 95 bp, Homo sapiens; identical to SEQ ID NO: 72956
  misc_feature 1..95: note = chr11:5394464-5394559
  misc_feature 1..95: note = Hypo
  source 1..95: mol_type = genomic DNA

SEQ ID NO: 105921 - DNA, 30 bp, Homo sapiens; identical to SEQ ID NO: 72957
  misc_feature 1..30: note = chr11:5411435-5411465
  misc_feature 1..30: note = Hypo
  source 1..30: mol_type = genomic DNA

SEQ ID NO: 105922 - DNA, 16 bp, Homo sapiens
  misc_feature 1..16: note = chr11:5580873-5580889
  misc_feature 1..16: note = Hypo
  source 1..16: mol_type = genomic DNA
ccgtctcaaaaaaaaa

SEQ ID NO: 105923 - DNA, 27 bp, Homo sapiens
  misc_feature 1..27: note = chr11:5609308-5609335
  misc_feature 1..27: note = Hypo
  source 1..27: mol_type = genomic DNA
catgagcctccgcgactgacctaaaat

SEQ ID NO: 105924 - DNA, 30 bp, Homo sapiens; identical to SEQ ID NO: 72966
  misc_feature 1..30: note = chr11:5624731-5624761
  misc_feature 1..30: note = Hypo
  source 1..30: mol_type = genomic DNA

SEQ ID NO: 105925 - DNA, 19 bp, Homo sapiens
  misc_feature 1..19: note = chr11:5784549-5784568
  misc_feature 1..19: note = Hypo
  source 1..19: mol_type = genomic DNA
aatttatttttgagacgga

SEQ ID NO: 105926 - DNA, 196 bp, Homo sapiens; identical to SEQ ID NO: 73011
  misc_feature 1..196: note = chr11:5949707-5949903
  misc_feature 1..196: note = Hypo
  source 1..196: mol_type = genomic DNA

SEQ ID NO: 105927 - DNA, 15 bp, Homo sapiens
  misc_feature 1..15: note = chr11:5949963-5949978
  misc_feature 1..15: note = Hypo
  source 1..15: mol_type = genomic DNA
cggccttattgatcc

SEQ ID NO: 105928 - DNA, 30 bp, Homo sapiens; identical to SEQ ID NO: 73013
  misc_feature 1..30: note = chr11:5951371-5951401
  misc_feature 1..30: note = Hypo
  source 1..30: mol_type = genomic DNA

SEQ ID NO: 105929 - DNA, 34 bp, Homo sapiens; identical to SEQ ID NO: 73015
  misc_feature 1..34: note = chr11:5957970-5958004
  misc_feature 1..34: note = Hypo
  source 1..34: mol_type = genomic DNA

SEQ ID NO: 105930 - DNA, 104 bp, Homo sapiens; identical to SEQ ID NO: 43007
  misc_feature 1..104: note = chr11:6257172-6257276
  misc_feature 1..104: note = Hypo
  source 1..104: mol_type = genomic DNA

SEQ ID NO: 105931 - DNA, 307 bp, Homo sapiens; identical to SEQ ID NO: 73096
  misc_feature 1..307: note = chr11:6280415-6280722
  misc_feature 1..307: note = Hyper
  source 1..307: mol_type = genomic DNA

SEQ ID NO: 105932 - DNA, 156 bp, Homo sapiens; identical to SEQ ID NO: 73097
  misc_feature 1..156: note = chr11:6281164-6281320
  misc_feature 1..156: note = Hyper
  source 1..156: mol_type = genomic DNA

SEQ ID NO: 105933 - DNA, 90 bp, Homo sapiens; identical to SEQ ID NO: 73101
  misc_feature 1..90: note = chr11:6341394-6341484
  misc_feature 1..90: note = Hyper
  source 1..90: mol_type = genomic DNA

SEQ ID NO: 105934 - DNA, 96 bp, Homo sapiens; identical to SEQ ID NO: 73190
  misc_feature 1..96: note = chr11:6497213-6497309
  misc_feature 1..96: note = Hypo
  source 1..96: mol_type = genomic DNA

SEQ ID NO: 105935 - DNA, 555 bp, Homo sapiens
  misc_feature 1..555: note = chr11:6676451-6677006
  misc_feature 1..555: note = Hyper
  source 1..555: mol_type = genomic DNA
acacagccagagagacgcccagggacacacaacctcccagtgacacgcactgacacactccgacgatgcactggaacacaacgctgtcgcaccccacacccccggcgcacgctcccgccgccaccctccccgactcgatgacacacgcacacaaagacccccaggccctgcccccacgctcacgttcacgcccgcccgggtcccgcaggcccaggccccccctcccccattgtctccggctcagaacaaagcccccggctccgccgccgctgccgcagcccaggggaggccggcgggcagggcgggcgcggccagacgggccgggcgggcgcgggcactgacctccgcgcgacgcgggctccctcgcccggtgctggggcgccgtccggccgcggtcagccccccgggcagcgcccgctcgcgcggggcctgaggccgcgcatcgtccgcagtcgctgtctccgaggcccgcgatcccctccgggcagccgccgtcggtccgcgcgcccttggccgtcgatcggtccgtccgctgacgcccgggcgccgcctcct

SEQ ID NO: 105936 - DNA, 133 bp, Homo sapiens; identical to SEQ ID NO: 73273
  misc_feature 1..133: note = chr11:6677213-6677346
  misc_feature 1..133: note = Hyper
  source 1..133: mol_type = genomic DNA

SEQ ID NO: 105937 - DNA, 199 bp, Homo sapiens; identical to SEQ ID NO: 73286
  misc_feature 1..199: note = chr11:6731043-6731242
  misc_feature 1..199: note = Hypo
  source 1..199: mol_type = genomic DNA

SEQ ID NO: 105938 - DNA, 714 bp, Homo sapiens; identical to SEQ ID NO: 73346
  misc_feature 1..714: note = chr11:6947603-6948317
  misc_feature 1..714: note = Hyper
  source 1..714: mol_type = genomic DNA

SEQ ID NO: 105939 - DNA, 38 bp, Homo sapiens; identical to SEQ ID NO: 73366
  misc_feature 1..38: note = chr11:7041865-7041903
  misc_feature 1..38: note = Hyper
  source 1..38: mol_type = genomic DNA

SEQ ID NO: 105940 - DNA, 1388 bp, Homo sapiens
  misc_feature 1..1388: note = chr11:7272860-7274248
  misc_feature 1..1388: note = Hyper
  source 1..1388: mol_type = genomic DNA
actcggcggtgggagcgggtgcttggtttgcatcagggatgaggggtggagtagcgaaagcgcccggagcgcgcactcactcacactccccaagccagggcgcggccgctctgggcgcgaggtcccaagccaagtctcgcgctcggccaggagccggggagtaccccaggtccccggtctggggccgccgctatcctaccctgcggcgcgcactcctgacctggccccgccccccggcggccgcgagtagcgggcggagcgcaagcagagaggcgctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagagcgaggggaggccgcggcggcctcggagccgtgggaagggggacgaggccgaaggaaactctgggaagttgggagttggggacggccccgggttggggccgaatcccaccgggtgctgctcatcctttctcccaagcgtctagttcctttccttggtatggggtgagaagggcgggacgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcggtcctggcttgtg

SEQ ID NO: 105941 - DNA, 28 bp, Homo sapiens
  misc_feature 1..28: note = chr11:7388589-7388617
  misc_feature 1..28: note = Hypo
  source 1..28: mol_type = genomic DNA
gcgtgagccaccgcgcccggccttccag

SEQ ID NO: 105942 - DNA, 30 bp, Homo sapiens; identical to SEQ ID NO: 43010
  misc_feature 1..30: note = chr11:7439190-7439220
  misc_feature 1..30: note = Hypo
  source 1..30: mol_type = genomic DNA

SEQ ID NO: 105943 - DNA, 188 bp, Homo sapiens; identical to SEQ ID NO: 73476
  misc_feature 1..188: note = chr11:7905970-7906158
  misc_feature 1..188: note = Hypo
  source 1..188: mol_type = genomic DNA

SEQ ID NO: 105944 - DNA, 33 bp, Homo sapiens; identical to SEQ ID NO: 73477
  misc_feature 1..33: note = chr11:7909927-7909960
  misc_feature 1..33: note = Hypo
  source 1..33: mol_type = genomic DNA

SEQ ID NO: 105945 - DNA, 888 bp, Homo sapiens
  misc_feature 1..888: note = chr11:8040261-8041149
  misc_feature 1..888: note = Hyper
  source 1..888: mol_type = genomic DNA
gaagagaggaggggacggtggtttcaagacttccaccctggggaagaagggacggggagacggcgggaatctaggaaattgggggatggctatttccattcctgagaaggggggaacttgattgtgggaggttggctgaagactcccacgccggaaaggagggcgcctctgcggaagggccccgagtggcgacagcggatccgggactcccaagcaagcaggagccggagcagcctcttagcaacccctgtcccgggaaggtttgaaagcagcggtgccctagtgacgccggaaaagatggagcggttgtcatggcgacgcggagcacacctcggaaataaataaataagcgcccaggctgccgcagccgcgcccccgcgggacccgagcgagggggagggggcctcacgggcccgggtccccgcagtcgcgcgtccccgccattggcagagccggagggggtcaccccccggggggcgaatggtacagtcctccgcccgcgcctcggccgggcccgcagcctgcgagccagccccaagcccagcgccgccgccgcccgcggagccccgagcggagccggaggcggcgatggagggagtcagcagccaccggaccctgtcttacagccgctggagctatgacaggtagggcgcccgaagggtggccctgcgtgagcgcctgctgaccctcgatctcctgcgggagaagcgggcctccgggggctaggactggcgcgagcgcccgacccccagggtgggcttgggcacccggaccctcgggcatccgggacccagagcctcgggtacggcgcagcggagctccagcgagggtagtgtccccacacccacggggcagagctgtcggaggagggcacgcggccactgggac

SEQ ID NO: 105946 - DNA, 108 bp, Homo sapiens; identical to SEQ ID NO: 73491
  misc_feature 1..108: note = chr11:8041493-8041601
  misc_feature 1..108: note = Hyper
  source 1..108: mol_type = genomic DNA

SEQ ID NO: 105947 - DNA, 594 bp, Homo sapiens; identical to SEQ ID NO: 73492
  misc_feature 1..594: note = chr11:8102561-8103155
  misc_feature 1..594: note = Hyper
  source 1..594: mol_type = genomic DNA

SEQ ID NO: 105948 - DNA, 820 bp, Homo sapiens; identical to SEQ ID NO: 73494
  misc_feature 1..820: note = chr11:8189946-8190766
  misc_feature 1..820: note = Hyper
  source 1..820: mol_type = genomic DNA

SEQ ID NO: 105949 - DNA, 30 bp, Homo sapiens; identical to SEQ ID NO: 73495
  misc_feature 1..30: note = chr11:8213825-8213855
  misc_feature 1..30: note = Hypo
  source 1..30: mol_type = genomic DNA

SEQ ID NO: 105950 - DNA, 120 bp, Homo sapiens
  misc_feature 1..120: note = chr11:8284225-8284345
  misc_feature 1..120: note = Hyper
  source 1..120: mol_type = genomic DNA
tctgggccaaactcccgcctccgcgctcagagagacagggagctagcgggccggcacaagaggcggctctctttctcaccgagtcacgctcatgcagatgtcccccggagggtccaaccc

SEQ ID NO: 105951 - DNA, 393 bp, Homo sapiens; identical to SEQ ID NO: 73504
  misc_feature 1..393: note = chr11:8284568-8284961
  misc_feature 1..393: note = Hyper
  source 1..393: mol_type = genomic DNA

SEQ ID NO: 105952 - DNA, 896 bp, Homo sapiens
  misc_feature 1..896: note = chr11:8289527-8290423
  misc_feature 1..896: note = Hyper
  source 1..896: mol_type = genomic DNA
caccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgctgagcctggcaccgccgaccccggcaccggcgcacacatcagccgccgcgcttccgggaagccacccatcagccggaggaggcccgcgggtgctgagggctctgccgccgctagcggggtggactccgcagggccagcgccgcagtctccgccccacgtcccgcgtgcccccgggcaccggcaccgggcgccgggcacctaccgtcctcctggtccaacaccatggtcccgacggctccagccggactagcgccgaggatacggaggggcgcgtggctccgactcccgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcccgggccgggccgcagccggagcctgagccgcgcgcgcgtccttcctccgcgccggccgtactcgcctcagcagagtgaaggctgcatttcccagggcccctcagattcccctgttaattaaatcaattcattatgctcagatctgattagcggcccttccccccc

SEQ ID NO: 105953 - DNA, 599 bp, Homo sapiens; identical to SEQ ID NO: 73529
  misc_feature 1..599: note = chr11:8615288-8615887
  misc_feature 1..599: note = Hyper
  source 1..599: mol_type = genomic DNA

SEQ ID NO: 105954 - DNA, 73 bp, Homo sapiens; identical to SEQ ID NO: 73545
  misc_feature 1..73: note = chr11:8832710-8832783
  misc_feature 1..73: note = Hypo
  source 1..73: mol_type = genomic DNA

SEQ ID NO: 105955 - DNA, 1338 bp, Homo sapiens; identical to SEQ ID NO: 73555
  misc_feature 1..1338: note = chr11:9025010-9026348
  misc_feature 1..1338: note = Hyper
  source 1..1338: mol_type = genomic DNA

SEQ ID NO: 105956 - DNA, 525 bp, Homo sapiens
  misc_feature 1..525: note = chr11:9112446-9112971
  misc_feature 1..525: note = Hyper
  source 1..525: mol_type = genomic DNA
gggtaattcccagatcggaacaggcgctgttccgctgacagaaaagtctctggagcccaccccgaagccatcagcagaacttgccggcccccaaagaaagaaacggcaaagctgccaccgcctcgcggatgtgcccggcccggccctcagtttccccgcctacgctgaggcgcgggaccccaaggccagggtccgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccga

SEQ ID NO: 105957 - DNA, 465 bp, Homo sapiens; identical to SEQ ID NO: 73559
  misc_feature 1..465: note = chr11:9113031-9113496
  misc_feature 1..465: note = Hyper
  source 1..465: mol_type = genomic DNA

SEQ ID NO: 105958 - DNA, 30 bp, Homo sapiens; identical to SEQ ID NO: 73566
  misc_feature 1..30: note = chr11:9285492-9285522
  misc_feature 1..30: note = Hyper
  source 1..30: mol_type = genomic DNA

SEQ ID NO: 105959 - DNA, 157 bp, Homo sapiens; identical to SEQ ID NO: 43011
  misc_feature 1..157: note = chr11:9405392-9405549
  misc_feature 1..157: note = Hypo
  source 1..157: mol_type = genomic DNA

SEQ ID NO: 105960 - DNA, 37 bp, Homo sapiens; identical to SEQ ID NO: 43012
  misc_feature 1..37: note = chr11:9405789-9405826
  misc_feature 1..37: note = Hypo
  source 1..37: mol_type = genomic DNA

SEQ ID NO: 105961 - DNA, 26 bp, Homo sapiens
  misc_feature 1..26: note = chr11:9567879-9567905
  misc_feature 1..26: note = Hypo
  source 1..26: mol_type = genomic DNA
ctgttcctattcggccatcttggctc

SEQ ID NO: 105962 - DNA, 30 bp, Homo sapiens; identical to SEQ ID NO: 73599
  misc_feature 1..30: note = chr11:9593400-9593430
  misc_feature 1..30: note = Hypo
  source 1..30: mol_type = genomic DNA

SEQ ID NO: 105963 - DNA, 46 bp, Homo sapiens; identical to SEQ ID NO: 73601
  misc_feature 1..46: note = chr11:9830623-9830669
  misc_feature 1..46: note = Hypo
  source 1..46: mol_type = genomic DNA

SEQ ID NO: 105964 - DNA, 30 bp, Homo sapiens; identical to SEQ ID NO: 71907
  misc_feature 1..30: note = chr11:10326950-10326980
  misc_feature 1..30: note = Hyper
  source 1..30: mol_type = genomic DNA

SEQ ID NO: 105965 - DNA, 25 bp, Homo sapiens
  misc_feature 1..25: note = chr11:10405168-10405193
  misc_feature 1..25: note = Hypo
  source 1..25: mol_type = genomic DNA
tctctctctaggagtcgtcatttat

SEQ ID NO: 105966 - DNA, 84 bp, Homo sapiens; identical to SEQ ID NO: 71915
  misc_feature 1..84: note = chr11:10468369-10468453
  misc_feature 1..84: note = Hypo
  source 1..84: mol_type = genomic DNA

SEQ ID NO: 105967 - DNA, 576 bp, Homo sapiens
  misc_feature 1..576: note = chr11:10472027-10472603
  misc_feature 1..576: note = Hyper
  source 1..576: mol_type = genomic DNA
ctgggaaaagttgtgcggggaggggaggacgtcgggcaagcccgggcggcacggggagcggtgtggaagcccggcggggccagcgcagttgaggtctggggagcccggctggcatctgctccgggctgcggcgcgggccccgcggagcccaggaggcggcgggtgcttccggccaagggccctggcggccgccgcgcccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccggtgagtgcgcgcg

SEQ ID NO: 105968 - DNA, 214 bp, Homo sapiens; identical to SEQ ID NO: 71918
  misc_feature 1..214: note = chr11:10509593-10509807
  misc_feature 1..214: note = Hypo
  source 1..214: mol_type = genomic DNA

SEQ ID NO: 105969 - DNA, 37 bp, Homo sapiens; identical to SEQ ID NO: 71937
  misc_feature 1..37: note = chr11:10811151-10811188
  misc_feature 1..37: note = Hypo
  source 1..37: mol_type = genomic DNA

SEQ ID NO: 105970 - DNA, 29 bp, Homo sapiens
  misc_feature 1..29: note = chr11:10815867-10815896
  misc_feature 1..29: note = Hypo
  source 1..29: mol_type = genomic DNA
acatttgaagctgggcgcggtagctcacg

SEQ ID NO: 105971 - DNA, 30 bp, Homo sapiens; identical to SEQ ID NO: 71941
  misc_feature 1..30: note = chr11:10828053-10828083
  misc_feature 1..30: note = Hypo
  source 1..30: mol_type = genomic DNA

SEQ ID NO: 105972 - DNA, 100 bp, Homo sapiens; identical to SEQ ID NO: 43016
  misc_feature 1..100: note = chr11:10865202-10865302
  misc_feature 1..100: note = Hypo
  source 1..100: mol_type = genomic DNA

SEQ ID NO: 105973 - DNA, 116 bp, Homo sapiens; identical to SEQ ID NO: 71954
  misc_feature 1..116: note = chr11:10952367-10952483
  misc_feature 1..116: note = Hyper
  source 1..116: mol_type = genomic DNA

SEQ ID NO: 105974 - DNA, 30 bp, Homo sapiens; identical to SEQ ID NO: 71987
  misc_feature 1..30: note = chr11:11373606-11373636
  misc_feature 1..30: note = Hypo
  source 1..30: mol_type = genomic DNA

SEQ ID NO: 105975 - DNA, 30 bp, Homo sapiens; identical to SEQ ID NO: 72002
  misc_feature 1..30: note = chr11:11465873-11465903
  misc_feature 1..30: note = Hypo
  source 1..30: mol_type = genomic DNA

SEQ ID NO: 105976 - DNA, 66 bp, Homo sapiens; identical to SEQ ID NO: 33631
  misc_feature 1..66: note = chr11:11642602-11642668
  misc_feature 1..66: note = Hyper
  source 1..66: mol_type = genomic DNA

SEQ ID NO: 105977 - DNA, 288 bp, Homo sapiens; identical to SEQ ID NO: 72025
  misc_feature 1..288: note = chr11:11643016-11643304
  misc_feature 1..288: note = Hyper
  source 1..288: mol_type = genomic DNA

SEQ ID NO: 105978 - DNA, 669 bp, Homo sapiens
  misc_feature 1..669: note = chr11:12029892-12030561
  misc_feature 1..669: note = Hyper
  source 1..669: mol_type = genomic DNA
cccgcgccgccagggcgcacccacctcttccaccgcgctgcgcaatttgtgctgcgtgtcctccatcagttcctcaacctcgcggaacatctcattgagggtggcctcctcctgcgggtagctgagagccgggccgggcttgactggagccgaggtcgccgtcggagcgggcgcgggggccgtggggaccgccgccgccagcagcaggcacagcagggtggccccaagccgctgcatctccgctctgcgcccgcagccgccgcctgtgtgtcccggaacgcgatcagaggcgcgcggaccacccccctcgctgggcccgccgccccgccccgttccgccccgccgcccgcccctggcgcccctctttcccgcacccgcccggagacgggaggaaaccgaggcccctgaaaacgcagctcccctacacccgaaaagacgcgaccccacccgctccagcccgagccccgatcgccccaggaccccgcacccccatcctcgagcacaagctgagctctgctcctcacctgtgatgctggagccctcgccagagcaaccgaacccggatcctctacgctaatagctcccaagccccagctcacctagactctgtccccggttcaaaccctagcccctcctcgaccaggtcagagtgcccgacccccacttcca

SEQ ID NO: 105979 - DNA, 172 bp, Homo sapiens; identical to SEQ ID NO: 72080
  misc_feature 1..172: note = chr11:12030834-12031006
  misc_feature 1..172: note = Hyper
  source 1..172: mol_type = genomic DNA

SEQ ID NO: 105980 - DNA, 350 bp, Homo sapiens; identical to SEQ ID NO: 72100
  misc_feature 1..350: note = chr11:12131862-12132212
  misc_feature 1..350: note = Hyper
  source 1..350: mol_type = genomic DNA

SEQ ID NO: 105981 - DNA, 112 bp, Homo sapiens; identical to SEQ ID NO: 72101
  misc_feature 1..112: note = chr11:12132499-12132611
  misc_feature 1..112: note = Hyper
  source 1..112: mol_type = genomic DNA

SEQ ID NO: 105982 - DNA, 30 bp, Homo sapiens; identical to SEQ ID NO: 72114
  misc_feature 1..30: note = chr11:12231039-12231069
  misc_feature 1..30: note = Hypo
  source 1..30: mol_type = genomic DNA

SEQ ID NO: 105983 - DNA, 30 bp, Homo sapiens; identical to SEQ ID NO: 43017
  misc_feature 1..30: note = chr11:12288561-12288591
  misc_feature 1..30: note = Hypo
  source 1..30: mol_type = genomic DNA

SEQ ID NO: 105984 - DNA, 59 bp, Homo sapiens; identical to SEQ ID NO: 72153
  misc_feature 1..59: note = chr11:12398995-12399054
  misc_feature 1..59: note = Hyper
  source 1..59: mol_type = genomic DNA

SEQ ID NO: 105985 - DNA, 106 bp, Homo sapiens; identical to SEQ ID NO: 72154
  misc_feature 1..106: note = chr11:12399277-12399383
  misc_feature 1..106: note = Hyper
  source 1..106: mol_type = genomic DNA

SEQ ID NO: 105986 - DNA, 1289 bp, Homo sapiens
  misc_feature 1..1289: note = chr11:12695399-12696688
  misc_feature 1..1289: note = Hyper
  source 1..1289: mol_type = genomic DNA
gctgggaatctggcccggagacggcgtccaccgcgctcgagagcaacaatctgcatcaccagaaaggcaacttctctaccctacacttgcagacttccgcgagtccgggagcactcaacgcagtcacccgcgcttccgcgtcccggactagggaaactgaggcacggtaggcgcgtcgcgcgcaactcccgcctcggcgcctgccccctggaagaaacccaggcttccagagttcttcgcgcgagcgcagggacttccaagccgcgcagctcccgtccgccccgccccgccccgccccggctcgggacaaagcccggagcccgcgccgggagacggagggcggctcccgcgcgagccacgctcccccgtgggcgcgagactccgcccagctgccgaaagcccgcgccccaacggcgaagcagccgcgccggtccgccccgattccccatgacgtcaccggcggcggcaggccccgcctccagccccgggcggcaggccgcatgacgtcaccgaggccccacccctccggagcgagttcggtcctggcgttcatttcattcctgtcctcattccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtaagttggcgcgcggggcggatgctggggtgcggggggcgcacggggcagcggggggccggcggcgcgtccctcgcgggccgctctttctttgcgggctctgctttgtgtgcgacggcgggcgggcacgcggagggccgcggccgggcccccacacccgcctccccgcgccccctccgaggtgagcggccgggcgccgccgcgcgacttgccaggacgccaagttgggccgcgcgctgggagcccgcgcggcaacaggcggcccccggccggccgcgccgcgccccccgcgcgccccctctcccgc

SEQ ID NO: 105987 - DNA, 30 bp, Homo sapiens; identical to SEQ ID NO: 33642
  misc_feature 1..30: note = chr11:12715647-12715677
  misc_feature 1..30: note = Hyper
  source 1..30: mol_type = genomic DNA

SEQ ID NO: 105988 - DNA, 30 bp, Homo sapiens; identical to SEQ ID NO: 72228
  misc_feature 1..30: note = chr11:12745696-12745726
  misc_feature 1..30: note = Hypo
  source 1..30: mol_type = genomic DNA

SEQ ID NO: 105989 - DNA, 397 bp, Homo sapiens; identical to SEQ ID NO: 72271
  misc_feature 1..397: note = chr11:13030293-13030690
  misc_feature 1..397: note = Hyper
  source 1..397: mol_type = genomic DNA

SEQ ID NO: 105990 - DNA, 687 bp, Homo sapiens
  misc_feature 1..687: note = chr11:13030937-13031624
  misc_feature 1..687: note = Hyper
  source 1..687: mol_type = genomic DNA
aaccgcgaccacagccgcagtcgctttccagcctgccttcggtgcgcagcgggggaacagggctagtgcagccgccggaggggggcacgggctcctctcccatcccagagctactgggctgcccttgctgtcctcgccgccccagcagaccccggccggacctgccacctgcgccctggttgcgccatggatccttcggaaaagaagatatcggtgtggatctgccaggaagagaagctggtgtccggcctctcccgccgcaccacttgctccgacgttgtgcgagtgcttttggaggacggctgccggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggcc

SEQ ID NO: 105991 - DNA, 356 bp, Homo sapiens
  misc_feature 1..356: note = chr11:13031956-13032312
  misc_feature 1..356: note = Hyper
  source 1..356: mol_type = genomic DNA
ggttggggcaggcatcgagctcgacgggtccagaccgggagaggagccagaagaggtggcggcggaggcggaggaggcggcggcggcgccccctctagccggcgaggcgcaggcggcggcgctggaggagctggcccggcgctgcgacgacttgctgcggcttcaggagcaacgggttcagcaggaggagttgctggagcgcctttcagccgagattcaggaggaactcaaccagaggtggatgcgacggcgccaggaggagctggcggcgcgggaggagcccctggagcccgacggtggccccgacggcgagctgctgctggagcaggaacgggtcaggacgcagctcagtacca

SEQ ID NO: 105992 - DNA, 150 bp, Homo sapiens
  misc_feature 1..150: note = chr11:13032656-13032806
  misc_feature 1..150: note = Hyper
  source 1..150: mol_type = genomic DNA
gcggggggcggggggcgggaacagggggattcttttttcttgcagaatgcagtgggccagccggctcgcggacttgaaaccaggctgttgcgagcccagagctccggctgggcagcagcgctctgcgcagcctcgcgctcatctggctcc

SEQ ID NO: 105993 - DNA, 281 bp, Homo sapiens; identical to SEQ ID NO: 72308
  misc_feature 1..281: note = chr11:13300434-13300715
  misc_feature 1..281: note = Hyper
  source 1..281: mol_type = genomic DNA

SEQ ID NO: 105994 - DNA, 19 bp, Homo sapiens
  misc_feature 1..19: note = chr11:13687132-13687151
  misc_feature 1..19: note = Hypo
  source 1..19: mol_type = genomic DNA
agtacgagactccttctca

SEQ ID NO: 105995 - DNA, 33 bp, Homo sapiens; identical to SEQ ID NO: 72381
  misc_feature 1..33: note = chr11:14520450-14520483
  misc_feature 1..33: note = Hypo
  source 1..33: mol_type = genomic DNA

SEQ ID NO: 105996 - DNA, 18 bp, Homo sapiens
  misc_feature 1..18: note = chr11:14542771-14542789
  misc_feature 1..18: note = Hypo
  source 1..18: mol_type = genomic DNA
gggcggaggatcgcttga

SEQ ID NO: 105997 - DNA, 23 bp, Homo sapiens
  misc_feature 1..23: note = chr11:14558164-14558187
  misc_feature 1..23: note = Hypo
  source 1..23: mol_type = genomic DNA
tttttatttttgagacggagtct

SEQ ID NO: 105998 - DNA, 79 bp, Homo sapiens; identical to SEQ ID NO: 72387
  misc_feature 1..79: note = chr11:14564357-14564436
  misc_feature 1..79: note = Hypo
  source 1..79: mol_type = genomic DNA

SEQ ID NO: 105999 - DNA, 198 bp, Homo sapiens; identical to SEQ ID NO: 72392
  misc_feature 1..198: note = chr11:14665073-14665271
  misc_feature 1..198: note = Hyper
  source 1..198: mol_type = genomic DNA

SEQ ID NO: 106000 - DNA, 34 bp, Homo sapiens; identical to SEQ ID NO: 72393
  misc_feature 1..34: note = chr11:14665617-14665651
  misc_feature 1..34: note = Hyper
  source 1..34: mol_type = genomic DNA

SEQ ID NO: 106001 - DNA, 30 bp, Homo sapiens; identical to SEQ ID NO: 72394
  misc_feature 1..30: note = chr11:14666026-14666056
  misc_feature 1..30: note = Hyper
  source 1..30: mol_type = genomic DNA

SEQ ID NO: 106002 - DNA, 35 bp, Homo sapiens; identical to SEQ ID NO: 72395
  misc_feature 1..35: note = chr11:14666496-14666531
  misc_feature 1..35: note = Hyper
  source 1..35: mol_type = genomic DNA

SEQ ID NO: 106003 - DNA, 84 bp, Homo sapiens; identical to SEQ ID NO: 43021
  misc_feature 1..84: note = chr11:15084438-15084522
  misc_feature 1..84: note = Hypo
  source 1..84: mol_type = genomic DNA

SEQ ID NO: 106004 - DNA, 515 bp, Homo sapiens
  misc_feature 1..515: note = chr11:15136043-15136558
  misc_feature 1..515: note = Hyper
  source 1..515: mol_type = genomic DNA
cagctccaagggaaacgatcgcggcacattcccttcccctctccagatgttggcatgcggggcaccttgtgggcgaccccgcctggacggcttcgcggctcccgggcgatcaccctggtgcctgccgcctggcccgggggagcccggtctctaattaggcctgaccgcgtccccattccagcgctcctgcagatgggagggagggccatgtttccccccccaggggcaccgaaatagcctcgtagtcccgcggagacagcaggcagccgtggctgacgcgggaccaaggcttggcagggagcgcgctgctgtggaaggtccttgggaggctgcgaccgcctcggagagggcgggcgggggagaacggggcggggggtggggcgggggccaggggcggcctctcgggctgggccggcagagcggccactttgcgcgcggcctctggagctccagctgcgccccgccaccactggccgctcgcactaccagcctgtctcgcacgctaagtaagtaga

SEQ ID NO: 106005 - DNA, 23 bp, Homo sapiens
  misc_feature 1..23: note = chr11:16255262-16255285
  misc_feature 1..23: note = Hypo
  source 1..23: mol_type = genomic DNA
aacataaaacaggcccggtgcgg

SEQ ID NO: 106006 - DNA, 214 bp, Homo sapiens; identical to SEQ ID NO: 72414
  misc_feature 1..214: note = chr11:16625964-16626178
  misc_feature 1..214: note = Hyper
  source 1..214: mol_type = genomic DNA

SEQ ID NO: 106007 - DNA, 57 bp, Homo sapiens; identical to SEQ ID NO: 72415
  misc_feature 1..57: note = chr11:16626439-16626496
  misc_feature 1..57: note = Hyper
  source 1..57: mol_type = genomic DNA

SEQ ID NO: 106008 - DNA, 46 bp, Homo sapiens; identical to SEQ ID NO: 72416
  misc_feature 1..46: note = chr11:16627364-16627410
  misc_feature 1..46: note = Hyper
  source 1..46: mol_type = genomic DNA

SEQ ID NO: 106009 - DNA, 606 bp, Homo sapiens; identical to SEQ ID NO: 72417
  misc_feature 1..606: note = chr11:16628305-16628911
  misc_feature 1..606: note = Hyper
  source 1..606: mol_type = genomic DNA

SEQ ID NO: 106010 - DNA, 156 bp, Homo sapiens; identical to SEQ ID NO: 33655
  misc_feature 1..156: note = chr11:16629373-16629529
  misc_feature 1..156: note = Hyper
  source 1..156: mol_type = genomic DNA

SEQ ID NO: 106011 - DNA, 257 bp, Homo sapiens
  misc_feature 1..257: note = chr11:16632413-16632670
  misc_feature 1..257: note = Hyper
  source 1..257: mol_type = genomic DNA
gctcggagaagttcccggaggagcagagggcacccaggcacggtggccagatccaggaactcataagctcacatcccctgggggttggagccccacgcggcgcaagaaccccgggcgctgagctccggggaacctgggagggaaggaggggcgagcgggtggggctgacttacctgcccgcagcagtcgctgcctctgtgttgtccgaatgtccctgcgcaccgcaaccagcaaaggcaattcggctttgctaactt

SEQ ID NO: 106012 - DNA, 313 bp, Homo sapiens; identical to SEQ ID NO: 72421
  misc_feature 1..313: note = chr11:16634139-16634452
  misc_feature 1..313: note = Hyper
  source 1..313: mol_type = genomic DNA

SEQ ID NO: 106013 - DNA, 30 bp, Homo sapiens; identical to SEQ ID NO: 72422
  misc_feature 1..30: note = chr11:16635126-16635156
  misc_feature 1..30: note = Hyper
  source 1..30: mol_type = genomic DNA

SEQ ID NO: 106014 - DNA, 132 bp, Homo sapiens; identical to SEQ ID NO: 33658
  misc_feature 1..132: note = chr11:16635795-16635927
  misc_feature 1..132: note = Hyper
  source 1..132: mol_type = genomic DNA

SEQ ID NO: 106015 - DNA, 21 bp, Homo sapiens
  misc_feature 1..21: note = chr11:16762253-16762274
  misc_feature 1..21: note = Hypo
  source 1..21: mol_type = genomic DNA
ccacctcgcccagccagtact

SEQ ID NO: 106016 - DNA, 30 bp, Homo sapiens; identical to SEQ ID NO: 72426
  misc_feature 1..30: note = chr11:16935834-16935864
  misc_feature 1..30: note = Hypo
  source 1..30: mol_type = genomic DNA

SEQ ID NO: 106017 - DNA, 219 bp, Homo sapiens; identical to SEQ ID NO: 72427
  misc_feature 1..219: note = chr11:16978351-16978570
  misc_feature 1..219: note = Hypo
  source 1..219: mol_type = genomic DNA

SEQ ID NO: 106018 - DNA, 108 bp, Homo sapiens; identical to SEQ ID NO: 43023
  misc_feature 1..108: note = chr11:16988399-16988507
  misc_feature 1..108: note = Hypo
  source 1..108: mol_type = genomic DNA

SEQ ID NO: 106019 - DNA, 21 bp, Homo sapiens
  misc_feature 1..21: note = chr11:17037323-17037344
  misc_feature 1..21: note = Hypo
  source 1..21: mol_type = genomic DNA
tcgcgccgctgccctgcaacc

SEQ ID NO: 106020 - DNA, 154 bp, Homo sapiens; identical to SEQ ID NO: 43025
  misc_feature 1..154: note = chr11:17100671-17100825
  misc_feature 1..154: note = Hypo
  source 1..154: mol_type = genomic DNA

SEQ ID NO: 106021 - DNA, 279 bp, Homo sapiens; identical to SEQ ID NO: 72431
  misc_feature 1..279: note = chr11:17373126-17373405
  misc_feature 1..279: note = Hyper
  source 1..279: mol_type = genomic DNA

SEQ ID NO: 106022 - DNA, 249 bp, Homo sapiens
  misc_feature 1..249: note = chr11:17497448-17497697
  misc_feature 1..249: note = Hyper
  source 1..249: mol_type = genomic DNA
ctcagtggagaggcacgcacgattgtcccggccgtggcgcccaactttgcaagcaagggcgccggggtcgctgcgtcggcgagtcggagctactttgcgcagagcctgagaagttgcgctctggagacacatgcccgggtggggtggcgggggaagggaatccaagtccctagctctcgcctctcctcgcccagggcgcgggcctgggactgtcagagatcacggaccactgcgcggctcagcccggtg

SEQ ID NO: 106023 - DNA, 314 bp, Homo sapiens; identical to SEQ ID NO: 72435
  misc_feature 1..314: note = chr11:17497951-17498265
  misc_feature 1..314: note = Hyper
  source 1..314: mol_type = genomic DNA

SEQ ID NO: 106024 - DNA, 218 bp, Homo sapiens; identical to SEQ ID NO: 72436
  misc_feature 1..218: note = chr11:17565786-17566004
  misc_feature 1..218: note = Hyper
  source 1..218: mol_type = genomic DNA

SEQ ID NO: 106025 - DNA, 98 bp, Homo sapiens; identical to SEQ ID NO: 72437
  misc_feature 1..98: note = chr11:17566237-17566335
  misc_feature 1..98: note = Hypo
  source 1..98: mol_type = genomic DNA

SEQ ID NO: 106026 - DNA, 46 bp, Homo sapiens; identical to SEQ ID NO: 72438
  misc_feature 1..46: note = chr11:17591817-17591863
  misc_feature 1..46: note = Hypo
  source 1..46: mol_type = genomic DNA

SEQ ID NO: 106027 - DNA, 117 bp, Homo sapiens; identical to SEQ ID NO: 72440
  misc_feature 1..117: note = chr11:17633792-17633909
  misc_feature 1..117: note = Hypo
  source 1..117: mol_type = genomic DNA

SEQ ID NO: 106028 - DNA, 30 bp, Homo sapiens; identical to SEQ ID NO: 72441
  misc_feature 1..30: note = chr11:17653699-17653729
  misc_feature 1..30: note = Hypo
  source 1..30: mol_type = genomic DNA

SEQ ID NO: 106029 - DNA, 465 bp, Homo sapiens; identical to SEQ ID NO: 72443
  misc_feature 1..465: note = chr11:17717315-17717780
  misc_feature 1..465: note = Hyper
  source 1..465: mol_type = genomic DNA

SEQ ID NO: 106030 - DNA, 806 bp, Homo sapiens; identical to SEQ ID NO: 72444
  misc_feature 1..806: note = chr11:17740381-17741187
  misc_feature 1..806: note = Hyper
  source 1..806: mol_type = genomic DNA

SEQ ID NO: 106031 - DNA, 187 bp, Homo sapiens
  misc_feature 1..187: note = chr11:17741411-17741598
  misc_feature 1..187: note = Hyper
  source 1..187: mol_type = genomic DNA
acttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggc

SEQ ID NO: 106032 - DNA, 722 bp, Homo sapiens
  misc_feature 1..722: note = chr11:17741806-17742528
  misc_feature 1..722: note = Hyper
  source 1..722: mol_type = genomic DNA
ctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcgg

SEQ ID NO: 106033 - DNA, 32 bp, Homo sapiens; identical to SEQ ID NO: 72449
  misc_feature 1..32: note = chr11:17742779-17742811
  misc_feature 1..32: note = Hyper
  source 1..32: mol_type = genomic DNA

SEQ ID NO: 106034 - DNA, 32 bp, Homo sapiens; identical to SEQ ID NO: 72450
  misc_feature 1..32: note = chr11:17743213-17743245
  misc_feature 1..32: note = Hyper
  source 1..32: mol_type = genomic DNA

SEQ ID NO: 106035 - DNA, 76 bp, Homo sapiens; identical to SEQ ID NO: 72451
  misc_feature 1..76: note = chr11:17743716-17743792
  misc_feature 1..76: note = Hyper
  source 1..76: mol_type = genomic DNA

SEQ ID NO: 106036 - DNA, 431 bp, Homo sapiens; identical to SEQ ID NO: 72452
  misc_feature 1..431: note = chr11:17756235-17756666
  misc_feature 1..431: note = Hyper
  source 1..431: mol_type = genomic DNA

SEQ ID NO: 106037 - DNA, 257 bp, Homo sapiens
  misc_feature 1..257: note = chr11:17756886-17757143
  misc_feature 1..257: note = Hyper
  source 1..257: mol_type = genomic DNA
agagagggagggggccggagcccgccctgcgtcccgagctgcagcccggccacgcagggaggaaggcaggcggcatccatctcccccgcgccgagagcgcgccgcggcgaccacctcacagaggagcgcgaatttcccggccctgtctcctcccctccccctcctgggggctggcctctagtccggccccgggagcggctgacctttcccccaaaagctttgtgccgatttctccattttcccgcggagatggggac

SEQ ID NO: 106038 - DNA, 77 bp, Homo sapiens; identical to SEQ ID NO: 33673
  misc_feature 1..77: note = chr11:17757704-17757781
  misc_feature 1..77: note = Hyper
  source 1..77: mol_type = genomic DNA

SEQ ID NO: 106039 - DNA, 45 bp, Homo sapiens
  misc_feature 1..45: note = chr11:17758041-17758086
  misc_feature 1..45: note = Hyper
  source 1..45: mol_type = genomic DNA
cctggcggcttttggcgccgctggcagccgcgcatctgggcgctc

SEQ ID NO: 106040 - DNA, 44 bp, Homo sapiens; identical to SEQ ID NO: 43028
  misc_feature 1..44: note = chr11:17784927-17784971
  misc_feature 1..44: note = Hypo
  source 1..44: mol_type = genomic DNA

SEQ ID NO: 106041 - DNA, 39 bp, Homo sapiens; identical to SEQ ID NO: 72463
  misc_feature 1..39: note = chr11:18033384-18033423
  misc_feature 1..39: note = Hypo
  source 1..39: mol_type = genomic DNA

SEQ ID NO: 106042 - DNA, 30 bp, Homo sapiens; identical to SEQ ID NO: 72464
  misc_feature 1..30: note = chr11:18231515-18231545
  misc_feature 1..30: note = Hypo
  source 1..30: mol_type = genomic DNA

SEQ ID NO: 106043 - DNA, 47 bp, Homo sapiens; identical to SEQ ID NO: 72470
  misc_feature 1..47: note = chr11:18512392-18512439
  misc_feature 1..47: note = Hypo
  source 1..47: mol_type = genomic DNA

SEQ ID NO: 106044 - DNA, 43 bp, Homo sapiens; identical to SEQ ID NO: 43029
  misc_feature 1..43: note = chr11:18656839-18656882
  misc_feature 1..43: note = Hypo
  source 1..43: mol_type = genomic DNA

SEQ ID NO: 106045 - DNA, 515 bp, Homo sapiens; identical to SEQ ID NO: 72484
  misc_feature 1..515: note = chr11:18742646-18743161
  misc_feature 1..515: note = Hyper
  source 1..515: mol_type = genomic DNA

SEQ ID NO: 106046 - DNA, 103 bp, Homo sapiens; identical to SEQ ID NO: 72485
  misc_feature 1..103: note = chr11:18743474-18743577
  misc_feature 1..103: note = Hyper
  source 1..103: mol_type = genomic DNA

SEQ ID NO: 106047 - DNA, 1494 bp, Homo sapiens
  misc_feature 1..1494: note = chr11:18812557-18814051
  misc_feature 1..1494: note = Hyper
  source 1..1494: mol_type = genomic DNA
gctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgcttgtgtctgtgccagtgtgtatgcgacgggggccgcgccgagctctgtgcgtctgcgtgtgcgggggcgtccgtccttcggtgcctccgtccttcggtccgtccgcctggcgctccgtcccgcgctccgtgcgcgctccctcgcccgaccgcctcaccaaatgcgcttcagctgcagagtcgctggcgcagccgccgggtgggtttggcaccccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcccgagcaactctgcgcggagtctccgcagtcgtcgcccccatgccaaggttgcttggacaaggagggcggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcagagttgggggagggagtcggctcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggcacgcacctgttttggt

SEQ ID NO: 106048 - DNA, 214 bp, Homo sapiens; identical to SEQ ID NO: 72492
  misc_feature 1..214: note = chr11:18950386-18950600
  misc_feature 1..214: note = Hypo
  source 1..214: mol_type = genomic DNA

SEQ ID NO: 106049 - DNA, 22 bp, Homo sapiens
  misc_feature 1..22: note = chr11:19137286-19137308
  misc_feature 1..22: note = Hypo
  source 1..22: mol_type = genomic DNA
ccacgcccggccagaaagctct

SEQ ID NO: 106050 - DNA, 632 bp, Homo sapiens; identical to SEQ ID NO: 72495
  misc_feature 1..632: note = chr11:19263417-19264049
  misc_feature 1..632: note = Hyper
  source 1..632: mol_type = genomic DNA

SEQ ID NO: 106051 - DNA, 707 bp, Homo sapiens
  misc_feature 1..707: note = chr11:19366652-19367359
  misc_feature 1..707: note = Hyper
  source 1..707: mol_type = genomic DNA
ccggggtggcgaggccgccgattggcagcgaggcgccatgtgaactgcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcctctcaagccacccggccgcagcatagataccgggcgagcggacgcatagccacccgtgcgcgatgacggccggcgggcccttgttcacagatgcgctgggaaactcttccccagcagatgcggggctgggcgcccggcgcagtgctccgaggctgctctgcgagctcgggggcgcactttcccggcctccagcgacactgcgcacgcccctatccggagtgggtgtgtgtccctctgggcgtacgtgcctgaggctgt

SEQ ID NO: 106052 - DNA, 321 bp, Homo sapiens
  misc_feature 1..321: note = chr11:19367810-19368131
  misc_feature 1..321: note = Hyper
  source 1..321: mol_type = genomic DNA
ctgctgtgcttgtgtcggtctgtgcctctttgctgtgcctgtctgtccatacgtgtgtatgtgttggtgggggtggtgtaggtggatcggatccgagccaagccgggggcaactaggccaggcctgcggttcccctggctctcgctctcccacgctccggttagctgcgggcggcgggctagggcgcgggcggggagggggcgcccgagcactgggagccgcggtgcctcccgggtgtgcgctccgctgagccggctcctttcttgcctgcaaagggactcaggcggcggcggtggcagcccgcgtcgcccagctggggcc

SEQ ID NO: 106053 - DNA, 179 bp, Homo sapiens; identical to SEQ ID NO: 43031
  misc_feature 1..179: note = chr11:19567961-19568140
  misc_feature 1..179: note = Hypo
  source 1..179: mol_type = genomic DNA

SEQ ID NO: 106054 - DNA, 93 bp, Homo sapiens; identical to SEQ ID NO: 72514
  misc_feature 1..93: note = chr11:19734973-19735066
  misc_feature 1..93: note = Hyper
  source 1..93: mol_type = genomic DNA

SEQ ID NO: 106055 - DNA, 80 bp, Homo sapiens; identical to SEQ ID NO: 72515
  misc_feature 1..80: note = chr11:19735404-19735484
  misc_feature 1..80: note = Hyper
  source 1..80: mol_type = genomic DNA

SEQ ID NO: 106056 - DNA, 51 bp, Homo sapiens; identical to SEQ ID NO: 72516
  misc_feature 1..51: note = chr11:19735709-19735760
  misc_feature 1..51: note = Hyper
  source 1..51: mol_type = genomic DNA

SEQ ID NO: 106057 - DNA, 673 bp, Homo sapiens; identical to SEQ ID NO: 72532
  misc_feature 1..673: note = chr11:20153534-20154207
  misc_feature 1..673: note = Hyper
  source 1..673: mol_type = genomic DNA

SEQ ID NO: 106058 - DNA, 1410 bp, Homo sapiens
  misc_feature 1..1410: note = chr11:20177593-20179003
  misc_feature 1..1410: note = Hyper
  source 1..1410: mol_type = genomic DNA
tctctttggggctaccgcagggccggtggcgccctcaatgaggtgatggtttctaccgtcgggagaggcagcatctgggcacggggacaaagtgaatgcgcagactggaccccacctcttcgatttcaaagcacttaaaaatagtactctggcgtgcgagcggcttctaggacacggtgatttcctcctgttcctcgccctcctcttcctcctcggaatctgagaagtccgaaggtttcccgggactgctcgagtgcgcgggcgaggggggcagcggccctggcagccgcgggtcccgcaggtgctgggggtcggaggacgcgtggtaggccaggcggtggctggggctgcccgggccctcctcctcctcttcgttcccagggcccttctggcccacgtcgctgaggtccgggtgcggattgagcttggtgggcagggtctgctcgcgacagcccccgctagacaggagttcgcgctccttggagttccgccatttcatgcgtcggttctggaaccagattttcacctggaatgtcccggccggcgagaagaagggagaagcagaggtcagatcaggggctccgggggacgcacgggggcggggagtggagtcgggtgcaggctctgtccttcgggctgtgtcctctccccacccccagaaatgagttccggtggattcccgcattgactccgcccccgcctcagctcgcggttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggattaggtaaaac

SEQ ID NO: 106059 - DNA, 30 bp, Homo sapiens; identical to SEQ ID NO: 72535
  misc_feature 1..30: note = chr11:20179512-20179542
  misc_feature 1..30: note = Hyper
  source 1..30: mol_type = genomic DNA

SEQ ID NO: 106060 - DNA, 506 bp, Homo sapiens; identical to SEQ ID NO: 72536
  misc_feature 1..506: note = chr11:20180320-20180826
  misc_feature 1..506: note = Hyper
  source 1..506: mol_type = genomic DNA

SEQ ID NO: 106061 - DNA, 892 bp, Homo sapiens
  misc_feature 1..892: note = chr11:20181185-20182077
  misc_feature 1..892: note = Hyper
  source 1..892: mol_type = genomic DNA
tgtctcctagaagctcgaaggcagaaacgcagacgtccaggagcgtgcgctcagcgttactgcaccagatgactgcgcacagtctccgactgcgtgtgctcaagttcactccgaggatggggcgagcctggaggcttttcttccccggaattgactggactattctcacattgcctgacgtagggtctcagagttcgtgcgtattgtgtgtgcaccgatgtgtgtgtgggggcccgctcgctagaggaaactgaggccaggatgactccgcgcatgcctagtacctgaatgggcccttagggttctgacctcgcttacctgttctgggccccgaggagaggatggcgttcactccaaacttcagaaacgtcgtctcgctggcaggggagaaggcagtcggcggagagccgccccgtcggctgccgggacccggggagcccaggtccgaggcccccgtgtcggtgagggccgtgggggccccctgcctgggcggcgacatgctggcggtgggcacgctgcggggcaggtaggcggggggtcggctgatgcggatcagatcctccaccaggaagctggagtggccggaaaatgccgactgcaaggactggggcagcgtcaaggtgggcgtgggccgcaggaggctagggtacccggcggggggcgcgaggaggccggggaacatcatggtaggcgcgggcgggcgaaataacccttctttcagtggccggagggtaaacgcctcgcttcccgcccctcccgcccccacagtgtcctctctcttgggcttagcaaacgtctccaagtaacaatcccacttgggcgtctgcgagtcctccgtggtcctctcgtcgaggtgatggttttatagtggcccgcccgctaaagcactttg

SEQ ID NO: 106062 - DNA, 280 bp, Homo sapiens; identical to SEQ ID NO: 72539
  misc_feature 1..280: note = chr11:20182831-20183111
  misc_feature 1..280: note = Hyper
  source 1..280: mol_type = genomic DNA

SEQ ID NO: 106063 - DNA, 382 bp, Homo sapiens; identical to SEQ ID NO: 72540
  misc_feature 1..382: note = chr11:20183391-20183773
  misc_feature 1..382: note = Hyper
  source 1..382: mol_type = genomic DNA

SEQ ID NO: 106064 - DNA, 35 bp, Homo sapiens; identical to SEQ ID NO: 72541
  misc_feature 1..35: note = chr11:20184112-20184147
  misc_feature 1..35: note = Hyper
  source 1..35: mol_type = genomic DNA

SEQ ID NO: 106065 - DNA, 987 bp, Homo sapiens; identical to SEQ ID NO: 33700
  misc_feature 1..987: note = chr11:20184500-20185487
  misc_feature 1..987: note = Hyper
  source 1..987: mol_type = genomic DNA

SEQ ID NO: 106066 - DNA, 30 bp, Homo sapiens; identical to SEQ ID NO: 72543
  misc_feature 1..30: note = chr11:20185714-20185744
  misc_feature 1..30: note = Hyper
  source 1..30: mol_type = genomic DNA

SEQ ID NO: 106067 - DNA, 379 bp, Homo sapiens; identical to SEQ ID NO: 72544
  misc_feature 1..379: note = chr11:20229217-20229596
  misc_feature 1..379: note = Hyper
  source 1..379: mol_type = genomic DNA

SEQ ID NO: 106068 - DNA, 120 bp, Homo sapiens; identical to SEQ ID NO: 72545
  misc_feature 1..120: note = chr11:20229900-20230020
  misc_feature 1..120: note = Hyper
  source 1..120: mol_type = genomic DNA

SEQ ID NO: 106069 - DNA, 112 bp, Homo sapiens; identical to SEQ ID NO: 33702
  misc_feature 1..112: note = chr11:20230398-20230510
  misc_feature 1..112: note = Hyper
  source 1..112: mol_type = genomic DNA

SEQ ID NO: 106070 - DNA, 81 bp, Homo sapiens; identical to SEQ ID NO: 72548
  misc_feature 1..81: note = chr11:20386484-20386565
  misc_feature 1..81: note = Hypo
  source 1..81: mol_type = genomic DNA

SEQ ID NO: 106071 - DNA, 30 bp, Homo sapiens; identical to SEQ ID NO: 72551
  misc_feature 1..30: note = chr11:20486737-20486767
  misc_feature 1..30: note = Hypo
  source 1..30: mol_type = genomic DNA

SEQ ID NO: 106072 - DNA, 36 bp, Homo sapiens; identical to SEQ ID NO: 72553
  misc_feature 1..36: note = chr11:20595699-20595735
  misc_feature 1..36: note = Hypo
  source 1..36: mol_type = genomic DNA

SEQ ID NO: 106073 - DNA, 1792 bp, Homo sapiens
  misc_feature 1..1792: note = chr11:20618182-20619974
  misc_feature 1..1792: note = Hyper
  source 1..1792: mol_type = genomic DNA
ctggctaattcagaccgaatggctgcgcggtgatggatgcggatttacggcctccttggctgcggcgcgctgggcctgattatcactataaacaggcgtccgcggagggcgggggcggaggcccgcgtctagaggacgtgcggctggtcttcttcttcttcttcttctttttttttgtttttgttttttaatactgcggttccatcctctgcgcttcgtaggcgctgacacacacccatacgcacgacctgctgccccagggcctggcttcctgcctccgcatgctctctcccgcccctgaagcccaaccttcaagccctgctgatgcccgcccctccgtcccagcgttggcctcatagcgaaccctcttaggcctctccgttccagaccctccctccattctccacgtagcccctcccttctagaatcttgcggctgaaagtgggggcaggcggggagcccgaatagcgcctcagccaaaccccgcagccgttcctgcgcgtcacccgcctctgcagagcctgacgcgcggcagtctccacgccggaacccaagtgctcactgggccggggagggccagcgggcgaaatatcaggcctgggggctgagcgggggcgctgggcgtcactcaggcccagggccgcagctgggggaagtgagaaggccggcaggattctgcccactctgcgcagttctcccttcctcccggggcagccaagtctgtgcgccctggaacgtccgggcgccgcgtagactctccattcgcacctggccctttgcgggggctgctcaaatgcaaattgggaaactggccagaaccttccaaagtcgtgactgtccctcggggaagtcggccggggaaccgcagagggaggcctacaccgatctttgggcccgcctcgtggtaccgctccggccgatcgctctctgagcccgagcctgcctgccaggcctgccttctacagttctcgcattcgtcttgagccctctcggaaactggggactgtttaggcagaaacactcgtaggtccccttggcgtcccccaagatgccaagagcctgcggggtgcttctcagcgccagccggaacttgagcaggcacccctgcggaattctcagtcccacccactcagacgaccctcctccagccagagtccaccacagcccaccctaccctcttaaccctcgttcccgacctctccctacgagcgggccccggggagagagcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccctttagaggggctaggcgggaaagccaaccagcggaggcatccaaacactctcgggctctccagaggagcaggagggtgccccttagtgcccccggcgcccgccgcaatctgccactgcagcctacgcctgcggccgcggccgccgcggcattgtcctcccgccgcgtgggacggcccagccgctggcgacggcgcgcaccccgaggcagtgggctgggctgttggcagtagggaagggaaaacgtgctgtctgtggc

SEQ ID NO: 106074 - DNA, 54 bp, Homo sapiens; identical to SEQ ID NO: 72557
  misc_feature 1..54: note = chr11:20620247-20620301
  misc_feature 1..54: note = Hyper
  source 1..54: mol_type = genomic DNA

SEQ ID NO: 106075 - DNA, 260 bp, Homo sapiens; identical to SEQ ID NO: 72558
  misc_feature 1..260: note = chr11:20621539-20621799
  misc_feature 1..260: note = Hyper
  source 1..260: mol_type = genomic DNA

SEQ ID NO: 106076 - DNA, 1050 bp, Homo sapiens
  misc_feature 1..1050: note = chr11:20622578-20623628
  misc_feature 1..1050: note = Hyper
  source 1..1050: mol_type = genomic DNA
tctggacctgagttgcgaacgtctccatatctagatacaggtattttaaaagctgttgtgactttgttttgcacgaacttgacattgtgtttgcaggattgcagtgctcccaaggaaatgaataaactgccagccaacagcccggaggcggcggcggcgcagggccacccggatggcccatgcgctcccaggacgagcccggagcaggagcttcccgcggctgccgccccgccgccgccacgtgtgcccaggtccgcttccaccggcgcccaaactttccagtcagcggacgcgcgagcctgcgaggctgagcggccaggagtggggtcttgcaaactcagtagcccgcgggcgcaggcggcctctgcagctctgcgggacttgagagaggcgcaaggcgcgcaggcctcgccccctcccgggagctccgggcccggcaacgcgctgcactgtaagatcccttttctgcgaggcccggagggggatgcgaacgtgagtgtgggcaagggcaccctggagcggaacaatacccctgttgtgggctgggtgaacatgagccagagcaccgtggtgctggccacggatggaatcacgtccgtgctcccgggcagcgtggccaccgttgccacccaggtaagcaggttgcattacggcccgcacagtgtcctgctctccagctgcgcgagagaggccagccgggccgtggcgggtgcacgtatgctgatggggaaaccggttggcagtgccaggtgatggatgcgggaggcggctttggggcttcggaagctcgcactgcgctggggtcggcagttcagggcgcgagggctgcagtgaccctgccagaggggccacgacctgccccttcccagccttggcggtagcgggaatacaggtccagatccacgaaagagttgaggaagatagattccacccttttatgcagacagactccctctcctgccaatgactgtcttttcttttcaaaaataatttcttaattaaacaaaaagagggttaaaattcagaacaaagccacgtggtggtggctgg

SEQ ID NO: 106077 - DNA, 19 bp, Homo sapiens
  misc_feature 1..19: note = chr11:20672510-20672529
  misc_feature 1..19: note = Hypo
  source 1..19: mol_type = genomic DNA
cagacgcctgttcttattg

SEQ ID NO: 106078 - DNA, 2569 bp, Homo sapiens
  misc_feature 1..2569: note = chr11:20690388-20692957
  misc_feature 1..2569: note = Hyper
  source 1..2569: mol_type = genomic DNA
accccaaccacagctcgctccgcctcgaggaccccttttctgcacccccacctcagcgccctcttcctgcacccacaaagagagtactcagtcataggggttcaacaggagagaggagacagaaggtacaggcggtgagcagggactcagccatcatccccctcaggtccctccccacccagttgacagagcgaatcccgagtaattgttttccgagggggtccgtgcgcgctcggtggcgccgcctcggtctgggttcccccgaggaaaaatacccacccgcgagggctcggcggcttttcgactcggcggggatgaactgtggcaacttcggcagcccccaccgcggtgcggaagtaaagagggcaacattggcgactgcggctcggaggggctggagcgcgtgaagccgtgggggcgccgtgcgcctcccgctctctcgtttcggccgcaggtcctgggactccgacttcggtgctccgggtgatagcggctgcggcgcctgcagtccagatcctcgcagttctgcgggcgaaggaggcgaacggaatcggcccccagtggggagcgcaacaagccacagtagccaaaccccgcgctcctgcccgggctcccagacgaacgcagccgcagcggggggccgggccccgagccccacgccgccgccgccgcgccagcggtggggggcgggctgggggcggggcggccggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacaggtaagcatgactgtggcggttagagggatccgggaaatgggggtgcccacagaccacggcggcgtggggagacctggagccgagctttgcgctggtctggggaacggcggtagcgtggaccggttcctgggatctctttgccctgctcggagtgacagggtgaaaatagggactcacgggcttgaagatgtccccgttgagtgccccttctcaggggacccggcctcaggggcgcaggagtgaggggcgcggccgagtaggcgcaccctcttgctgctagtaaccggctttccgtcccagggagtcgaaacccgcagcagggcgggcccgcgtgccccgagttcccgaacttgtaaggtgctgtggaaaccactctcgccgacccccgccaggctgggaaggggtagctgcgggagtcgcacccgcagagggagcgcttccggctggcgggcgcggccggggcccgggagggcgcggtgcggcgagggcagagagctgcgggagaaccctgggatcccgcgatctcctcctgtgccttcctgactacccaggagaactccaggagtattctcctccgcctgtctttgctcccaagggctgggcgaacaattatctgagggaaatagagcagtggagacaatctggggaaattttctcaagctcaaaccagttttctcttgccataatcgcagggttccgtgtggggaggggggagcaaggatgacgcttgattgtctgaagtccccacttcgttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggagagggctaagaaggggcgtctgcacttggttggctcaaaagttccctccgcttgcgcccaggcgcccctctttggcagttagcccgctggaagatctagcgtctaggagctttcagagggcccttcccacttccccaggactgagcaggcagcggctttcgtctggttaagaatgttgaatatggatttctcaagggacaaaagaaacctcccattccgttccttacctctatccgagcttcccaggctgcggagacgccaaggctcagtctagcttagaatagttgcttcttgagttcaggcccatccggatgggttagtcttttaaaaccaggacacgctgaaggagtgcgcgcaccccaggaagatcaggacaggcaagactagtgcagagcgtgggctactggctctgagcgcgagagtctggtgctcgtggacatcttacagaggaaccgcagacaggaagaagctaggtagggagggggcaacccgttagtgagttcac

SEQ ID NO: 106079 - DNA, 27 bp, Homo sapiens
  misc_feature 1..27: note = chr11:21017124-21017151
  misc_feature 1..27: note = Hypo
  source 1..27: mol_type = genomic DNA
aaaaaaaatcagcgtctataaattgct

SEQ ID NO: 106080 - DNA, 1061 bp, Homo sapiens; identical to SEQ ID NO: 72582
  misc_feature 1..1061: note = chr11:22214360-22215421
  misc_feature 1..1061: note = Hyper
  source 1..1061: mol_type = genomic DNA

SEQ ID NO: 106081 - DNA, 328 bp, Homo sapiens
  misc_feature 1..328: note = chr11:22359172-22359500
  misc_feature 1..328: note = Hyper
  source 1..328: mol_type = genomic DNA
ggtttccatagcatccgttcctgaagagcccccgtatggtccttggtcagggcgatccgcccagctcccctagaaagttggcaacctagctagccaaaagaagagtcccctattcctgaaacttactctgtccgtggtgctgaaacattgtaccgagacccgcccagacgggcgctgtcagccgctgaaaaaaaaaatcttccccgaggctgcccaaatcagaactgtgtatcttttatttactcacgtcctcaaagagcagcaagccttctccatcttaatttgactctaccgcagagcagacttacgctggcgtgatgggaggaga

SEQ ID NO: 106082 - DNA, 136 bp, Homo sapiens; identical to SEQ ID NO: 33720
  misc_feature 1..136: note = chr11:22359746-22359882
  misc_feature 1..136: note = Hyper
  source 1..136: mol_type = genomic DNA

SEQ ID NO: 106083 - DNA, 92 bp, Homo sapiens; identical to SEQ ID NO: 72588
  misc_feature 1..92: note = chr11:22361451-22361543
  misc_feature 1..92: note = Hyper
  source 1..92: mol_type = genomic DNA

SEQ ID NO: 106084 - DNA, 30 bp, Homo sapiens; identical to SEQ ID NO: 72589
  misc_feature 1..30: note = chr11:22361815-22361845
  misc_feature 1..30: note = Hyper
  source 1..30: mol_type = genomic DNA

SEQ ID NO: 106085 - DNA, 708 bp, Homo sapiens; identical to SEQ ID NO: 72590
  misc_feature 1..708: note = chr11:22362501-22363209
  misc_feature 1..708: note = Hyper
  source 1..708: mol_type = genomic DNA

SEQ ID NO: 106086 - DNA, 815 bp, Homo sapiens; identical to SEQ ID NO: 72591
  misc_feature 1..815: note = chr11:22364799-22365614
  misc_feature 1..815: note = Hyper
  source 1..815: mol_type = genomic DNA

SEQ ID NO: 106087 - DNA, 482 bp, Homo sapiens; identical to SEQ ID NO: 72592
  misc_feature 1..482: note = chr11:22688123-22688605
  misc_feature 1..482: note = Hyper
  source 1..482: mol_type = genomic DNA

SEQ ID NO: 106088 - DNA, 50 bp, Homo sapiens; identical to SEQ ID NO: 72605
  misc_feature 1..50: note = chr11:23326514-23326564
  misc_feature 1..50: note = Hypo
  source 1..50: mol_type = genomic DNA

SEQ ID NO: 106089 - DNA, 45 bp, Homo sapiens; identical to SEQ ID NO: 72614
  misc_feature 1..45: note = chr11:24518383-24518428
  misc_feature 1..45: note = Hyper
  source 1..45: mol_type = genomic DNA

SEQ ID NO: 106090 - DNA, 57 bp, Homo sapiens
  misc_feature 1..57: note = chr11:24518643-24518700
  misc_feature 1..57: note = Hyper
  source 1..57: mol_type = genomic DNA
gtccgttcgtgtgcccgtctccgcctttccgcctcggaagagcgctcatcactggct

SEQ ID NO: 106091 - DNA, 24 bp, Homo sapiens
  misc_feature 1..24: note = chr11:24945189-24945213
  misc_feature 1..24: note = Hypo
  source 1..24: mol_type = genomic DNA
ccaagatcgcgccactgcactcca

SEQ ID NO: 106092 - DNA, 30 bp, Homo sapiens; identical to SEQ ID NO: 33725
  misc_feature 1..30: note = chr11:26353691-26353721
  misc_feature 1..30: note = Hyper
  source 1..30: mol_type = genomic DNA

SEQ ID NO: 106093 - DNA, 30 bp, Homo sapiens; identical to SEQ ID NO: 72631
  misc_feature 1..30: note = chr11:26472646-26472676
  misc_feature 1..30: note = Hypo
  source 1..30: mol_type = genomic DNA

SEQ ID NO: 106094 - DNA, 136 bp, Homo sapiens; identical to SEQ ID NO: 72633
  misc_feature 1..136: note = chr11:27495243-27495379
  misc_feature 1..136: note = Hypo
  source 1..136: mol_type = genomic DNA

SEQ ID NO: 106095 - DNA, 75 bp, Homo sapiens; identical to SEQ ID NO: 72634
  misc_feature 1..75: note = chr11:27495679-27495754
  misc_feature 1..75: note = Hypo
  source 1..75: mol_type = genomic DNA

SEQ ID NO: 106096 - DNA, 50 bp, Homo sapiens; identical to SEQ ID NO: 72638
  misc_feature 1..50: note = chr11:27720970-27721020
  misc_feature 1..50: note = Hyper
  source 1..50: mol_type = genomic DNA

SEQ ID NO: 106097 - DNA, 115 bp, Homo sapiens; identical to SEQ ID NO: 72639
  misc_feature 1..115: note = chr11:27722537-27722652
  misc_feature 1..115: note = Hyper
  source 1..115: mol_type = genomic DNA

SEQ ID NO: 106098 - DNA, 251 bp, Homo sapiens
  misc_feature 1..251: note = chr11:27739988-27740239
  misc_feature 1..251: note = Hyper
  source 1..251: mol_type = genomic DNA
gggaagggtgggtggcgatggtgatgcgggcgccttggagttcctttgcagcacgcttggaattgcatcagactgatcagaaatccccccgcccccaagctcagcccctcccgccacgctcccctgcccgcccctcccctcccctcccttcgcgtagatctgactgagaaaacgactggatctcggaacaatctgtgccccattcgctgcaggcttgctccgtaaaccctgccctacgctccctttgtgtg

SEQ ID NO: 106099 - DNA, 30 bp, Homo sapiens; identical to SEQ ID NO: 72641
  misc_feature 1..30: note = chr11:27740463-27740493
  misc_feature 1..30: note = Hyper
  source 1..30: mol_type = genomic DNA

SEQ ID NO: 106100 - DNA, 88 bp, Homo sapiens; identical to SEQ ID NO: 72642
  misc_feature 1..88: note = chr11:27740898-27740986
  misc_feature 1..88: note = Hyper
  source 1..88: mol_type = genomic DNA

SEQ ID NO: 106101 - DNA, 30 bp, Homo sapiens; identical to SEQ ID NO: 72643
  misc_feature 1..30: note = chr11:27741900-27741930
  misc_feature 1..30: note = Hyper
  source 1..30: mol_type = genomic DNA

SEQ ID NO: 106102 - DNA, 30 bp, Homo sapiens; identical to SEQ ID NO: 72644
  misc_feature 1..30: note = chr11:27742185-27742215
  misc_feature 1..30: note = Hyper
  source 1..30: mol_type = genomic DNA

SEQ ID NO: 106103 - DNA, 125 bp, Homo sapiens; identical to SEQ ID NO: 72645
  misc_feature 1..125: note = chr11:27743048-27743173
  misc_feature 1..125: note = Hyper
  source 1..125: mol_type = genomic DNA

SEQ ID NO: 106104 - DNA, 1325 bp, Homo sapiens
  misc_feature 1..1325: note = chr11:27743419-27744744
  misc_feature 1..1325: note = Hyper
  source 1..1325: mol_type = genomic DNA
actcagcctgcacaccgctcccttgcccactacgcaggtcacacctggggctccggcgaagctgaattcggctcgggagatttccctgtcgccaggtaagaaaaccttcgccttgtcaggctagggcgggaagaccgctggggaacttgttgcttatcagcgccggcagactaccgctttaataataataccagaaaagcgcagcagggagggggtggggggcggcaacggcgacgactaacctcgctgtttacgtgaccgactcactgtgactctctgggtaaaaaaaggaaacttcttagaaaagttcgtgcccctccccctcccccatcatgactaagggtctccagccgatgaggtcgtgagtgatgatcaaatggggactggggggaggggggcgagtaagtgacttgtccttgggaacatctgcatgcgtcgaagcgcgaaccagcccaacaactttcccttttcctcttaggtactgatgactaggcgagaggcaccaaggcgagccactagttgcccacaggaacctgtgtaagccgagctctcgagcggctgagttgaatgaagttatgactgcgtttgctctaatgggttatggcttcccaaatgtgagttaacagccccggtgcgcagctaggtcggaaggcgagccgcggagagcggagccgcgggccaaggcagggacgggaggggaggcggcaggttgggcgctccgctgctgctcggtgctgcttccccggagccgcttcctcatcctgcgggggctgccccgccgccggggtgccggggtgagcgcggcgggagccagggctggggtggcgaacctcggagggggctctcccaggaagccctgcggttagcgcccgcgcttccccaccagtggctgcgcaagctgggaagcgaagaggtcacgtgttggcggaaagtaacttggaggcgaaaggatgaactttgagaagaggaaaaaaagcacaatgaaacaaactacccccttggagtgtctaatagagggggaggcgggagggggggcggaggggcgccgctctccgcgggagatgtggggacgactccggaaatctcgggaaataggcaataactcgagctttggcaacgtcccccagcctagggaggcgctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccagacgcatttcaggtttcgtcgttttggcactgac

SEQ ID NO: 106105 - DNA, 81 bp, Homo sapiens; identical to SEQ ID NO: 72664
  misc_feature 1..81: note = chr11:29581595-29581676
  misc_feature 1..81: note = Hypo
  source 1..81: mol_type = genomic DNA

SEQ ID NO: 106106 - DNA, 381 bp, Homo sapiens
  misc_feature 1..381: note = chr11:30037614-30037995
  misc_feature 1..381: note = Hyper
  source 1..381: mol_type = genomic DNA
aaatatacacttcaacgcacgccatttatgcagcccctatgtatgttgctcaaatgctcggaaaatgcacgcaaatccaaacgttggaagaggcagcaattcagacccgttcaccggctgttcccaaaagaagggaaccggtgcggctgggaggaggcgaaacgatgctaaatcttaacccccctctcgttgggaaacgacatctttaatcgcgccctcgcctccagacctcggttcccgctccagcacgttaagcagggcgcactcaccgcatccccgggtttgggaaaataacaactgttggccccccggagcgccgcgcagcatccgcacctcccttctcccacctcctggtttatttttaaccgccttccattcatg

SEQ ID NO: 106107 - DNA, 1239 bp, Homo sapiens; identical to SEQ ID NO: 72668
  misc_feature 1..1239: note = chr11:30038294-30039533
  misc_feature 1..1239: note = Hyper
  source 1..1239: mol_type = genomic DNA

SEQ ID NO: 106108 - DNA, 152 bp, Homo sapiens; identical to SEQ ID NO: 72669
  misc_feature 1..152: note = chr11:30040150-30040302
  misc_feature 1..152: note = Hyper
  source 1..152: mol_type = genomic DNA

SEQ ID NO: 106109 - DNA, 40 bp, Homo sapiens; identical to SEQ ID NO: 72670
  misc_feature 1..40: note = chr11:30409640-30409680
  misc_feature 1..40: note = Hypo
  source 1..40: mol_type = genomic DNA

SEQ ID NO: 106110 - DNA, 44 bp, Homo sapiens; identical to SEQ ID NO: 72671
  misc_feature 1..44: note = chr11:30605841-30605885
  misc_feature 1..44: note = Hyper
  source 1..44: mol_type = genomic DNA

SEQ ID NO: 106111 - DNA, 464 bp, Homo sapiens
  misc_feature 1..464: note = chr11:30605945-30606409
  misc_feature 1..464: note = Hyper
  source 1..464: mol_type = genomic DNA
tctaggctcacggctggctcttcccggctacaacttccccttccttcctgaaacaccagcgccttactcgctcagtcccccgttgccacctccgtcacctcctcggccgccgctcctgctggcactgctggcgctagcgctggcggccccgggctccgctggacgcctatcttttttctctccctcttccctagctctggattgattgatgaccaccggcggccaatggctctgacaccacgccatcctcggtcgggcatcacagccccacgtccccgacctcagcctcccgggcgcgttggcatccccgaacccacagcgctgagcccgagcccggggccgccgcctcctccctgctctacgcctgggcgctgccaggttccttccctggaacggcggagaaaggaagggagggagccagcgagcgttggaagggggtgtggaggccacgggatctccccctc

SEQ ID NO: 106112 - DNA, 1111 bp, Homo sapiens
  misc_feature 1..1111: note = chr11:30606651-30607762
  misc_feature 1..1111: note = Hyper
  source 1..1111: mol_type = genomic DNA
cttcacctcctaggccgcaaaaccccggaattcaaaggctttacaaagataaccttgttatacgtaaatagcaaagaaactcctgcctctgtagagaagaaatccggcggcaacggttacttttcctcggtactcgtcccccgtcgcctagcctcgaccccagcttgggtcgccgggtcgctccgcaggctgcgagcgcggagacccaggcagcggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagtaaacagctcgctgagccctcgtccccacccccatccccgccgcccggcttccccagcttctcgccgataccccctcctctcctcctaagaaatcctggcggaggagggagcgaagaggtggggacccccagaggtcgggggactgatggctggagggggtggagaagagaagaggcgcaggatggggagtcggagggaagacacctcctaaaaaagaatttgctttcgctcaggggttgaaaatcagccctccccgagcgccgaattgcccgggaggcgcccgctcgtgcggatgtcaggggcaccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgcaggctggggctg

SEQ ID NO: 106113 - DNA, 121 bp, Homo sapiens; identical to SEQ ID NO: 72677
  misc_feature 1..121: note = chr11:30608098-30608219
  misc_feature 1..121: note = Hyper
  source 1..121: mol_type = genomic DNA

SEQ ID NO: 106114 - DNA, 177 bp, Homo sapiens; identical to SEQ ID NO: 72685
  misc_feature 1..177: note = chr11:31533680-31533857
  misc_feature 1..177: note = Hypo
  source 1..177: mol_type = genomic DNA

SEQ ID NO: 106115 - DNA, 144 bp, Homo sapiens
  misc_feature 1..144: note = chr11:31818452-31818596
  misc_feature 1..144: note = Hyper
  source 1..144: mol_type = genomic DNA
gacgcgctccgctcacgtgtgcgggcacaagcgtctgtgctaatttactgccccaagtttccggggacttttcaaagcgtttttcaagggaagaaatgaagcgaccacccccacccctcgctttattttcgggtttggtgaaga

SEQ ID NO: 106116 - DNA, 2476 bp, Homo sapiens
  misc_feature 1..2476: note = chr11:31819302-31821778
  misc_feature 1..2476: note = Hyper
  source 1..2476: mol_type = genomic DNA
ctagaagttggatctcgactcccccacccccacgataaacctaagtggtggacaattaagatatcttcttcaaaaggcgccccctcggagccgcgcaaagcaggggccttcagtgggtgccgttcaccttccagcctaatccgtgagaaagcgagtgaaagcgcctcccattatcccagccccaggaccatctgacgatgggaataggatttgtttcctggaaggaggtgagagagagagagagagagagagacagagagagagttgctgggaaataaaatcattccttagtttcttagtgtcttaatcagtgaggcggaaaacaagcaagaaaagatagcaacccggttgcggcaccttttcagctctggagcgcggatcaaaacattgtagcatctgttgaaagagaggctgactaaatcctatagagggcttgggtattatggggggtgggggtggggtgaggggaggagataagaaaaagtgtctccgtgatccctaaaaccaccaaatcgccggagaattggggctggatagagttgtctcttgttgttgtcagcccacgtcgtcgcgattttattcaccgccgcatggcgttgatcagatggaaaccatatttgtctccctctgagacctaacccccgccttatgcttttggagtatggactctttaaaacccaagaaaggcttcctgggctgggaaagggggctagggagggagggggaccctcttagcaccaaaaagtctgaggattccccgggaacgtgaagcgaagctcaccaccggtgcccgctacccccacgccggcaactctgtgcttcgtttggcccacgtgtcctccccacgcaactaggggcgacggtcctgtgcctgaggtgacaatcaccccccaaaaacctcacttgcgggtgggggggtggtgattgccagttgacccagaattttctagcaactaggcgcgttaaagtgaaaagcccctggactagctccacctccggccccaaccatcacaggcggaccctagctgatttgactctcacttcccgccctcagactgccggcgacgaaaatccgcccgaatcgggcgccacctctggtggaagctgctgtcctcggcttctgcccaactccaagaagcggaaggggggtgtatcctgcgccccaagctcatgggagcccacgcaccggggagagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccgcgctgggaaacaagaagcgagcgctttgctccctatcttcccagtgtccgtcctatattgttttctgctcttaaaactgacatgtctaattggcaattggtgccgaatcgtgtccagaggtctcttgtggaacatttctacagctgtctccttcaactagacgcttattcatgtcgccttaatgagaaacaaaacgttctctaatgagcaattacagagcgacaggattgttcccataacaaattcttgcgagtgacagaagcatcctttgtaccagatatttcgcatactgttaccgattttcccttccctcgcccgactccatggaggcgccgggcatccggagccggtccgagagctcacggatgcgccggcagcctcctcgcagtcccgcgcgccgcccctggccccgagcccctcggctccgttgtgctcctgggagtgagacgccacgtcccattatcccgcatattatctccttgtcacgaggacaacaaataccgattaatcttcggagtaaactgtttcctattcttgaccaagctacctcggggtgtggaggggagcggaggggagccaactgaccctcccctccgccccaccccccccatcccccgctcttcttcctccagcccttctcacagaacctggggtgtttcaggtcccatctctcctcccagaccagagcggctcccggcatcccgccgtcctgctcacagtatcttcacctcaccacttccacatagtcgccacccacagagagtgagaaagtgggacccagaggggcgaacgggggaggggcaaggatagtggggtggttttagttgggagaccaccacttccaatgccccatccccgactcgccctgcatctccc

SEQ ID NO: 106117 - DNA, 706 bp, Homo sapiens; identical to SEQ ID NO: 72693
  misc_feature 1..706: note = chr11:31822002-31822708
  misc_feature 1..706: note = Hyper
  source 1..706: mol_type = genomic DNA

SEQ ID NO: 106118 - DNA, 87 bp, Homo sapiens; identical to SEQ ID NO: 72694
  misc_feature 1..87: note = chr11:31823165-31823252
  misc_feature 1..87: note = Hyper
  source 1..87: mol_type = genomic DNA

SEQ ID NO: 106119 - DNA, 1126 bp, Homo sapiens
  misc_feature 1..1126: note = chr11:31824154-31825280
  misc_feature 1..1126: note = Hyper
  source 1..1126: mol_type = genomic DNA
gtccataattagcatcgtttacagtaagaaatgaagagagggcgttgagagtggagggccgcgggggcggcgagtggggcggcgccgggaggatcacctgcagaattcgggaaatgtcgcacggccgggccccgctgtgagctagctctacaatcttctgccgggtggagtccggcagtggccgcccgttgacaaagacaccaccgagctgattcactccgctgtgacctgaggaaagggagaggagaggaaaggggaaaagaagagaagagagcagagtgaagaggaagaagagggagaagaaggaagaggaagatgagggagaacaagaacagaaaggagaggaggaaggggaagaggaagaaggagaggaggaggagacaaccacaatgcatcctcatccccctgccaacctgtgccaacctcggcggtcagttccctgctatcgatcaaataaaggacaacaggaccaccagccatgccagacatcgggcagcccagtccaagcaaccgtgcccctgcccactgtactgcagcagcaacacagagtcagacacatgccaaggaacaagtacacatggacctcactacagccataaccccagcagtgtccccagcccactgcccctcttcataaacactgcagccagcctctgaacccacaaagcgctaagaaccggctctataaatctcccaaagatcccctctgagtgtcaccgcaaaccatgggttctacagatcccacactgaaccttcaaggtctctgcagtgttgggacagtgatagcaaaccttacagcccttgagtgctcccttagacgctaaaatccagaaatgtttccatcaccgtccaaactggccaaggcctggcacaagcatcgagttgggttttgtttggttagaatagaagaaggaagaggagagaacaaccagagcagccagtatgtggctggtgaaccccagtccaggtttccgcacctccagtgcagacgtgagagtcagagcccgggctcggcttcagccacagacaagtccggccaccgcaagtaaggcttagagccgggagtcggttcgcaccagccactgctcgctttatttccgccgctgaactccgccctccccttagc

SEQ ID NO: 106120 - DNA, 2464 bp, Homo sapiens
  misc_feature 1..2464: note = chr11:31825590-31828054
  misc_feature 1..2464: note = Hyper
  source 1..2464: mol_type = genomic DNA
tactgataaattgacgccaggagcctgagcttcttagcaataaataagctccaaatatagaagaggggggaaaatatgatgagcctctctgacatttgtctttaaaataaaactagctgcacgtcaagtttgagcttaatttctggaaataggcggaagtcgctccggatcatgcatggaaggctaattgaaaagatcagtcggggcgcttgtggcagccttgtcactttgtgacagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtgacaggcgtttgggggatctgggctccggccgggaccagcgcaagcagggactttgcggggacaccgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggccgcagcgacaaacgctcagggctgcgcgccctggctggggcccgcccgagagacagcctgcggctggggagtctgagctccaaggggagagcccagccgccgaaggcgagcctaccggccaagccctggggtccggcaggttctgcacaactactcccgcaaagctcgccacctttgtgccctttcctcagctacgcgcttaccagccccggaagcaccagggggcgaccggcgtttccaaaacagatggataaggtgctggggaccctccttaagcctgtgtggttcggccagggcaggctgctggaagacccgggcctttccacactttgagttcagttgagccccgacgccgtgtgcctcaaccgtaacctcaaaccgggcctggtttcgctgggcctccaggctcccaggtcggagctctagactagccctgccgcgtaccagcacccaccacgaacaggaaggtgggtgggaccccacggggtctgggcagaggaaagcagggaggtacaagggccataagtatcaaaagcgctctgggcctgggactatcaggacccaagcaattgcagttgccagggcagggattttccaattcctgggcacctccttaccagacccagtaaaccgtgctctctcccgcgccctgtaacagcgagtttaccacccctaccctgctgcaggcctgggggctcctctccccatcccttctaggcccgtagtggggtgaggaggggaggagctgccctgagagtgacttggggagagaagcccccaaccccgccgggttggtggagactttcagtcttggctaagcccaaaggggcctccttctcgctcaactaggagaagacttcgccccgccctgatcagcccagcccctctctccggggtcagagcccgggcaggggcgagagggggtgtgagttacaggatttgggggggatggggtttctctaccgcagcttcgaaaactcgggcgggctgttcttaagggcccagcccctgcttctccagtatcgagaagagccaagcaaacgccctcccctcccgggctgccgggcgcggagcggggagcagccgccgcaggtccccgggcctcagtcggtcggcggccgggccagcgcgggcgtcgcgagtccctgtgtcctcccctgaccctcgggtccgcgcaccccgagcccgaagtcccagaaagaccagaggcacttactgttctgcatgctggctctggctgggggccgcgggattccacggggctcgaatatggggctctgttagcaagaaaataggagttaatcctcgggcagctgcatca

SEQ ID NO: 106121 - DNA, 480 bp, Homo sapiens; identical to SEQ ID NO: 72701
  misc_feature 1..480: note = chr11:31829116-31829596
  misc_feature 1..480: note = Hyper
  source 1..480: mol_type = genomic DNA

SEQ ID NO: 106122 - DNA, 99 bp, Homo sapiens; identical to SEQ ID NO: 72702
  misc_feature 1..99: note = chr11:31830319-31830418
  misc_feature 1..99: note = Hyper
  source 1..99: mol_type = genomic DNA

SEQ ID NO: 106123 - DNA, 660 bp, Homo sapiens; identical to SEQ ID NO: 72703
  misc_feature 1..660: note = chr11:31831479-31832139
  misc_feature 1..660: note = Hyper
  source 1..660: mol_type = genomic DNA

SEQ ID NO: 106124 - DNA, 566 bp, Homo sapiens; identical to SEQ ID NO: 72704
  misc_feature 1..566: note = chr11:31832589-31833155
  misc_feature 1..566: note = Hyper
  source 1..566: mol_type = genomic DNA

SEQ ID NO: 106125 - DNA, 248 bp, Homo sapiens; identical to SEQ ID NO: 72705
  misc_feature 1..248: note = chr11:31833517-31833765
  misc_feature 1..248: note = Hyper
  source 1..248: mol_type = genomic DNA

SEQ ID NO: 106126 - DNA, 156 bp, Homo sapiens; identical to SEQ ID NO: 72706
  misc_feature 1..156: note = chr11:31834086-31834242
  misc_feature 1..156: note = Hyper
  source 1..156: mol_type = genomic DNA

SEQ ID NO: 106127 - DNA, 375 bp, Homo sapiens; identical to SEQ ID NO: 72707
  misc_feature 1..375: note = chr11:31834473-31834848
  misc_feature 1..375: note = Hyper
  source 1..375: mol_type = genomic DNA

SEQ ID NO: 106128 - DNA, 1337 bp, Homo sapiens; identical to SEQ ID NO: 72708
  misc_feature 1..1337: note = chr11:31835180-31836517
  misc_feature 1..1337: note = Hyper
  source 1..1337: mol_type = genomic DNA

SEQ ID NO: 106129 - DNA, 3349 bp, Homo sapiens
  misc_feature 1..3349: note = chr11:31836824-31840173
  misc_feature 1..3349: note = Hyper
  source 1..3349: mol_type = genomic DNA
ttcatcaccctgtgacgatccccccatctctcttttccctgtaacctctgcccccaagaggcaagagttcagcttcaaaggaaaagcaagcaagtcaaggccacctcagtcccttctccctggatatcccctctctaaaccgctgcctattctaaaggccaacgacccggtcctgcgatttgtcccgttgtagacctgggaacaggcaggcgggaactgggggctttactgggggatttgaggctggggagggggagggagcaaatgtcatggctggctcgctcaagcatccagggaaccgaagctaagcgcatcctgacgggcttttaaaatgacattgattaggacaagctgttcccaaccccagtaagagttaatctgcctgttaatcaaggcactaaggggctcaatgcgagttttattagcgacaggagaacagaggcggcagccagggatcaaaagccgggatcccatatatttgtcagcgctatctccaaaaaaaaaaaaaaaagtattttcaatttgaaaacaattcggcgcttttcgtcacttcctaacccagtctcacagagggtgacttccaaacctggctagcggggaaaaccgctgcccgggggacagaggggctgacaggaactgcgggttggctcagccgaatgcggccggggagaatttaagaattctcagcccgcgcggcccgatgcctctgattcctcacgagaggaaagggaatgaaaaatgaagcaacaaatgacaccacccaggctggcagccctcgttcccggccagaccccgctcctcaggcccggctctggcgccgggtggcgtccagcccctgcacgcgcggcgcggcccgcgggaaagtttgtgcagcgagagtgactgtccttccgcctcgcgcgcgctgcccccttctgccccggaggggcgttgggttcccttcggttttcctttccaattctaaaataaataaataaactccgggccctggggaaatctgaatagtaattccagtcatccaaattctatgagagggtctgaggaaaaaaagacaagcctatcacgggcgccctccgatcacgaagggcacgggcatgagaaggcgacagaggaggtcctcggctcgccctgggcgcggagcgaggactctggtcagaggtaattatgtcaccgcgttttctcgccgtgacagccgaataaacacgatctccaataaacatctctaatgagggaggaggcccgaggatggctgggtttgatttatgactggaggagaaggtccacttcccactgcgaagcaggcgacctgctcgccgcccagctccagggagaggaacccgcggaggagaggatcccggcccaggtaaggcgtgcggccggactgccactgcgctcgtcccccgtttccaggtgaggtgagcagggggcgccaccgctcggagtcgggcggaggtcccaacacctgtcacaggtgactgagctccgaaggtgctcccagaagacctagaaagggggcgcaggagcgcgagtgggagtgggggttgggggctagccggggcctggcccagaggccgccccaaactcccgggcggggttcttgggtgccccgcctaagccggcctgggcgtctccagctgcttttagggccgggctcccaggactttcgcccggctgaaccacaagttagtctaagtttgggtcgtcccttccctgactcactaaggggacacttccgggccccggctctggccctccaagggccgcagggtggtgggcgcttctctttcccgggcttggcggcccggctcccatggcgcccgcgcgcttcccgccgaggcagccagcgcagcgcccgcagtaaccggagcccgcgttctagctcagtgagaatcgctaattattaggtcttccgaagtgaagctcaaatcacacgctgggagctttacgcgctgcccagctctgtcggccgcattctttcgtactccgcgtctttctgagaaacgaaccccatctctagactttgttgcggtccagccatctgcactttgcaaccgcgggaaacttctgctgcacctcgcccgacccgcggcagggtgtctttaagcgctccaggcgcgggtacggactttcccaagcgtggatgtcgtgaactgcgatgcagaggaggtctggatgcaaagtgcgtccccacctcctgcatttttcgcggtcgcgagtggctttagcagacagcagcagcagactcccgccccctactcccagctcagggccggactggaagtccactcttaggagtggaacattttgctacttttgcagaagagcacactcggcaaagacaagtccctcctccaccccccttcctatccctccctcagtaactcgcttccatctttgtatgcctccttttaaaagcaaaaatcaagccccggggccacttggggcgggctttgatttggggacagcagtcgctggcagcggagaggccccgcgggccccgagccgggccggggccggagcccgggcggttacctgggagcggagggcggggaggcaggtgagcctggcagcgccggttcccacacttctcaccgccgctcggcaggggaagtggcagatctgacagccgcgttctacgcgaggacctgccccagagtttaaatgtcaatgataagaaaagagggtgctcaggcaggcgctaactttccttaatatccacgccagcgccgtcctcattggctgcccggcccgcgtgacgtcatggcggctagagttgggcacagctctgcgccgactagttttccggccgggcgggagcctgcttctccccacccagggtccggccggctccaacccctgctttggccttccttggcccggcctgtgactgctctagcccggcccggtccagcctgggccgccgtcctgtatggcgtagagtcgatccccaggaaactagtcttgccgagtgcgctcctccgcaccttcgggcactagggccccaagatctctgcccttaggctggccagctacctctctgggtaatcaccctgtcccctcctccgatccccaagggagtcccttcatcggagagacccgaaggccgcgccgggatggagaggcgcttttggcaggaatcatttttaggaggagttcgaggctcgatgagtaccctcaacctggccctcgagcccgcaagtcactagctgggcacagacgggggctccgggaagaggacatgcgacccctttttcagggcctaggccaaaggtctctccaggcctgctgggttctcaagagggaagccctaaagggggcctacccgggcttccctcgccctctggctgaa

SEQ ID NO: 106130 - DNA, 436 bp, Homo sapiens
  misc_feature 1..436: note = chr11:31840544-31840980
  misc_feature 1..436: note = Hyper
  source 1..436: mol_type = genomic DNA
cacttgaggagtttgcgggagaggaaggggcggggcgtggaatttcctttaggcagctcgtggagacccagcctgggtggacccgggagtgtgtgtgtagaagcagggagggggacgcctgggccggagagggtcctagggccagtccctgcgcgccttgatccgggcggcggctaagggagagccgagcacagatggcgccgaggcggaggtctagtgattcccgctcccgcccctggcacacctggacaggtgccgggcctcgcaaccggccaggaggcagctccaggcagcccgtctgcccactcctcttagcccggacagctcctagctggacttgattttttgtcttgctcagcccgtcgaggactggagggcagagtaggggtgggagtgggggtaggggtagaggtgggggtggcggtgaaggtgggga

SEQ ID NO: 106131 - DNA, 939 bp, Homo sapiens
  misc_feature 1..939: note = chr11:31841337-31842276
  misc_feature 1..939: note = Hyper
  source 1..939: mol_type = genomic DNA
gctgcggataggcctcggacctgtgtaggccttcctagctggccagtttctgtccgggtctcgctccccacactgtaccaaccctaggccgccgagagggctgttatgggcttgtttggagtccaggccattaagtgtgcgcaaatccctgcaacccagcagggtgctcgagagcgactctggaaacgccacggcccccgcctgcttatctgcctgtcaataaagggcgcgttcgggctgcgcgggagcgccggtggtgcaggcgaggcccgaactaggcccttccgagctccgggccaacgcacgagccgctctccatttgtcccgggcaaggaggctgggagggagggagccggctctggggtcgccgagggagaaggtgcgggtttagccgctgcctcagctggattcttggagaagcgctcgacctcggagcactctggagaccctaccagaaatctagtgctgggggctcctctccgcgcctgccaccagccttggaggaagctgggcagggccccgtgtggtgcccagcctacgaggtcccacctcgcctctccctggcagaggcatcctctctaggccacactggctcgcattgcgggaagaagggcaccgcgggcggcccgggggcatcatcgacgactcgtagagccccaaatgccgagtgctacctgaggcaggctgtagctggggtgaaaaggaccggaagcgggaaagaaacctcttttctttcaggcctcccttcagcccggggtagcacagactgcaaatttccgacacctagggcagctccaggctctgattctccaccgcacagtgagcgagctcggcagccgcccagtctgcgtaggctcccaggccagccccggccccagagcttccccatcagccagcagaggctgggtggagagcctggatgggcgtgagaggccttga

SEQ ID NO: 106132 - DNA, 62 bp, Homo sapiens; identical to SEQ ID NO: 72716
  misc_feature 1..62: note = chr11:31843422-31843484
  misc_feature 1..62: note = Hyper
  source 1..62: mol_type = genomic DNA

SEQ ID NO: 106133 - DNA, 280 bp, Homo sapiens; identical to SEQ ID NO: 72717
  misc_feature 1..280: note = chr11:31845075-31845355
  misc_feature 1..280: note = Hyper
  source 1..280: mol_type = genomic DNA

SEQ ID NO: 106134 - DNA, 30 bp, Homo sapiens; identical to SEQ ID NO: 72718
  misc_feature 1..30: note = chr11:31845607-31845637
  misc_feature 1..30: note = Hyper
  source 1..30: mol_type = genomic DNA

SEQ ID NO: 106135 - DNA, 58 bp, Homo sapiens; identical to SEQ ID NO: 33775
  misc_feature 1..58: note = chr11:31845842-31845900
  misc_feature 1..58: note = Hyper
  source 1..58: mol_type = genomic DNA

SEQ ID NO: 106136 - DNA, 1809 bp, Homo sapiens
  misc_feature 1..1809: note = chr11:31846162-31847971
  misc_feature 1..1809: note = Hyper
  source 1..1809: mol_type = genomic DNA
tcacaaatataatatcggcagctcccggattgcctgcggggttgttcaggccccgggcctgcacagctatgagaagtggggtgcagggtgctatttgcccagcaaaagctcatttcctcccaaatgagtataatgaaaacccgagaggcgatattagtgtaaagatcgggattagtccaaataggagccgcggacttgggcttcaaaggcgacccctactctttttgcccagtctgggggcggagggcgctcgaagggatacttcaaggacaccacatccaacttgtcgcagccccacgttcaggcacaggagggagcgaacattgggcagagggtaatttcaacaaaggacggcaggctccggggatcccggcttttccctgagttctctgggttggaaggagagggtccgggctctgtcggaggagtgggtacagcccagcacatgcttttctgacgcgcagcgctggcctggggagtgggtgcagctgctgcagccagcccccaccccgccccaggctgggaaggacgcagagtataatacgacggcccccttccccaaggggacactagatccagagctccaggcatatttgttgttcaaagttaattatacctgaaagcaaccaaaatgcgcacgccaggcccacggaggccgattgccgaccagcgtagccggcccgcagcgccagagaagccgctcactccggcggagtctctgcaagagaatctgaggctggggaataaaagccgaaactaaatcaggcagcaagagtaacaaaccatctggaaaatggacccacggagccgcaagaatgtactttttttttttatccttgacaacttgtgtcctaaagaaagtgtattgaagataattgaaatgattacaattcattgctgcctgactttgaatatgaacagtcacataatgacatccccgccacacaacaacagtttaatttccattatccgacttcgggatcctagcgccagccgccggggcaacgtggcgctaatgcagaaatcttggctcctgcctgcattattcatttcggggacgtggggatgggataggagtggagagtgggtttcttcccctcccccgaacttattctgaaaatcccggggaccaatggacaccgaggaaccgaaagccgagagaatagctgtcaaggggccactttgaccgacggggctgcggtcgacggcgctccccggctgtctttttgtcccaggggttcccaggcccgcagggctaggatcccccagctcccaccctagtcagtcccagtcagggaggacctaggccagggcctcctcccaaggctgtcatctggcggggcaaacgctcttctctcattccttcgtctcccttccagccctcgcatcctttccttctttctgcttcagagctctcaggctcgcgtgcagggcgggatgggcccggatcgggggccccttcgcagatttgaaagttgcctcggccttgatcttctcccagcctccctgctggggactcacccccacatcccgctaccccccggggaaaagcgaagaaagccagagtctctttgcacggcggggacgctggcgctcacctctgggcgcggcctcggtggagcctcagggccagggcggggtgtggcggggtgtggcccggtggggtgagggagggacccggggtgcaagccaggccaaggcctcctcagtgcgcaggcgccgttcgggcccgccgccccctcccaaggcgtggggtcccggggacagaccccgagcccctctctgcgcaactaccgcctctaaaaaaaa

SEQ ID NO: 106137 - DNA, 757 bp, Homo sapiens
  misc_feature 1..757: note = chr11:31848318-31849075
  misc_feature 1..757: note = Hyper
  source 1..757: mol_type = genomic DNA
cttgatggcataactcgaaccggagaagcgaggggagcctgagtgactggggcgcacatgacccccctcctggggcctttgggctcaacccttacttttaacttgttctaacaggaataatggagtagtactactaatgcatggtcagaaggggcttttctgtctagaacgcaggcggcgggagttgcaccgccacagcccgggagaccaaagagtctccactccccgctcccggcgcctcctcgccgaccggagccccgagcccagtgagcccagccggtcccacgtcgagaggcgctgggttgggagaagttctgctggtcgtgggctcggcccccaggcgccaggccgagtgcccacctcggcttctttagggggcctacagcgggcagccgagcggctggcggacccggagcttgggaggcgaccgccaggctggtgcccggcctgacccggcgttcgcggccgcccgctcgcccgccgcgggccgggagcgtacaggagtgtgacgcagattgtgaaaacagaagggagggagttgggtcatttccttcgctaatcatcgccccctcctgctcctcctccccacccccatcccatcctcgccgccacccagcctcgaactctcttccttgccagagtctgcctcactttgagccagtggctgcactttatggagaaaatatatgtgcccatcactcacccatctatttgcagcgtccatggagcgcctcggggaacacgcatggacaattaa

SEQ ID NO: 106138 - DNA, 30 bp, Homo sapiens; identical to SEQ ID NO: 72726
  misc_feature 1..30: note = chr11:31849540-31849570
  misc_feature 1..30: note = Hyper
  source 1..30: mol_type = genomic DNA

SEQ ID NO: 106139 - DNA, 288 bp, Homo sapiens
  misc_feature 1..288: note = chr11:32008982-32009270
  misc_feature 1..288: note = Hyper
  source 1..288: mol_type = genomic DNA
caaatggccgccccccgccgacgccatctgctctgcgaagcagaaacggcggcagctgcgcgcccagtccctccgcccgcgccccgcgcgccgagtccggatccgccgcccggcggcaccgcggacagcgccagccccggggtggcgggcgcggggctgggggcgctgggaagaggggtccgctgtaaggccctcccgccgcctcggggccagtctgggtctagccacttcacctgtgtgcttgaaatgtcagttctttaccagccaggctgccgtttgtttggctcc

SEQ ID NO: 106140 - DNA, 23 bp, Homo sapiens
  misc_feature 1..23: note = chr11:32269881-32269904
  misc_feature 1..23: note = Hypo
  source 1..23: mol_type = genomic DNA
actgcacccggcccacatctaca

SEQ ID NO: 106141 - DNA, 23 bp, Homo sapiens
  misc_feature 1..23: note = chr11:32281902-32281925
  misc_feature 1..23: note = Hypo
  source 1..23: mol_type = genomic DNA
accgcgcccggccagtgctgcat

SEQ ID NO: 106142 - DNA, 446 bp, Homo sapiens
  misc_feature 1..446: note = chr11:32354892-32355338
  misc_feature 1..446: note = Hyper
  source 1..446: mol_type = genomic DNA
caggtgcacggaaggcggcccattctggacagaaaagctttcgtttgacccaaagctcccccttccggcgtgttttctagagggaattcgtgagctgagccgaggagcgagcaggcggcttctcctgaccggggagacgcgggaggtttgcaaacagaccttggcctgggctgcgcagggacaaagtgttcaagggcagcaggggaggctgagggagtacacggctgggaacaagggacactgccgcccccagccacgcaggagcggtgtctgcaccactgaaagtcccccggggcccacagctctatccaggcggaagggaagcagccaggccgccgcggatctgaacttgaatcccgggtggaccggacgccccggccggcgctcctgacgcgcggaggagctggcgagaacctgcagatctcagggctcgcccgcggtccggc

SEQ ID NO: 106143 - DNA, 566 bp, Homo sapiens
  misc_feature 1..566: note = chr11:32448447-32449013
  misc_feature 1..566: note = Hyper
  source 1..566: mol_type = genomic DNA
ggacagtcccccaggcgcggccactcccccacccaatctcccagggcaggcgcttttccttccttcatgacctcactacctccttcccttgacgtcagccccgggtccccgcgcggaggggagggaggatggggatgggtttgggggcagccggtgtcaggatccccgagcaccagggaggagggggctatgaggtcatgcgcgcccaatcccgggccgcacaggcctcgcgctgctgctccccggcccccgccccaacttccagccccgtgcgggctggtgtgcgccgcagttactaggcaaccctatcgcagacgcgggcggccggccaagttcacccaaagttgaagaaaaaatttgggggagagaaggtggagcgagaggcgagaagaggaagcacggagcggggaaaagcttggaagggaatgaagctggccttgggcctcccgctcacaggaagaaggtcccacgcgggccagagcagcctccccgcagggccctgttgcgacccgatctccgtcctgcaccccggccgggggcccaccccagagcgtagcaggggcgct

SEQ ID NO: 106144 - DNA, 131 bp, Homo sapiens; identical to SEQ ID NO: 72739
  misc_feature 1..131: note = chr11:32449434-32449565
  misc_feature 1..131: note = Hyper
  source 1..131: mol_type = genomic DNA

SEQ ID NO: 106145 - DNA, 3507 bp, Homo sapiens
  misc_feature 1..3507: note = chr11:32455276-32458783
  misc_feature 1..3507: note = Hyper
  source 1..3507: mol_type = genomic DNA
gtgggcgggcatcggcgcgggatgagaaaccaacctgatacttatcgtgtgccgagttccctccttgtatcctgactaagcacagcgaataaccctgtccttgttctaaccccaggtcttgaagaaatactgtcccagctgagccccgcgtttacaagatgaagaggcgccccagatgcgctgaaagaaaggccaaagctcgtgcctccttccactgcctgcggtagaacctggtcccgcatagcttggactcggataagtcaagttctcttccatccccagaacctgcgtggccgccgcctgagcgaagcccagtgaagatccacttctgtattaccatacgcgggagctatccacggacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagacgtctgaaaagcgctacgcttggtgacaatttggcgtttccttaattaacaaaactctccccaaggcagagccagacactgcgccggtctcctggttccactcccgtggggactagcagtcccggaatctctcggactctaaggggccccagacgccctcccggctcttgcgaacagtcaggctcctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggcagctgggcaggtagggcgcgttaggaaacatcctggcctggccggatgacgcctggctgggcggaggaggaccgaagggcccgtagcgacaggctccggctgtgccagtgaactggccggaaaagtggacagtgaaggcgctcaggcactgctcctcgtgcggctccgcgccgccccagctcggctcctgtttgatgaaggagtgaggcggcggcggcgggggtggcggcggagccggtggcggcgcggggccgcccaacgacccgtaagccgaagcgcccgggggcgcaaagtccagcaccggcgcccactgcgccgcgccgctcacaggcagggcacagccgccgccgccacccagggaggggacggcgggcagcagcgcgttcaggtcccgcacgtcggagcccatttgctgcggctcagacccggacgccccgcggctcctccggccctggagacgttcagcgctggcctcggcggcgcctaacttggcccagatgccgcccgggtcccggactccctgctgctctggctgctgtaggcacccaggcccggagcggagcgtgtgctgagacgccggctccgggacacacgtggaagccgggtcctgcagcaagaggaagtccaggatcgcggcgaggagacggcggggcccgggcgcctgggctgccgtcccggctctgggtgggtgggtgggtgaatgagtaggtgggagggagggcgggaagtgggggagcggacaggcggtcgggttgcggagagcccccgggtgtgggcgctgccttgaactccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagagatggggttgttaatctaaaagagtggtttggagggaggggcaggtaggctccaagagggcgggaacttcaggaaagcgcagaaagaactcagtcaagcttcaaagaagcgtatacccttgctttgcacccttgagtctggctcttgcttctagaactgtcgggtaggggagtggccatgatcttggggtcactggggaaagaggtggccctttgtgggttccagaggtcgggactgaaagcgaacgtccctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccagg

SEQ ID NO: 106146 - DNA, 468 bp, Homo sapiens
  misc_feature 1..468: note = chr11:32459407-32459875
  misc_feature 1..468: note = Hyper
  source 1..468: mol_type = genomic DNA
ggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttc

SEQ ID NO: 106147 - DNA, 30 bp, Homo sapiens; identical to SEQ ID NO: 33793
  misc_feature 1..30: note = chr11:32460192-32460222
  misc_feature 1..30: note = Hyper
  source 1..30: mol_type = genomic DNA

SEQ ID NO: 106148 - DNA, 47 bp, Homo sapiens; identical to SEQ ID NO: 33794
  misc_feature 1..47: note = chr11:32460468-32460515
  misc_feature 1..47: note = Hyper
  source 1..47: mol_type = genomic DNA

SEQ ID NO: 106149 - DNA, 196 bp, Homo sapiens
  misc_feature 1..196: note = chr11:32460744-32460940
  misc_feature 1..196: note = Hyper
  source 1..196: mol_type = genomic DNA
gacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccact

SEQ ID NO: 106150 - DNA, 32 bp, Homo sapiens; identical to SEQ ID NO: 72749
  misc_feature 1..32: note = chr11:32461289-32461321
  misc_feature 1..32: note = Hyper
  source 1..32: mol_type = genomic DNA

SEQ ID NO: 106151 - DNA, 22 bp, Homo sapiens
  misc_feature 1..22: note = chr11:32604850-32604872
  misc_feature 1..22: note = Hypo
  source 1..22: mol_type = genomic DNA
tccactgcgcccagccaaagct

SEQ ID NO: 106152 - DNA, 210 bp, Homo sapiens; identical to SEQ ID NO: 43034
  misc_feature 1..210: note = chr11:32728943-32729153
  misc_feature 1..210: note = Hypo
  source 1..210: mol_type = genomic DNA

SEQ ID NO: 106153 - DNA, 17 bp, Homo sapiens
  misc_feature 1..17: note = chr11:32859995-32860012
  misc_feature 1..17: note = Hypo
  source 1..17: mol_type = genomic DNA
tccggaaaaaaaaaaaa

SEQ ID NO: 106154 - DNA, 37 bp, Homo sapiens; identical to SEQ ID NO: 43036
  misc_feature 1..37: note = chr11:32935022-32935059
  misc_feature 1..37: note = Hypo
  source 1..37: mol_type = genomic DNA

SEQ ID NO: 106155 - DNA, 173 bp, Homo sapiens; identical to SEQ ID NO: 33796
  misc_feature 1..173: note = chr11:33037467-33037640
  misc_feature 1..173: note = Hyper
  source 1..173: mol_type = genomic DNA

SEQ ID NO: 106156 - DNA, 104 bp, Homo sapiens; identical to SEQ ID NO: 43037
  misc_feature 1..104: note = chr11:33181185-33181289
  misc_feature 1..104: note = Hypo
  source 1..104: mol_type = genomic DNA

SEQ ID NO: 106157 - DNA, 18 bp, Homo sapiens
  misc_feature 1..18: note = chr11:33184321-33184339
  misc_feature 1..18: note = Hypo
  source 1..18: mol_type = genomic DNA
ctccgtctcaaaaaaaat

SEQ ID NO: 106158 - DNA, 137 bp, Homo sapiens; identical to SEQ ID NO: 72762
  misc_feature 1..137: note = chr11:33202679-33202816
  misc_feature 1..137: note = Hypo
  source 1..137: mol_type = genomic DNA

SEQ ID NO: 106159 - DNA, 15 bp, Homo sapiens
  misc_feature 1..15: note = chr11:33262877-33262892
  misc_feature 1..15: note = Hypo
  source 1..15: mol_type = genomic DNA
cgcaaagaaattaat

SEQ ID NO: 106160 - DNA, 224 bp, Homo sapiens; identical to SEQ ID NO: 43040
  misc_feature 1..224: note = chr11:33269863-33270087
  misc_feature 1..224: note = Hypo
  source 1..224: mol_type = genomic DNA

SEQ ID NO: 106161 - DNA, 23 bp, Homo sapiens
  misc_feature 1..23: note = chr11:33277687-33277710
  misc_feature 1..23: note = Hypo
  source 1..23: mol_type = genomic DNA
agccaccgcgcccggcctccttt

SEQ ID NO: 106162 - DNA, 107 bp, Homo sapiens; identical to SEQ ID NO: 72766
  misc_feature 1..107: note = chr11:33397535-33397642
  misc_feature 1..107: note = Hyper
  source 1..107: mol_type = genomic DNA

SEQ ID NO: 106163 - DNA, 16 bp, Homo sapiens
  misc_feature 1..16: note = chr11:33430482-33430498
  misc_feature 1..16: note = Hypo
  source 1..16: mol_type = genomic DNA
gcgactccatctcaaa

SEQ ID NO: 106164 - DNA, 18 bp, Homo sapiens
  misc_feature 1..18: note = chr11:33655887-33655905
  misc_feature 1..18: note = Hypo
  source 1..18: mol_type = genomic DNA
ctgcgcttactgctctga

SEQ ID NO: 106165 - DNA, 104 bp, Homo sapiens
  misc_feature 1..104: note = chr11:33721908-33722012
  misc_feature 1..104: note = Hyper
  source 1..104: mol_type = genomic DNA
gcaggggaccaggggcgaggcaaccacctcaggccccggcggcggtgagtagaagaagcgcagaggctcgtaggggatggaggccaggccggagggccagggcg

SEQ ID NO: 106166 - DNA, 198 bp, Homo sapiens; identical to SEQ ID NO: 72771
  misc_feature 1..198: note = chr11:33801487-33801685
  misc_feature 1..198: note = Hypo
  source 1..198: mol_type = genomic DNA

SEQ ID NO: 106167 - DNA, 44 bp, Homo sapiens; identical to SEQ ID NO: 72772
  misc_feature 1..44: note = chr11:33850913-33850957
  misc_feature 1..44: note = Hyper
  source 1..44: mol_type = genomic DNA

SEQ ID NO: 106168 - DNA, 25 bp, Homo sapiens
  misc_feature 1..25: note = chr11:33858438-33858463
  misc_feature 1..25: note = Hypo
  source 1..25: mol_type = genomic DNA
aaaccgaccacgccccttattattc

SEQ ID NO: 106169 - DNA, 39 bp, Homo sapiens; identical to SEQ ID NO: 72774
  misc_feature 1..39: note = chr11:33874033-33874072
  misc_feature 1..39: note = Hypo
  source 1..39: mol_type = genomic DNA

SEQ ID NO: 106170 - DNA, 180 bp, Homo sapiens; identical to SEQ ID NO: 72775
  misc_feature 1..180: note = chr11:33874405-33874585
  misc_feature 1..180: note = Hypo
  source 1..180: mol_type = genomic DNA

SEQ ID NO: 106171 - DNA, 186 bp, Homo sapiens; identical to SEQ ID NO: 72776
  misc_feature 1..186: note = chr11:33880881-33881067
  misc_feature 1..186: note = Hypo
  source 1..186: mol_type = genomic DNA

SEQ ID NO: 106172 - DNA, 452 bp, Homo sapiens; identical to SEQ ID NO: 72777
  misc_feature 1..452: note = chr11:33890181-33890633
  misc_feature 1..452: note = Hyper
  source 1..452: mol_type = genomic DNA

SEQ ID NO: 106173 - DNA, 168 bp, Homo sapiens; identical to SEQ ID NO: 72778
  misc_feature 1..168: note = chr11:33891959-33892127
  misc_feature 1..168: note = Hyper
  source 1..168: mol_type = genomic DNA

SEQ ID NO: 106174 - DNA, 48 bp, Homo sapiens; identical to SEQ ID NO: 72779
  misc_feature 1..48: note = chr11:33928255-33928303
  misc_feature 1..48: note = Hypo
  source 1..48: mol_type = genomic DNA

SEQ ID NO: 106175 - DNA, 31 bp, Homo sapiens; identical to SEQ ID NO: 72780
  misc_feature 1..31: note = chr11:33951209-33951240
  misc_feature 1..31: note = Hypo
  source 1..31: mol_type = genomic DNA

SEQ ID NO: 106176 - DNA, 52 bp, Homo sapiens; identical to SEQ ID NO: 72781
  misc_feature 1..52: note = chr11:33976639-33976691
  misc_feature 1..52: note = Hypo
  source 1..52: mol_type = genomic DNA

SEQ ID NO: 106177 - DNA, 35 bp, Homo sapiens; identical to SEQ ID NO: 72783
  misc_feature 1..35: note = chr11:33993944-33993979
  misc_feature 1..35: note = Hypo
  source 1..35: mol_type = genomic DNA

SEQ ID NO: 106178 - DNA, 45 bp, Homo sapiens; identical to SEQ ID NO: 72785
  misc_feature 1..45: note = chr11:34378277-34378322
  misc_feature 1..45: note = Hyper
  source 1..45: mol_type = genomic DNA

SEQ ID NO: 106179 - DNA, 46 bp, Homo sapiens; identical to SEQ ID NO: 72787
  misc_feature 1..46: note = chr11:34517683-34517729
  misc_feature 1..46: note = Hypo
  source 1..46: mol_type = genomic DNA

SEQ ID NO: 106180 - DNA, 35 bp, Homo sapiens; identical to SEQ ID NO: 72788
  misc_feature 1..35: note = chr11:34534277-34534312
  misc_feature 1..35: note = Hypo
  source 1..35: mol_type = genomic DNA

SEQ ID NO: 106181 - DNA, 204 bp, Homo sapiens; identical to SEQ ID NO: 72789
  misc_feature 1..204: note = chr11:34535044-34535248
  misc_feature 1..204: note = Hypo
  source 1..204: mol_type = genomic DNA

SEQ ID NO: 106182 - DNA, 30 bp, Homo sapiens; identical to SEQ ID NO: 43050
  misc_feature 1..30: note = chr11:34536053-34536083
  misc_feature 1..30: note = Hypo
  source 1..30: mol_type = genomic DNA

SEQ ID NO: 106183 - DNA, 26 bp, Homo sapiens
  misc_feature 1..26: note = chr11:34577250-34577276
  misc_feature 1..26: note = Hypo
  source 1..26: mol_type = genomic DNA
aactcaaatctgaagcgtcctggctg

SEQ ID NO: 106184 - DNA, 163 bp, Homo sapiens; identical to SEQ ID NO: 72792
  misc_feature 1..163: note = chr11:34847311-34847474
  misc_feature 1..163: note = Hypo
  source 1..163: mol_type = genomic DNA

SEQ ID NO: 106185 - DNA, 28 bp, Homo sapiens
  misc_feature 1..28: note = chr11:34920681-34920709
  misc_feature 1..28: note = Hypo
  source 1..28: mol_type = genomic DNA
ctgggattacaggcgtgagccactgagc

SEQ ID NO: 106186 - DNA, 166 bp, Homo sapiens; identical to SEQ ID NO: 43052
  misc_feature 1..166: note = chr11:35134173-35134339
  misc_feature 1..166: note = Hypo
  source 1..166: mol_type = genomic DNA

SEQ ID NO: 106187 - DNA, 1272 bp, Homo sapiens
  misc_feature 1..1272: note = chr11:35440486-35441758
  misc_feature 1..1272: note = Hyper
  source 1..1272: mol_type = genomic DNA
atcccctcacccttccgtagatgccatggtctggggaacgccccctcctcttcagcactatccggcagctgtgggcgagggagaaagcggacgccggggtgagcgcgaagtgcggccgggagcggtatttaagaggagcctctgcccgcccttccacccgcctccggggtaagccctttagcgcctcaacgggcgcaggaggctcctgcgggcgctaatccgcgtcccggctctccacggcgcgcgacccgcgctcccctccgcccgcggggatggcgcttggcggggagctccgggggctccgagggtggcttccccgagagagcgatgcgcccagggctgcaggagggcgcacgccggcgatgcgcccctgcagccgctgccacctgtgctttgctgcggggctcgcgggcgcggcgagtggcgggagcagagagtggtggcagaggacggtgagcgtgcgtgcgcgtgtgcgggtgtgtgcgcgcctggggaggcggtggaggccgctgcgctctggctcggcgccggccagggagggattgcaaggtttagccccgccggagctggggatttgcaggcgatccctctctattttcgtcgagagctgacatcacccgcgccgccgcctcgggcaactcctttaaccgccgccccccgcccccatctccagtcgcggtccctcctctgccatccctccccccagcctctcgccataaattagccaaataagaaaagaggccccgccgctcgtccgggaaggcttgggcagccggtggcaggagcccaggatctaaggagtagctattgtttcccctgaagcccgcgtggccccaggtcaccccgtgcggggtgaagcgcaggcgaccgcgcggagacccgggatgcccctccgtctccgcctccctggagcagcccctggcgctccctcctcactccccggagcacccgcttcagctcacactcacccccaaactcacaggcaggcacacccaccccatcctcccacgtctgggggtcccaggtccagcggagtcgagcggctgaaacacgcgggtggtgcagcctaaacgcggcccagctgcgctccctcccccgccgaagctcgaataaatctctggccttcaattattcagcgagattaatattaatgcagctccctgggggcggcgggcggggtgcaggggaggccgggattttttttttttttttttaggccgagagaggtcggcctcgtgggtgccggctgagaaggcgcggagagttggccga

SEQ ID NO: 106188 - DNA, 30 bp, Homo sapiens; identical to SEQ ID NO: 72797
  misc_feature 1..30: note = chr11:35547097-35547127
  misc_feature 1..30: note = Hyper
  source 1..30: mol_type = genomic DNA

SEQ ID NO: 106189 - DNA, 240 bp, Homo sapiens; identical to SEQ ID NO: 72798
  misc_feature 1..240: note = chr11:35547335-35547575
  misc_feature 1..240: note = Hyper
  source 1..240: mol_type = genomic DNA

SEQ ID NO: 106190 - DNA, 239 bp, Homo sapiens
  misc_feature 1..239: note = chr11:35639567-35639806
  misc_feature 1..239: note = Hyper
  source 1..239: mol_type = genomic DNA
ctgatcctagcctggcggagctcggaaagaggtggaaatctgtctgaagtttgcaggagacccgcgctgcctaggcaaagggacccggcgaccaagacacccccgcgagggcccagggcgcgtccctcccgccaggccccagactccggctctgcgccaccccctcctacgccccggcgcgggcgcagccagtccggcttcctccaggcccccaagtcccggaccgagtgtggggccgc

SEQ ID NO: 106191 - DNA, 1118 bp, Homo sapiens; identical to SEQ ID NO: 72801
  misc_feature 1..1118: note = chr11:35640499-35641617
  misc_feature 1..1118: note = Hyper
  source 1..1118: mol_type = genomic DNA

SEQ ID NO: 106192 - DNA, 290 bp, Homo sapiens; identical to SEQ ID NO: 43053
  misc_feature 1..290: note = chr11:35684922-35685212
  misc_feature 1..290: note = Hypo
  source 1..290: mol_type = genomic DNA

SEQ ID NO: 106193 - DNA, 420 bp, Homo sapiens; identical to SEQ ID NO: 72804
  misc_feature 1..420: note = chr11:36398057-36398477
  misc_feature 1..420: note = Hyper
  source 1..420: mol_type = genomic DNA

SEQ ID NO: 106194 - DNA, 787 bp, Homo sapiens; identical to SEQ ID NO: 72805
  misc_feature 1..787: note = chr11:36398700-36399487
  misc_feature 1..787: note = Hyper
  source 1..787: mol_type = genomic DNA

SEQ ID NO: 106195 - DNA, 98 bp, Homo sapiens; identical to SEQ ID NO: 43054
  misc_feature 1..98: note = chr11:36687119-36687217
  misc_feature 1..98: note = Hypo
  source 1..98: mol_type = genomic DNA

SEQ ID NO: 106196 - DNA, 22 bp, Homo sapiens
  misc_feature 1..22: note = chr11:36935607-36935629
  misc_feature 1..22: note = Hypo
  source 1..22: mol_type = genomic DNA
ataaaggaaggtggccgggtgt

SEQ ID NO: 106197 - DNA, 33 bp, Homo sapiens; identical to SEQ ID NO: 72813
  misc_feature 1..33: note = chr11:38503116-38503149
  misc_feature 1..33: note = Hypo
  source 1..33: mol_type = genomic DNA

SEQ ID NO: 106198 - DNA, 43 bp, Homo sapiens; identical to SEQ ID NO: 72816
  misc_feature 1..43: note = chr11:39673547-39673590
  misc_feature 1..43: note = Hypo
  source 1..43: mol_type = genomic DNA

SEQ ID NO: 106199 - DNA, 30 bp, Homo sapiens; identical to SEQ ID NO: 72817
  misc_feature 1..30: note = chr11:39808437-39808467
  misc_feature 1..30: note = Hypo
  source 1..30: mol_type = genomic DNA

SEQ ID NO: 106200 - DNA, 231 bp, Homo sapiens; identical to SEQ ID NO: 72818
  misc_feature 1..231: note = chr11:40314692-40314923
  misc_feature 1..231: note = Hyper
  source 1..231: mol_type = genomic DNA

SEQ ID NO: 106201 - DNA, 192 bp, Homo sapiens
  misc_feature 1..192: note = chr11:40315416-40315608
  misc_feature 1..192: note = Hyper
  source 1..192: mol_type = genomic DNA
gctcacggctccctgcgcggcagaaaccccagtccccttccatccacttcggtttgaactctcttcctccccctccctctgctctctcccctctttttctcccaaataaatgctctcccagcaccggcggcagctcttgccagcccaggctttctctcgaccaatgccacgtcctgacgcttagggtcctag

SEQ ID NO: 106202 - DNA, 37 bp, Homo sapiens; identical to SEQ ID NO: 72824
  misc_feature 1..37: note = chr11:41989424-41989461
  misc_feature 1..37: note = Hypo
  source 1..37: mol_type = genomic DNA

SEQ ID NO: 106203 - DNA, 120 bp, Homo sapiens; identical to SEQ ID NO: 72825
  misc_feature 1..120: note = chr11:42366142-42366262
  misc_feature 1..120: note = Hypo
  source 1..120: mol_type = genomic DNA

SEQ ID NO: 106204 - DNA, 18 bp, Homo sapiens
  misc_feature 1..18: note = chr11:43402096-43402114
  misc_feature 1..18: note = Hypo
  source 1..18: mol_type = genomic DNA
gcccggccaaaagctggc

SEQ ID NO: 106205 - DNA, 126 bp, Homo sapiens; identical to SEQ ID NO: 72829
  misc_feature 1..126: note = chr11:43543226-43543352
  misc_feature 1..126: note = Hypo
  source 1..126: mol_type = genomic DNA

SEQ ID NO: 106206 - DNA, 46 bp, Homo sapiens; identical to SEQ ID NO: 72830
  misc_feature 1..46: note = chr11:43544024-43544070
  misc_feature 1..46: note = Hypo
  source 1..46: mol_type = genomic DNA

SEQ ID NO: 106207 - DNA, 373 bp, Homo sapiens
  misc_feature 1..373: note = chr11:43568942-43569315
  misc_feature 1..373: note = Hyper
  source 1..373: mol_type = genomic DNA
gcacagcgactgggccgggagcgacctggctctcggaagccgggcagggtgggggagggggcaggtaagtgggttgcctggcaacccggcagacccgcgggtggacaagctcaaggggcagccaggtgccacccgccccacccccgagcacacgctgcggaattctgacggcacgaagcagagtcacgagcgcagccggagcagtcgagcgggcaggacaccgtcagtgccgggagaacacgcgcgcgtgggtggatggcgggagggtcctcacagccagccgcaccacccccctcccccccacatcccgcaacctggcttctcctcgctctaaatctaggggaacaaaaacccggcgcgtctgggacagcct

SEQ ID NO: 106208 - DNA, 51 bp, Homo sapiens; identical to SEQ ID NO: 72833
  misc_feature 1..51: note = chr11:43569569-43569620
  misc_feature 1..51: note = Hyper
  source 1..51: mol_type = genomic DNA

SEQ ID NO: 106209 - DNA, 107 bp, Homo sapiens; identical to SEQ ID NO: 33815
  misc_feature 1..107: note = chr11:43596489-43596596
  misc_feature 1..107: note = Hyper
  source 1..107: mol_type = genomic DNA

SEQ ID NO: 106210 - DNA, 462 bp, Homo sapiens; identical to SEQ ID NO: 72835
  misc_feature 1..462: note = chr11:43596850-43597312
  misc_feature 1..462: note = Hyper
  source 1..462: mol_type = genomic DNA

SEQ ID NO: 106211 - DNA, 66 bp, Homo sapiens; identical to SEQ ID NO: 72836
  misc_feature 1..66: note = chr11:43598418-43598484
  misc_feature 1..66: note = Hyper
  source 1..66: mol_type = genomic DNA

SEQ ID NO: 106212 - DNA, 30 bp, Homo sapiens; identical to SEQ ID NO: 10840
  misc_feature 1..30: note = chr11:43599075-43599105
  misc_feature 1..30: note = Hyper
  source 1..30: mol_type = genomic DNA

SEQ ID NO: 106213 - DNA, 199 bp, Homo sapiens; identical to SEQ ID NO: 72838
  misc_feature 1..199: note = chr11:43600016-43600215
  misc_feature 1..199: note = Hyper
  source 1..199: mol_type = genomic DNA

SEQ ID NO: 106214 - DNA, 1105 bp, Homo sapiens; identical to SEQ ID NO: 72839
  misc_feature 1..1105: note = chr11:43600492-43601597
  misc_feature 1..1105: note = Hyper
  source 1..1105: mol_type = genomic DNA

SEQ ID NO: 106215 - DNA, 30 bp, Homo sapiens; identical to SEQ ID NO: 72840
  misc_feature 1..30: note = chr11:43602138-43602168
  misc_feature 1..30: note = Hyper
  source 1..30: mol_type = genomic DNA

SEQ ID NO: 106216 - DNA, 1784 bp, Homo sapiens
  misc_feature 1..1784: note = chr11:43602393-43604177
  misc_feature 1..1784: note = Hyper
  source 1..1784: mol_type = genomic DNA
ctgattggtgggtgacgattttagtccgcaccaatgagctggcggcctcgtctgtatttatttagtgctctgggggagtttttctctttacgcagcgcctgtagtcacggctggaaccttggctgggggactctgagggataagaggggattcggggggaatccgaactgtacctgttcagagatccgcgaccttgcagccggggctggcggaactctgatagggagatagagggataggacaggcaggcggggaggctccgggtgctggggcgacaggaaaggggtggaggctgggctccgggatccgggtgcccctctgcggtccccttctcgccctccacacacttctctcggggctgagttgggggatcgcggacggtctggagaaatggagacacgagtccaggggcgcggaggggcgggcagcgcgcggagtggtgagactgagccgcgatggaacgcgctggggagacccagcctgttcggctccagggttcggagacatcctgggctgaaggcggcggcgaaccgaagaagccggcatattctgcccttcgcgaatctttttgcggtctgggcttgctgtacataactcaatagccggaagcccttaccccaaaaagcatttgcggagggcgcactcgtcgagaagacggcagccatccagcgatcgccgaagcccgcaccttcccgaagctgctccatccgagccttacccggccctttccccgttttccacggaagattcggccctttcccccgtcctttccgcggtgcccgaggctttggtcacctgtcttccctccgagcgagtcccccgcccccaactttttaacagactttgtatcacagggggaactggagcaggtggggtgtgtgtgttttcggagaagtgagaagaagctaaaatgcaataaaagtttacagaagttgtgtcttccccccaacccccgcccacaccacgaataaccccattcactcaatgcaaagaaaaggatctgagcttaaggccaagtcagaacctggaatatgaatcagtttaggacattttgtggtcatttttgaccgtaatgatccgattctgcaatatgggggtggggaagcccttgagggaggggctggaggcccttagtatcttatgtcctggtgcgggggacccggaggtgaggcgagccgcggtgaattgggtagatccgaaaaagagggaaaacacccaggcaccgcccgatccccggagtctcttcctcccgcgcctgcttccaacctaatttggggcgttttgcagcctcgggtctcccacatctcctctttttcaaaactaagtagcacggaagggggtaaaacaggcgagaactggggaagcccccgcagagaaggagctttggagagatgcggttgtgcccgactcagacgcttagcaggaacagaagcagcagcagcagcagcagccccatcccggcctctccaggcgccggtcctggggaggggggcaaagctgcaggagaggggagagtctgtgagtccccctcctccccctccactcattgcagtcctgaccacttcggtcacaagtggcacaaatcaggccttcaccacgctccccgcgcccttcgcctgctaggaacactgctagacgcccttgcccttagggactgggccagaaggacacacatacacacatgagtgcccacagggacagaaatgggtagaagatgggtctagagacaccggagttcaagacccgagggctgcgaaccttcacgttttcggggagggcctgaa

SEQ ID NO: 106217 - DNA, 127 bp, Homo sapiens; identical to SEQ ID NO: 72844
  misc_feature 1..127: note = chr11:43604737-43604864
  misc_feature 1..127: note = Hyper
  source 1..127: mol_type = genomic DNA

SEQ ID NO: 106218 - DNA, 16 bp, Homo sapiens
  misc_feature 1..16: note = chr11:43694378-43694394
  misc_feature 1..16: note = Hypo
  source 1..16: mol_type = genomic DNA
ccgcaccctggccaat

SEQ ID NO: 106219 - DNA, 30 bp, Homo sapiens; identical to SEQ ID NO: 72847
  misc_feature 1..30: note = chr11:43701969-43701999
  misc_feature 1..30: note = Hyper
  source 1..30: mol_type = genomic DNA

SEQ ID NO: 106220 - DNA, 93 bp, Homo sapiens; identical to SEQ ID NO: 72848
  misc_feature 1..93: note = chr11:43963470-43963563
  misc_feature 1..93: note = Hyper
  source 1..93: mol_type = genomic DNA

SEQ ID NO: 106221 - DNA, 392 bp, Homo sapiens; identical to SEQ ID NO: 72849
  misc_feature 1..392: note = chr11:43963623-43964015
  misc_feature 1..392: note = Hyper
  source 1..392: mol_type = genomic DNA

SEQ ID NO: 106222 - DNA, 1054 bp, Homo sapiens; identical to SEQ ID NO: 72850
  misc_feature 1..1054: note = chr11:43964245-43965299
  misc_feature 1..1054: note = Hyper
  source 1..1054: mol_type = genomic DNA

SEQ ID NO: 106223 - DNA, 557 bp, Homo sapiens; identical to SEQ ID NO: 72851
  misc_feature 1..557: note = chr11:43965504-43966061
  misc_feature 1..557: note = Hyper
  source 1..557: mol_type = genomic DNA

SEQ ID NO: 106224 - DNA, 48 bp, Homo sapiens
  misc_feature 1..48: note = chr11:44324942-44324990
  misc_feature 1..48: note = Hyper
  source 1..48: mol_type = genomic DNA
taggtacttggcagccggtggcccctcttaccccgcccgtatctccca

SEQ ID NO: 106225 - DNA, 834 bp, Homo sapiens
  misc_feature 1..834: note = chr11:44325688-44326522
  misc_feature 1..834: note = Hyper
  source 1..834: mol_type = genomic DNA
gtatcatcacatagccgggtcctcgcagtgttggtttcccaatccgatgactgtcacctcggtgaggacctgtgctgatggccggagaaccctgcgctgcgggcgcacatggccaggtggcgcctggcaggcgacgtccgggtgcaggacggcgctcttaccgccccaccccaaaccgttgcctgggcctaggtccttcggcttcctgaacaggggtttggggggctaaggacgctgaggctccgggggcaggaagttctctctggttaagcgttctctcttctctccggcatacactcccctacccacccacctcgcctaccctcggggcgagaggctcaccaaggcagggcgcgccccccccatgaatcatcccaaggcctctgagccgcgggggctccgggcaactatccccctcctctcctggcctcaggcaccccagtccaggggtctgcagagaagcccgaagcccggacaaacgcgccggacgtcaacaacctctcatccctggcagcagcaaaggccaatatatttccatttcttatttcagtttgccaccaaaacaaagctgcgcgcggctgagggcaggaaggcgctgagaccgagaagaagggacgtcccggagaaagtgcgcccagctgatcttagaaaccagagtcctccgggacttcgccgagattttctgtagggcgttttaatctgttttcctactgcgtgccggcgtcgcagcgcgtgcggctcagggcttggtgactccggcttagcccggcggtcgcggcgaggttcctggcgcagccgcttggaacttcgcattagaatcgggaccgcgcaaat

SEQ ID NO: 106226 - DNA, 1430 bp, Homo sapiens
  misc_feature 1..1430: note = chr11:44330477-44331907
  misc_feature 1..1430: note = Hyper
  source 1..1430: mol_type = genomic DNA
cagggtcccaggactcgggtcttgccagaccacagtgtcccctgggaccctagggtctctggctccgcactgtgttgcgccagtgcgcctggatttcccgtgagctttcggccaaccacgctccgggcttcccgcctggctccgcacctgcggcgctctcacctgcggcggcgccgcccgaggagcctcccagccggcgaggagcgaggcttctgcagtcctgctgtcccgcagccccgcagccccgcagcctcgcagccccgcagccccgcagccccgcagccccgcagccccgcagcccagcgccagagcgctgcgcggagactccttgccgccgcacgccctgggccggtaagaagcatccgcttcaaatcccgcccagcgggcagcgcaaagcgagcggtttggggaaatgccgaagggaccgggaaaaacaaactccaagtcgagtttaacagccgaaacgctccgtgcctaggccggcggacaagaaggagacagaacagatcccttggctccctcgcagcgatcgatcccgtttaccgaccagagtcaccaccccgcccccagcccgccaactcatacctcccgcaagccaccagtttcaagggatgcggaagccaagcaccccgtggtccccagcaccaggtgacccgcacgtgcactcaccgtagcagggaacctgcaaggccgcgctgtggccgctgctgccttcctggagtttgaggctgccgtccgggggcgtcttgcaggcgcctcgctgcaagtaaagatgcggttgcgcgggcggctggggctgcggctgctgctgctgcggctgcggctgcggcggcggctggggctgcggggtcgacggctggggctggaacttgttaaaggagccccgcgccccagctccactctccaggggtgtcgccaggtcctgctgcccagcgccgtaacgggcccggctcttggcgtccccgaatccctgtgctttggcggcggccgacaggaaagttgtgccgaacttgtcgcctccgggaaatgccctaaaaggcgacgagccctcccgactctgcgacaccgggctgtagtaggcgtccatggcagcggccggcgactcgcagtaagagacgcaagtctcagcattcatgcctggcttgcgcaggcggcgggcggggacgcgagcgagggcgcgaggacgccaccgcgcgccttggctgggagtttggggaggcgaggaggctgtggctgtgcactccttgcccggcctgctcgctctccctcctcccctccacgccggcctctctctctctccccctcttctttctctgtctctctcctctctctccctcctctctctctcttcccctccctcccccccccttcctctctctctccctctctctctttcctccctccccacagctagccgagggaaagaacgg

SEQ ID NO: 106227 - DNA, 814 bp, Homo sapiens; identical to SEQ ID NO: 72861
  misc_feature 1..814: note = chr11:44332324-44333138
  misc_feature 1..814: note = Hyper
  source 1..814: mol_type = genomic DNA

SEQ ID NO: 106228 - DNA, 86 bp, Homo sapiens; identical to SEQ ID NO: 72862
  misc_feature 1..86: note = chr11:44333542-44333628
  misc_feature 1..86: note = Hyper
  source 1..86: mol_type = genomic DNA

SEQ ID NO: 106229 - DNA, 898 bp, Homo sapiens
  misc_feature 1..898: note = chr11:44337654-44338552
  misc_feature 1..898: note = Hyper
  source 1..898: mol_type = genomic DNA
tggacctccagggctcgcagaaaagctgccacttctccagagccgccagggcgggcgcgagagcagcgagtccgcgcgggtcctcggcgcgctcgccagacccagccgaccgcgtgactcaccacgtcctccgccgggaggaggtcagcatcggccctgggcaccggtccccagccgccgcagcccctgccccaatctccccggaatgcggacgccgccgcgccaacccgagcctccagtcggatagaggcagggagggaggcactgcccacgacgagtgctctccaggcgctgcaaagagcaggggtctcctaggggctttgagaccgcgggcggacctcgggggagcaggcgtgggacccgatctgtgccggctcagcagggccccagcagcgccccagcgtcgcccgcccttcctcctcgcccaccttacgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcacacgctgtttggtaccccgcgtctatgaagcacaaagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttctcgcctgaaggcgaagtccgcgtgcg

SEQ ID NO: 106230 - DNA, 30 bp, Homo sapiens; identical to SEQ ID NO: 72866
  misc_feature 1..30: note = chr11:44340703-44340733
  misc_feature 1..30: note = Hyper
  source 1..30: mol_type = genomic DNA

SEQ ID NO: 106231 - DNA, 243 bp, Homo sapiens; identical to SEQ ID NO: 72867
  misc_feature 1..243: note = chr11:44341082-44341325
  misc_feature 1..243: note = Hyper
  source 1..243: mol_type = genomic DNA

SEQ ID NO: 106232 - DNA, 68 bp, Homo sapiens; identical to SEQ ID NO: 3751
  misc_feature 1..68: note = chr11:44341966-44342034
  misc_feature 1..68: note = Hyper
  source 1..68: mol_type = genomic DNA

SEQ ID NO: 106233 - DNA, 30 bp, Homo sapiens; identical to SEQ ID NO: 72869
  misc_feature 1..30: note = chr11:44525426-44525456
  misc_feature 1..30: note = Hypo
  source 1..30: mol_type = genomic DNA

SEQ ID NO: 106234 - DNA, 66 bp, Homo sapiens; identical to SEQ ID NO: 72871
  misc_feature 1..66: note = chr11:44609349-44609415
  misc_feature 1..66: note = Hypo
  source 1..66: mol_type = genomic DNA

SEQ ID NO: 106235 - DNA, 42 bp, Homo sapiens; identical to SEQ ID NO: 72872
  misc_feature 1..42: note = chr11:44620240-44620282
  misc_feature 1..42: note = Hypo
  source 1..42: mol_type = genomic DNA

SEQ ID NO: 106236 - DNA, 30 bp, Homo sapiens; identical to SEQ ID NO: 72873
  misc_feature 1..30: note = chr11:44621968-44621998
  misc_feature 1..30: note = Hypo
  source 1..30: mol_type = genomic DNA

SEQ ID NO: 106237 - DNA, 229 bp, Homo sapiens; identical to SEQ ID NO: 72874
  misc_feature 1..229: note = chr11:44748190-44748419
  misc_feature 1..229: note = Hyper
  source 1..229: mol_type = genomic DNA

SEQ ID NO: 106238 - DNA, 196 bp, Homo sapiens; identical to SEQ ID NO: 72875
  misc_feature 1..196: note = chr11:44748675-44748871
  misc_feature 1..196: note = Hyper
  source 1..196: mol_type = genomic DNA

SEQ ID NO: 106239 - DNA, 34 bp, Homo sapiens; identical to SEQ ID NO: 72876
  misc_feature 1..34: note = chr11:44749184-44749218
  misc_feature 1..34: note = Hyper
  source 1..34: mol_type = genomic DNA

SEQ ID NO: 106240 - DNA, 51 bp, Homo sapiens; identical to SEQ ID NO: 72878
  misc_feature 1..51: note = chr11:44919182-44919233
  misc_feature 1..51: note = Hypo
  source 1..51: mol_type = genomic DNA

SEQ ID NO: 106241 - DNA, 281 bp, Homo sapiens; identical to SEQ ID NO: 72879
  misc_feature 1..281: note = chr11:44922693-44922974
  misc_feature 1..281: note = Hypo
  source 1..281: mol_type = genomic DNA

SEQ ID NO: 106242 - DNA, 30 bp, Homo sapiens; identical to SEQ ID NO: 72880
  misc_feature 1..30: note = chr11:44925810-44925840
  misc_feature 1..30: note = Hypo
  source 1..30: mol_type = genomic DNA

SEQ ID NO: 106243 - DNA, 142 bp, Homo sapiens; identical to SEQ ID NO: 72881
  misc_feature 1..142: note = chr11:44929860-44930002
  misc_feature 1..142: note = Hypo
  source 1..142: mol_type = genomic DNA

SEQ ID NO: 106244 - DNA, 33 bp, Homo sapiens; identical to SEQ ID NO: 72882
  misc_feature 1..33: note = chr11:44931098-44931131
  misc_feature 1..33: note = Hypo
  source 1..33: mol_type = genomic DNA

SEQ ID NO: 106245 - DNA, 132 bp, Homo sapiens; identical to SEQ ID NO: 72884
  misc_feature 1..132: note = chr11:44941372-44941504
  misc_feature 1..132: note = Hypo
  source 1..132: mol_type = genomic DNA

SEQ ID NO: 106246 - DNA, 32 bp, Homo sapiens; identical to SEQ ID NO: 72886
  misc_feature 1..32: note = chr11:45167668-45167700
  misc_feature 1..32: note = Hyper
  source 1..32: mol_type = genomic DNA

SEQ ID NO: 106247 - DNA, 23 bp, Homo sapiens
  misc_feature 1..23: note = chr11:45195161-45195184
  misc_feature 1..23: note = Hypo
  source 1..23: mol_type = genomic DNA
aaacaccgcgtcaaaaaaaaaaa

SEQ ID NO: 106248 - DNA, 37 bp, Homo sapiens; identical to SEQ ID NO: 72888
  misc_feature 1..37: note = chr11:45307820-45307857
  misc_feature 1..37: note = Hyper
  source 1..37: mol_type = genomic DNA

SEQ ID NO: 106249 - DNA, 16 bp, Homo sapiens
  misc_feature 1..16: note = chr11:45337961-45337977
  misc_feature 1..16: note = Hypo
  source 1..16: mol_type = genomic DNA
gcgcccagtctaaaaa

SEQ ID NO: 106250 - DNA, 56 bp, Homo sapiens; identical to SEQ ID NO: 72890
  misc_feature 1..56: note = chr11:45376235-45376291
  misc_feature 1..56: note = Hypo
  source 1..56: mol_type = genomic DNA

SEQ ID NO: 106251 - DNA, 338 bp, Homo sapiens
  misc_feature 1..338: note = chr11:45376858-45377196
  misc_feature 1..338: note = Hyper
  source 1..338: mol_type = genomic DNA
agaaaggagaggaggcggagacggttagtctagcctctctgtggggcctctctgctggtacccagatgctgagcgctgaaattctcatccgccacacacaacatggcggcttcctggacccgcgcccaattttcgcttccgggatggaagctacgtcatttccccctctgttgccctagcgccccttggaagccaagaatatgaggaagtcttcttccttcgcgccttcttcttccttacgctccagggcagcctgacagagccgctcgaaggctctgctggccgcggctagccggtgaggagggtggggggaggggccgtcccgcgtgtgggggagt

SEQ ID NO: 106252 - DNA, 65 bp, Homo sapiens; identical to SEQ ID NO: 72893
  misc_feature 1..65: note = chr11:45553228-45553293
  misc_feature 1..65: note = Hypo
  source 1..65: mol_type = genomic DNA

SEQ ID NO: 106253 - DNA, 808 bp, Homo sapiens
  misc_feature 1..808: note = chr11:45686237-45687045
  misc_feature 1..808: note = Hyper
  source 1..808: mol_type = genomic DNA
gcagcggtctgggtgcggaggccgggccagggctgggagcaggaagcagggagcggcgcccccgcctccgggtgcagctgggtttggaaagttggtgcgggcgcggggacctcagggtctcaaggcgcctccgcagacccgagccaggcgggtcgtgggacggtgagcccggagcagcccctgagtgcgctccgcagcggaggggagccaagcgcctcgggggccaccgcgcgtctcaagtttgctgccctcctcgaatgggggcagggagggctgaggtgatcgcggcgctcaccggccaccagccccggcagccccttcctgcgcccaacacgccgccgttcctcgccgccgccacccctccgctcaccgccggtagctgctgtccccgagcggaggggcgtctcccaccgcgcccgcgcccctcccggctgctgcggcggagtgtccgctcccgcccgccccggagcccgcggggcccggccaatacctggtcggggacgcgccgggagcagctgcagcgcccagcgccggctccatcctcgggtctggagtcagggtcgccggggacccgcgggtggcggcggcggcagcagccgcggcggcatcctccgcctcccgcgccctcctcctcggcctccctcctccctcctcttcctccgactccgcgcgcgcctcacgggcccctcttcatggcccgggggcgcgagcccggggcggctcgagcagctgagtgcgttctctccggccggacgcgggacccggggccggggctcagggacccgagagatgccgggacaggggccgg

SEQ ID NO: 106254 - DNA, 30 bp, Homo sapiens; identical to SEQ ID NO: 72896
  misc_feature 1..30: note = chr11:45825671-45825701
  misc_feature 1..30: note = Hyper
  source 1..30: mol_type = genomic DNA

SEQ ID NO: 106255 - DNA, 30 bp, Homo sapiens; identical to SEQ ID NO: 72897
  misc_feature 1..30: note = chr11:45902551-45902581
  misc_feature 1..30: note = Hypo
  source 1..30: mol_type = genomic DNA

SEQ ID NO: 106256 - DNA, 63 bp, Homo sapiens; identical to SEQ ID NO: 72898
  misc_feature 1..63: note = chr11:45921994-45922057
  misc_feature 1..63: note = Hyper
  source 1..63: mol_type = genomic DNA

SEQ ID NO: 106257 - DNA, 23 bp, Homo sapiens
  misc_feature 1..23: note = chr11:46038808-46038831
  misc_feature 1..23: note = Hypo
  source 1..23: mol_type = genomic DNA
accacgcccggcctacatctatt

SEQ ID NO: 106258 - DNA, 30 bp, Homo sapiens; identical to SEQ ID NO: 72900
  misc_feature 1..30: note = chr11:46141017-46141047
  misc_feature 1..30: note = Hyper
  source 1..30: mol_type = genomic DNA

SEQ ID NO: 106259 - DNA, 169 bp, Homo sapiens; identical to SEQ ID NO: 72901
  misc_feature 1..169: note = chr11:46259315-46259484
  misc_feature 1..169: note = Hyper
  source 1..169: mol_type = genomic DNA

SEQ ID NO: 106260 - DNA, 33 bp, Homo sapiens; identical to SEQ ID NO: 43057
  misc_feature 1..33: note = chr11:46298483-46298516
  misc_feature 1..33: note = Hypo
  source 1..33: mol_type = genomic DNA

SEQ ID NO: 106261 - DNA, 109 bp, Homo sapiens; identical to SEQ ID NO: 72903
  misc_feature 1..109: note = chr11:46299747-46299856
  misc_feature 1..109: note = Hyper
  source 1..109: mol_type = genomic DNA

SEQ ID NO: 106262 - DNA, 910 bp, Homo sapiens
  misc_feature 1..910: note = chr11:46316818-46317728
  misc_feature 1..910: note = Hyper
  source 1..910: mol_type = genomic DNA
gtaccattactgccccgggagagtcccctctgccgccaccagagacagccaccaaagcgccccacggtaggacgattcgagatggagctgcaaggggatttaaggcccggctcgccctttgagtcggggtcgtcggggagaccctcggtctccacttctccctgcgggggtgggggcggggccgcgctactgatgaggggtttaggacaccgtgagacggccaggccatttctgcctcggccccagacgcagaaggggtcccatgcaggcccgagccagtgcaccctgcgctccctcagccgcgggccgtcggcgcaggccgggaccctcctccgcgcgagccctgcactcctccggtgccctccacgccgccaccggctgctgctcgcagcctcccgccattggccaggagctctgcggctcccaccagtgagcaggccggattccggtgaggggcggccccgggtgttcccgggttaaccctttgtgggccgctccaggacggcggcacccggatccttctctaaaatttaaagggcgggcggctgaggccaggctccaagagagggtgcagccgagaagaggggtacgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctcttgctccccaatttccatcggacaatctaaacc

SEQ ID NO: 106263 - DNA, 33 bp, Homo sapiens; identical to SEQ ID NO: 72907
  misc_feature 1..33: note = chr11:46332619-46332652
  misc_feature 1..33: note = Hypo
  source 1..33: mol_type = genomic DNA

SEQ ID NO: 106264 - DNA, 591 bp, Homo sapiens
  misc_feature 1..591: note = chr11:46354344-46354935
  misc_feature 1..591: note = Hyper
  source 1..591: mol_type = genomic DNA
gccctgagctaggttcgtgcccgtggtgggctgggccgggctcgctcccttcgtgccctgagcgggcgggctgggcggagcggcgccctcccctccggaccccaccggctggagagtgtctctaaggtgacactcgggtgcgcggcagcagcggcggttgcaggagctcgctctccgcccgggctccggctccgctccagccgtccggggggcgccgcggcgcgcagagcgcagcaccccgactccagccaggagcccccgcccccccggagcgcaggaggaccccggcccgcctctcccaggcgcagcgcccagcatctcgctgctcctgtcgtctaagcgtcggcgtcgctagggacctgcggaacccggcgctcccctccctccccgcctcgcgtccccggcccgggcggactggagactcgaacttgagcgggtgcccgaaaggccgcaggagccgcgggcggaaggcggccgcacgatggccgaggggcagggcggcggagggcagcgctgggactgggctggcggcggccgggcagccgaggaggaggtggtgcggcggcgatgccggcgcggggaggaggccca

SEQ ID NO: 106265 - DNA, 123 bp, Homo sapiens; identical to SEQ ID NO: 72910
  misc_feature 1..123: note = chr11:46403934-46404057
  misc_feature 1..123: note = Hyper
  source 1..123: mol_type = genomic DNA

SEQ ID NO: 106266 - DNA, 209 bp, Homo sapiens; identical to SEQ ID NO: 72911
  misc_feature 1..209: note = chr11:46405726-46405935
  misc_feature 1..209: note = Hypo
  source 1..209: mol_type = genomic DNA

SEQ ID NO: 106267 - DNA, 103 bp, Homo sapiens; identical to SEQ ID NO: 72912
  misc_feature 1..103: note = chr11:46413862-46413965
  misc_feature 1..103: note = Hyper
  source 1..103: mol_type = genomic DNA

SEQ ID NO: 106268 - DNA, 221 bp, Homo sapiens; identical to SEQ ID NO: 72913
  misc_feature 1..221: note = chr11:46414479-46414700
  misc_feature 1..221: note = Hyper
  source 1..221: mol_type = genomic DNA

SEQ ID NO: 106269 - DNA, 22 bp, Homo sapiens
  misc_feature 1..22: note = chr11:46614016-46614038
  misc_feature 1..22: note = Hypo
  source 1..22: mol_type = genomic DNA
tacaacaaaactgggcgggcgc

SEQ ID NO: 106270 - DNA, 30 bp, Homo sapiens; identical to SEQ ID NO: 43060
  misc_feature 1..30: note = chr11:46774904-46774934
  misc_feature 1..30: note = Hypo
  source 1..30: mol_type = genomic DNA

SEQ ID NO: 106271 - DNA, 19 bp, Homo sapiens
  misc_feature 1..19: note = chr11:46777041-46777060
  misc_feature 1..19: note = Hypo
  source 1..19: mol_type = genomic DNA
ccaccgcacctggccccat

SEQ ID NO: 106272 - DNA, 85 bp, Homo sapiens; identical to SEQ ID NO: 72917
  misc_feature 1..85: note = chr11:46872609-46872694
  misc_feature 1..85: note = Hypo
  source 1..85: mol_type = genomic DNA

SEQ ID NO: 106273 - DNA, 53 bp, Homo sapiens; identical to SEQ ID NO: 72918
  misc_feature 1..53: note = chr11:46916169-46916222
  misc_feature 1..53: note = Hypo
  source 1..53: mol_type = genomic DNA

SEQ ID NO: 106274 - DNA, 16 bp, Homo sapiens
  misc_feature 1..16: note = chr11:46920026-46920042
  misc_feature 1..16: note = Hypo
  source 1..16: mol_type = genomic DNA
gcgcccagccggtagt

SEQ ID NO: 106275 - DNA, 635 bp, Homo sapiens; identical to SEQ ID NO: 33862
  misc_feature 1..635: note = chr11:46938439-46939074
  misc_feature 1..635: note = Hyper
  source 1..635: mol_type = genomic DNA

SEQ ID NO: 106276 - DNA, 167 bp, Homo sapiens
  misc_feature 1..167: note = chr11:46939396-46939563
  misc_feature 1..167: note = Hyper
  source 1..167: mol_type = genomic DNA
agtaccagattctaccggggcctctctccgcaacccgcccgagcccccagccccaggaaggagggctatttacaatttatgggtttagcgaccctcctcacccgcctccctttcttcgcacgcattcattcgcaccaaggacacagagcccccgacctaacctgaaa

SEQ ID NO: 106277 - DNA, 83 bp, Homo sapiens; identical to SEQ ID NO: 72923
  misc_feature 1..83: note = chr11:46957761-46957844
  misc_feature 1..83: note = Hypo
  source 1..83: mol_type = genomic DNA

SEQ ID NO: 106278 - DNA, 41 bp, Homo sapiens; identical to SEQ ID NO: 72924
  misc_feature 1..41: note = chr11:46959060-46959101
  misc_feature 1..41: note = Hypo
  source 1..41: mol_type = genomic DNA

SEQ ID NO: 106279 - DNA, 105 bp, Homo sapiens; identical to SEQ ID NO: 72925
  misc_feature 1..105: note = chr11:47178630-47178735
  misc_feature 1..105: note = Hypo
  source 1..105: mol_type = genomic DNA

SEQ ID NO: 106280 - DNA, 699 bp, Homo sapiens; identical to SEQ ID NO: 72926
  misc_feature 1..699: note = chr11:47208581-47209280
  misc_feature 1..699: note = Hyper
  source 1..699: mol_type = genomic DNA

SEQ ID NO: 106281 - DNA, 144 bp, Homo sapiens; identical to SEQ ID NO: 72927
  misc_feature 1..144: note = chr11:47215919-47216063
  misc_feature 1..144: note = Hypo
  source 1..144: mol_type = genomic DNA

SEQ ID NO: 106282 - DNA, 266 bp, Homo sapiens; identical to SEQ ID NO: 43063
  misc_feature 1..266: note = chr11:47358971-47359237
  misc_feature 1..266: note = Hypo
  source 1..266: mol_type = genomic DNA

SEQ ID NO: 106283 - DNA, 141 bp, Homo sapiens; identical to SEQ ID NO: 72929
  misc_feature 1..141: note = chr11:47367760-47367901
  misc_feature 1..141: note = Hypo
  source 1..141: mol_type = genomic DNA

SEQ ID NO: 106284 - DNA, 30 bp, Homo sapiens; identical to SEQ ID NO: 72930
  misc_feature 1..30: note = chr11:47463077-47463107
  misc_feature 1..30: note = Hypo
  source 1..30: mol_type = genomic DNA

SEQ ID NO: 106285 - DNA, 198 bp, Homo sapiens; identical to SEQ ID NO: 72931
  misc_feature 1..198: note = chr11:47599117-47599315
  misc_feature 1..198: note = Hypo
  source 1..198: mol_type = genomic DNA

SEQ ID NO: 106286 - DNA, 213 bp, Homo sapiens; identical to SEQ ID NO: 72932
  misc_feature 1..213: note = chr11:47615713-47615926
  misc_feature 1..213: note = Hyper
  source 1..213: mol_type = genomic DNA

SEQ ID NO: 106287 - DNA, 23 bp, Homo sapiens
  misc_feature 1..23: note = chr11:47873752-47873775
  misc_feature 1..23: note = Hypo
  source 1..23: mol_type = genomic DNA
agtcaccgcgcctggccacactt

SEQ ID NO: 106288 - DNA, 35 bp, Homo sapiens; identical to SEQ ID NO: 43066
  misc_feature 1..35: note = chr11:49212608-49212643
  misc_feature 1..35: note = Hypo
  source 1..35: mol_type = genomic DNA

SEQ ID NO: 106289 - DNA, 109 bp, Homo sapiens; identical to SEQ ID NO: 72940
  misc_feature 1..109: note = chr11:49229761-49229870
  misc_feature 1..109: note = Hyper
  source 1..109: mol_type = genomic DNA

SEQ ID NO: 106290 - DNA, 30 bp, Homo sapiens; identical to SEQ ID NO: 72942
  misc_feature 1..30: note = chr11:49837177-49837207
  misc_feature 1..30: note = Hypo
  source 1..30: mol_type = genomic DNA

SEQ ID NO: 106291 - DNA, 30 bp, Homo sapiens; identical to SEQ ID NO: 43067
  misc_feature 1..30: note = chr11:50205839-50205869
  misc_feature 1..30: note = Hypo
  source 1..30: mol_type = genomic DNA

SEQ ID NO: 106292 - DNA, 45 bp, Homo sapiens; identical to SEQ ID NO: 72944
  misc_feature 1..45: note = chr11:50206566-50206611
  misc_feature 1..45: note = Hypo
  source 1..45: mol_type = genomic DNA

SEQ ID NO: 106293 - DNA, 163 bp, Homo sapiens; identical to SEQ ID NO: 72945
  misc_feature 1..163: note = chr11:50256715-50256878
  misc_feature 1..163: note = Hypo
  source 1..163: mol_type = genomic DNA

SEQ ID NO: 106294 - DNA, 21 bp, Homo sapiens
  misc_feature 1..21: note = chr11:55684103-55684124
  misc_feature 1..21: note = Hypo
  source 1..21: mol_type = genomic DNA
ttatttaaaagaaaacgtggc

SEQ ID NO: 106295 - DNA, 37 bp, Homo sapiens; identical to SEQ ID NO: 72960
  misc_feature 1..37: note = chr11:55743007-55743044
  misc_feature 1..37: note = Hypo
  source 1..37: mol_type = genomic DNA

SEQ ID NO: 106296 - DNA, 160 bp, Homo sapiens; identical to SEQ ID NO: 72962
  misc_feature 1..160: note = chr11:55918225-55918385
  misc_feature 1..160: note = Hypo
  source 1..160: mol_type = genomic DNA

SEQ ID NO: 106297 - DNA, 30 bp, Homo sapiens; identical to SEQ ID NO: 72963
  misc_feature 1..30: note = chr11:55919964-55919994
  misc_feature 1..30: note = Hypo
  source 1..30: mol_type = genomic DNA

SEQ ID NO: 106298 - DNA, 32 bp, Homo sapiens; identical to SEQ ID NO: 72968
  misc_feature 1..32: note = chr11:57056902-57056934
  misc_feature 1..32: note = Hyper
  source 1..32: mol_type = genomic DNA

SEQ ID NO: 106299 - DNA, 137 bp, Homo sapiens; identical to SEQ ID NO: 72969
  misc_feature 1..137: note = chr11:57071533-57071670
  misc_feature 1..137: note = Hypo
  source 1..137: mol_type = genomic DNA

SEQ ID NO: 106300 - DNA, 230 bp, Homo sapiens; identical to SEQ ID NO: 72970
  misc_feature 1..230: note = chr11:57117349-57117579
  misc_feature 1..230: note = Hyper
  source 1..230: mol_type = genomic DNA

SEQ ID NO: 106301 - DNA, 40 bp, Homo sapiens; identical to SEQ ID NO: 72971
  misc_feature 1..40: note = chr11:57150498-57150538
  misc_feature 1..40: note = Hypo
  source 1..40: mol_type = genomic DNA

SEQ ID NO: 106302 - DNA, 30 bp, Homo sapiens; identical to SEQ ID NO: 72972
  misc_feature 1..30: note = chr11:57168307-57168337
  misc_feature 1..30: note = Hypo
  source 1..30: mol_type = genomic DNA

SEQ ID NO: 106303 - DNA, 30 bp, Homo sapiens; identical to SEQ ID NO: 72973
  misc_feature 1..30: note = chr11:57168787-57168817
  misc_feature 1..30: note = Hypo
  source 1..30: mol_type = genomic DNA

SEQ ID NO: 106304 - DNA, 614 bp, Homo sapiens; identical to SEQ ID NO: 72975
  misc_feature 1..614: note = chr11:57194178-57194792
  misc_feature 1..614: note = Hyper
  source 1..614: mol_type = genomic DNA

SEQ ID NO: 106305 - DNA, 49 bp, Homo sapiens
  misc_feature 1..49: note = chr11:57227221-57227270
  misc_feature 1..49: note = Hyper
  source 1..49: mol_type = genomic DNA
acgcacacactcgcacgcgcgcccatctcgcacccgcttgtaaatgcac

SEQ ID NO: 106306 - DNA, 207 bp, Homo sapiens; identical to SEQ ID NO: 72978
  misc_feature 1..207: note = chr11:57235251-57235458
  misc_feature 1..207: note = Hypo
  source 1..207: mol_type = genomic DNA

SEQ ID NO: 106307 - DNA, 69 bp, Homo sapiens; identical to SEQ ID NO: 72979
  misc_feature 1..69: note = chr11:57243666-57243735
  misc_feature 1..69: note = Hyper
  source 1..69: mol_type = genomic DNA

SEQ ID NO: 106308 - DNA, 30 bp, Homo sapiens
  misc_feature 1..30: note = chr11:57244209-57244239
  misc_feature 1..30: note = Hyper
  source 1..30: mol_type = genomic DNA
cgcgcctactgaggacgactactggggggg

SEQ ID NO: 106309 - DNA, 32 bp, Homo sapiens; identical to SEQ ID NO: 72980
  misc_feature 1..32: note = chr11:57281984-57282016
  misc_feature 1..32: note = Hyper
  source 1..32: mol_type = genomic DNA

SEQ ID NO: 106310 - DNA, 30 bp, Homo sapiens; identical to SEQ ID NO: 72981
  misc_feature 1..30: note = chr11:57308593-57308623
  misc_feature 1..30: note = Hypo
  source 1..30: mol_type = genomic DNA

SEQ ID NO: 106311 - DNA, 163 bp, Homo sapiens; identical to SEQ ID NO: 72982
  misc_feature 1..163: note = chr11:57311354-57311517
  misc_feature 1..163: note = Hypo
  source 1..163: mol_type = genomic DNA

SEQ ID NO: 106312 - DNA, 33 bp, Homo sapiens; identical to SEQ ID NO: 72983
  misc_feature 1..33: note = chr11:57373422-57373455
  misc_feature 1..33: note = Hypo
  source 1..33: mol_type = genomic DNA

SEQ ID NO: 106313 - DNA, 30 bp, Homo sapiens; identical to SEQ ID NO: 72984
  misc_feature 1..30: note = chr11:57405988-57406018
  misc_feature 1..30: note = Hyper
  source 1..30: mol_type = genomic DNA

SEQ ID NO: 106314 - DNA, 30 bp, Homo sapiens; identical to SEQ ID NO: 72985
  misc_feature 1..30: note = chr11:57417507-57417537
  misc_feature 1..30: note = Hyper
  source 1..30: mol_type = genomic DNA

SEQ ID NO: 106315 - DNA, 30 bp, Homo sapiens; identical to SEQ ID NO: 72986
  misc_feature 1..30: note = chr11:57421913-57421943
  misc_feature 1..30: note = Hypo
  source 1..30: mol_type = genomic DNA

SEQ ID NO: 106316 - DNA, 25 bp, Homo sapiens
  misc_feature 1..25: note = chr11:57423912-57423937
  misc_feature 1..25: note = Hypo
  source 1..25: mol_type = genomic DNA
ttattataaccggactcagaaactc

SEQ ID NO: 106317 - DNA, 20 bp, Homo sapiens
  misc_feature 1..20: note = chr11:57437214-57437234
  misc_feature 1..20: note = Hypo
  source 1..20: mol_type = genomic DNA
gcccccgtgcccagctggca

SEQ ID NO: 106318 - DNA, 37 bp, Homo sapiens; identical to SEQ ID NO: 72989
  misc_feature 1..37: note = chr11:57501031-57501068
  misc_feature 1..37: note = Hypo
  source 1..37: mol_type = genomic DNA

SEQ ID NO: 106319 - DNA, 91 bp, Homo sapiens; identical to SEQ ID NO: 72990
  misc_feature 1..91: note = chr11:57548730-57548821
  misc_feature 1..91: note = Hypo
  source 1..91: mol_type = genomic DNA

SEQ ID NO: 106320 - DNA, 18 bp, Homo sapiens
  misc_feature 1..18: note = chr11:57551113-57551131
  misc_feature 1..18: note = Hypo
  source 1..18: mol_type = genomic DNA
gagcgagactccatctca

SEQ ID NO: 106321 - DNA, 30 bp, Homo sapiens; identical to SEQ ID NO: 72993
  misc_feature 1..30: note = chr11:57994277-57994307
  misc_feature 1..30: note = Hypo
  source 1..30: mol_type = genomic DNA

SEQ ID NO: 106322 - DNA, 148 bp, Homo sapiens; identical to SEQ ID NO: 72994
  misc_feature 1..148: note = chr11:58275194-58275342
  misc_feature 1..148: note = Hypo
  source 1..148: mol_type = genomic DNA

SEQ ID NO: 106323 - DNA, 141 bp, Homo sapiens; identical to SEQ ID NO: 72995
  misc_feature 1..141: note = chr11:58406402-58406543
  misc_feature 1..141: note = Hypo
  source 1..141: mol_type = genomic DNA

SEQ ID NO: 106324 - DNA, 229 bp, Homo sapiens; identical to SEQ ID NO: 72996
  misc_feature 1..229: note = chr11:58668329-58668558
  misc_feature 1..229: note = Hyper
  source 1..229: mol_type = genomic DNA

SEQ ID NO: 106325 - DNA, 603 bp, Homo sapiens
  misc_feature 1..603: note = chr11:58672686-58673289
  misc_feature 1..603: note = Hyper
  source 1..603: mol_type = genomic DNA
ggcattgtctgtgttcgccagcccctccacgaagttggatcatttgcggagcaggccaagtccctctagacctcacgcagacgcgggtgcagcctgctctgcgacttgcagtcagctggaagctgggcctctgcatcatcagggtggagctctctctgctgctgccgctggatcccgcctggatgcacgtcccgccaccgccgccgacccatcagcggcagaagggcagcaatggccacacaccgaagcaccttggcgggctattccccttgcagctctcctcagcgcgctgctcccactcgcaatcaaaaggcggaaaaagcgcgaaaccgccaggcatctcccatacccacccggctgccgcgcaacccctccttggcttccactgggagacaggggacgccgatgagcaggaagaagcagggcagtgactgcttagtttatcctggtacgcgggaactggctgtggaccgagtggttcgggggaggggatcgctgggaccgggatgggtcatctggacaaatagggagggtgggcgggtgggcgcgcagtcccctcggcctggccgtctgacccgcccgcgagcgcgtgcgcccaggcgt

SEQ ID NO: 106326 - DNA, 16 bp, Homo sapiens
  misc_feature 1..16: note = chr11:58821650-58821666
  misc_feature 1..16: note = Hypo
  source 1..16: mol_type = genomic DNA
gcgtggcctcctattc

SEQ ID NO: 106327 - DNA, 152 bp, Homo sapiens; identical to SEQ ID NO: 73000
  misc_feature 1..152: note = chr11:58835165-58835317
  misc_feature 1..152: note = Hypo
  source 1..152: mol_type = genomic DNA

SEQ ID NO: 106328 - DNA, 30 bp, Homo sapiens; identical to SEQ ID NO: 73001
  misc_feature 1..30: note = chr11:58953988-58954018
  misc_feature 1..30: note = Hypo
  source 1..30: mol_type = genomic DNA

SEQ ID NO: 106329 - DNA, 179 bp, Homo sapiens; identical to SEQ ID NO: 73002
  misc_feature 1..179: note = chr11:59245284-59245463
  misc_feature 1..179: note = Hypo
  source 1..179: mol_type = genomic DNA

SEQ ID NO: 106330 - DNA, 30 bp, Homo sapiens; identical to SEQ ID NO: 15547
  misc_feature 1..30: note = chr11:59312651-59312681
  misc_feature 1..30: note = Hypo
  source 1..30: mol_type = genomic DNA

SEQ ID NO: 106331 - DNA, 53 bp, Homo sapiens; identical to SEQ ID NO: 33871
  misc_feature 1..53: note = chr11:59318986-59319039
  misc_feature 1..53: note = Hyper
  source 1..53: mol_type = genomic DNA

SEQ ID NO: 106332 - DNA, 30 bp, Homo sapiens; identical to SEQ ID NO: 73005
  misc_feature 1..30: note = chr11:59323446-59323476
  misc_feature 1..30: note = Hyper
  source 1..30: mol_type = genomic DNA

SEQ ID NO: 106333 - DNA, 28 bp, Homo sapiens
  misc_feature 1..28: note = chr11:59323871-59323899
  misc_feature 1..28: note = Hyper
  source 1..28: mol_type = genomic DNA
gatagactaagcaaacgcttttcttcag

SEQ ID NO: 106334 - DNA, 28 bp, Homo sapiens
  misc_feature 1..28: note = chr11:59323959-59323987
  misc_feature 1..28: note = Hyper
  source 1..28: mol_type = genomic DNA
gtccctgttcgggcggatgctgttttag

SEQ ID NO: 106335 - DNA, 19 bp, Homo sapiens
  misc_feature 1..19: note = chr11:59328895-59328914
  misc_feature 1..19: note = Hypo
  source 1..19: mol_type = genomic DNA
accttaaaggctgggcgcg

SEQ ID NO: 106336 - DNA, 138 bp, Homo sapiens; identical to SEQ ID NO: 43081
  misc_feature 1..138: note = chr11:59329214-59329352
  misc_feature 1..138: note = Hypo
  source 1..138: mol_type = genomic DNA

SEQ ID NO: 106337 - DNA, 330 bp, Homo sapiens; identical to SEQ ID NO: 73010
  misc_feature 1..330: note = chr11:59333343-59333673
  misc_feature 1..330: note = Hyper
  source 1..330: mol_type = genomic DNA

SEQ ID NO: 106338 - DNA, 30 bp, Homo sapiens; identical to SEQ ID NO: 73014
  misc_feature 1..30: note = chr11:59521144-59521174
  misc_feature 1..30: note = Hypo
  source 1..30: mol_type = genomic DNA

SEQ ID NO: 106339 - DNA, 61 bp, Homo sapiens; identical to SEQ ID NO: 73016
  misc_feature 1..61: note = chr11:59609779-59609840
  misc_feature 1..61: note = Hypo
  source 1..61: mol_type = genomic DNA

SEQ ID NO: 106340 - DNA, 188 bp, Homo sapiens; identical to SEQ ID NO: 73017
  misc_feature 1..188: note = chr11:59807943-59808131
  misc_feature 1..188: note = Hypo
  source 1..188: mol_type = genomic DNA

SEQ ID NO: 106341 - DNA, 120 bp, Homo sapiens; identical to SEQ ID NO: 73018
  misc_feature 1..120: note = chr11:59841387-59841507
  misc_feature 1..120: note = Hypo
  source 1..120: mol_type = genomic DNA

SEQ ID NO: 106342 - DNA, 30 bp, Homo sapiens; identical to SEQ ID NO: 43085
  misc_feature 1..30: note = chr11:60282848-60282878
  misc_feature 1..30: note = Hypo
  source 1..30: mol_type = genomic DNA

SEQ ID NO: 106343 - DNA, 23 bp, Homo sapiens
  misc_feature 1..23: note = chr11:60409067-60409090
  misc_feature 1..23: note = Hypo
  source 1..23: mol_type = genomic DNA
ttatatactttcccccgttctat

SEQ ID NO: 106344 - DNA, 213 bp, Homo sapiens; identical to SEQ ID NO: 73021
  misc_feature 1..213: note = chr11:60524504-60524717
  misc_feature 1..213: note = Hypo
  source 1..213: mol_type = genomic DNA

SEQ ID NO: 106345 - DNA, 26 bp, Homo sapiens
  misc_feature 1..26: note = chr11:60535370-60535396
  misc_feature 1..26: note = Hypo
  source 1..26: mol_type = genomic DNA
aaaggacgggaaaggcggggcacggt

SEQ ID NO: 106346 - DNA, 67 bp, Homo sapiens; identical to SEQ ID NO: 73024
  misc_feature 1..67: note = chr11:60640875-60640942
  misc_feature 1..67: note = Hypo
  source 1..67: mol_type = genomic DNA

SEQ ID NO: 106347 - DNA, 609 bp, Homo sapiens
  misc_feature 1..609: note = chr11:60718628-60719237
  misc_feature 1..609: note = Hyper
  source 1..609: mol_type = genomic DNA
ccgcagaaggagctgcggccgtcggggaaggcggtggcgggcagcaggcccgaggcggccaggtagagcagcaggctgagcgcgaccgcgcggtagcggcccaggtacacgtcggccagccagccgcccacgggcgccagcaggtaggaggcgcccaggaataccagcgcggcgcgcgtcgcctgctcgccggtccagttgaagttggtgctgttgaggtacagcacgaggttggcggtgacgccgaagaaggcggcgcgctccagcatctccaccagcagcacggccgcgcccgccgcccgccgccaccgtcgagggccccgcgcaccgcgaggcagcagcggctggcgctccccgggcacgcggggctgctcccgggcgcgcggcgcgggcatcctggctccgggctgggccccccgcggctcttctctcctctcctctccccgcctcagagccctgcactcctgcccccgggcctcggccctctcccccacccaactggctggccctcctttctcaccgctttggcccacccttccctcctgtcccctctccctttcttgccctacccttcctgtccctccgctcactacccggactctaccacct

SEQ ID NO: 106348 - DNA, 30 bp, Homo sapiens; identical to SEQ ID NO: 43087
  misc_feature 1..30: note = chr11:60892552-60892582
  misc_feature 1..30: note = Hypo
  source 1..30: mol_type = genomic DNA

SEQ ID NO: 106349 - DNA, 170 bp, Homo sapiens; identical to SEQ ID NO: 73029
  misc_feature 1..170: note = chr11:60897862-60898032
  misc_feature 1..170: note = Hypo
  source 1..170: mol_type = genomic DNA

SEQ ID NO: 106350 - DNA, 86 bp, Homo sapiens; identical to SEQ ID NO: 73030
  misc_feature 1..86: note = chr11:60927434-60927520
  misc_feature 1..86: note = Hypo
  source 1..86: mol_type = genomic DNA

SEQ ID NO: 106351 - DNA, 171 bp, Homo sapiens; identical to SEQ ID NO: 5117
  misc_feature 1..171: note = chr11:60941596-60941767
  misc_feature 1..171: note = Hypo
  source 1..171: mol_type = genomic DNA

SEQ ID NO: 106352 - DNA, 30 bp, Homo sapiens; identical to SEQ ID NO: 73032
  misc_feature 1..30: note = chr11:61014723-61014753
  misc_feature 1..30: note = Hypo
  source 1..30: mol_type = genomic DNA

SEQ ID NO: 106353 - DNA, 41 bp, Homo sapiens; identical to SEQ ID NO: 73033
  misc_feature 1..41: note = chr11:61027383-61027424
  misc_feature 1..41: note = Hypo
  source 1..41: mol_type = genomic DNA

SEQ ID NO: 106354 - DNA, 39 bp, Homo sapiens; identical to SEQ ID NO: 73034
  misc_feature 1..39: note = chr11:61036508-61036547
  misc_feature 1..39: note = Hypo
  source 1..39: mol_type = genomic DNA

SEQ ID NO: 106355 - DNA, 377 bp, Homo sapiens; identical to SEQ ID NO: 73035
  misc_feature 1..377: note = chr11:61038898-61039275
  misc_feature 1..377: note = Hypo
  source 1..377: mol_type = genomic DNA

SEQ ID NO: 106356 - DNA, 30 bp, Homo sapiens; identical to SEQ ID NO: 73036
  misc_feature 1..30: note = chr11:61041904-61041934
  misc_feature 1..30: note = Hypo
  source 1..30: mol_type = genomic DNA

SEQ ID NO: 106357 - DNA, 158 bp, Homo sapiens; identical to SEQ ID NO: 73037
  misc_feature 1..158: note = chr11:61049497-61049655
  misc_feature 1..158: note = Hypo
  source 1..158: mol_type = genomic DNA

SEQ ID NO: 106358 - DNA, 175 bp, Homo sapiens; identical to SEQ ID NO: 73038
  misc_feature 1..175: note = chr11:61058212-61058387
  misc_feature 1..175: note = Hypo
  source 1..175: mol_type = genomic DNA

SEQ ID NO: 106359 - DNA, 124 bp, Homo sapiens; identical to SEQ ID NO: 73039
  misc_feature 1..124: note = chr11:61058771-61058895
  misc_feature 1..124: note = Hypo
  source 1..124: mol_type = genomic DNA

SEQ ID NO: 106360 - DNA, 470 bp, Homo sapiens
  misc_feature 1..470: note = chr11:61062688-61063158
  misc_feature 1..470: note = Hyper
  source 1..470: mol_type = genomic DNA
aggggacgcggcggacgattgtggggagggtctctggcacctcgaagcgaaacacacaaaggcaacgccgcccgcctgctgatgcctctccgagaggcgcggagcccggggcgggggcaaagatcagggacccctgggggcggggtttcgccctcggcccacaccccctgccccggtttgggagtcggcttcctgcgaagcgctgactgaaggcgtcagaccgaggccccgggaggaaacagacttcgggaacaaggctagcaccagaggctgcgcgccccgggcatggcccctgtcggtgggacccgagacgccttgttgtgacgaggtgggaaccgtggaaattcgaacccacgacgccaggtcgctgtgccgctgagcagttctaggcctgcccccagcctgccagaaggtctgcaccctaacgccggagtgcgttgatctgtgggtccaaccgctccctggcctgg

SEQ ID NO: 106361 - DNA, 30 bp, Homo sapiens; identical to SEQ ID NO: 73042
  misc_feature 1..30: note = chr11:61112512-61112542
  misc_feature 1..30: note = Hypo
  source 1..30: mol_type = genomic DNA

SEQ ID NO: 106362 - DNA, 18 bp, Homo sapiens
  misc_feature 1..18: note = chr11:61198502-61198520
  misc_feature 1..18: note = Hypo
  source 1..18: mol_type = genomic DNA
tttttttttttgagacgg

SEQ ID NO: 106363 - DNA, 40 bp, Homo sapiens; identical to SEQ ID NO: 73044
  misc_feature 1..40: note = chr11:61276061-61276101
  misc_feature 1..40: note = Hyper
  source 1..40: mol_type = genomic DNA

SEQ ID NO: 106364 - DNA, 926 bp, Homo sapiens
  misc_feature 1..926: note = chr11:61276416-61277342
  misc_feature 1..926: note = Hyper
  source 1..926: mol_type = genomic DNA
cggggcgatgcctggcggtggcagtggcggcggccccggccggggcccgtgaccatgggcatcgccgagtccacgccggatgagctgccgtcggacgcagaggagcagctgcgcagcggcgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgctgctgcgcatgggccgcctgcacatcctcgacctcgaccgcaaccgcctgggcggcttccccgacctgcacccgctgcgcgcgctgcgcgtcttctcctacgaccacaaccccgtcaccgggcccccgcgcgtcgcggacaccgtgttcctcgtgggcgagggcgccgtcgagcgcatggcggagcgcgacgagcccacgccccggcctccgccccggcgcccagcgcgggcctttgaggatgaggaggaggaagacctgctcataggcggcgctggttcccgggctctgggcgcccccgggggcagcttccgcgccctggaagccgctccaggactggg

SEQ ID NO: 106365 - DNA, 30 bp, Homo sapiens; identical to SEQ ID NO: 73048
  misc_feature 1..30: note = chr11:61305680-61305710
  misc_feature 1..30: note = Hypo
  source 1..30: mol_type = genomic DNA

SEQ ID NO: 106366 - DNA, 518 bp, Homo sapiens; identical to SEQ ID NO: 73049
  misc_feature 1..518: note = chr11:61334835-61335353
  misc_feature 1..518: note = Hyper
  source 1..518: mol_type = genomic DNA

SEQ ID NO: 106367 - DNA, 95 bp, Homo sapiens; identical to SEQ ID NO: 73050
  misc_feature 1..95: note = chr11:61347879-61347974
  misc_feature 1..95: note = Hyper
  source 1..95: mol_type = genomic DNA

SEQ ID NO: 106368 - DNA, 38 bp, Homo sapiens; identical to SEQ ID NO: 73051
  misc_feature 1..38: note = chr11:61355533-61355571
  misc_feature 1..38: note = Hyper
  source 1..38: mol_type = genomic DNA

SEQ ID NO: 106369 - DNA, 43 bp, Homo sapiens; identical to SEQ ID NO: 73052
  misc_feature 1..43: note = chr11:61356081-61356124
  misc_feature 1..43: note = Hyper
  source 1..43: mol_type = genomic DNA

SEQ ID NO: 106370 - DNA, 93 bp, Homo sapiens; identical to SEQ ID NO: 73053
  misc_feature 1..93: note = chr11:61447983-61448076
  misc_feature 1..93: note = Hyper
  source 1..93: mol_type = genomic DNA

SEQ ID NO: 106371 - DNA, 51 bp, Homo sapiens; identical to SEQ ID NO: 73054
  misc_feature 1..51: note = chr11:61526128-61526179
  misc_feature 1..51: note = Hypo
  source 1..51: mol_type = genomic DNA

SEQ ID NO: 106372 - DNA, 30 bp, Homo sapiens; identical to SEQ ID NO: 73056
  misc_feature 1..30: note = chr11:61581920-61581950
  misc_feature 1..30: note = Hypo
  source 1..30: mol_type = genomic DNA

SEQ ID NO: 106373 - DNA, 239 bp, Homo sapiens
  misc_feature 1..239: note = chr11:61582570-61582809
  misc_feature 1..239: note = Hyper
  source 1..239: mol_type = genomic DNA
tggcgataagattcacgttggcaggtccggcagccccgggccctgtaagtgatgcggcgtgtggggcgggggccggggcggagccggcggccggtggcaccacacatacggaccaatcgccgtccccgccgcggcattcccggccccaaatcacactgcgggaagctccagcgttggtgcctgtttcgtctgcgcatgcgccgggacacgcctgcgcccttggccgcagtcagggctcc

SEQ ID NO: 106374 - DNA, 448 bp, Homo sapiens; identical to SEQ ID NO: 73059
  misc_feature 1..448: note = chr11:61583181-61583629
  misc_feature 1..448: note = Hyper
  source 1..448: mol_type = genomic DNA

SEQ ID NO: 106375 - DNA, 232 bp, Homo sapiens; identical to SEQ ID NO: 73060
  misc_feature 1..232: note = chr11:61583894-61584126
  misc_feature 1..232: note = Hyper
  source 1..232: mol_type = genomic DNA

SEQ ID NO: 106376 - DNA, 46 bp, Homo sapiens; identical to SEQ ID NO: 73061
  misc_feature 1..46: note = chr11:61584805-61584851
  misc_feature 1..46: note = Hyper
  source 1..46: mol_type = genomic DNA

SEQ ID NO: 106377 - DNA, 511 bp, Homo sapiens; identical to SEQ ID NO: 73062
  misc_feature 1..511: note = chr11:61594981-61595492
  misc_feature 1..511: note = Hyper
  source 1..511: mol_type = genomic DNA

SEQ ID NO: 106378 - DNA, 944 bp, Homo sapiens; identical to SEQ ID NO: 73063
  misc_feature 1..944: note = chr11:61595751-61596695
  misc_feature 1..944: note = Hyper
  source 1..944: mol_type = genomic DNA

SEQ ID NO: 106379 - DNA, 30 bp, Homo sapiens; identical to SEQ ID NO: 73064
  misc_feature 1..30: note = chr11:61625542-61625572
  misc_feature 1..30: note = Hypo
  source 1..30: mol_type = genomic DNA

SEQ ID NO: 106380 - DNA, 82 bp, Homo sapiens; identical to SEQ ID NO: 73065
  misc_feature 1..82: note = chr11:61633635-61633717
  misc_feature 1..82: note = Hypo
  source 1..82: mol_type = genomic DNA

SEQ ID NO: 106381 - DNA, 81 bp, Homo sapiens; identical to SEQ ID NO: 43095
  misc_feature 1..81: note = chr11:61641410-61641491
  misc_feature 1..81: note = Hypo
  source 1..81: mol_type = genomic DNA

SEQ ID NO: 106382 - DNA, 488 bp, Homo sapiens; identical to SEQ ID NO: 73068
  misc_feature 1..488: note = chr11:61664512-61665000
  misc_feature 1..488: note = Hypo
  source 1..488: mol_type = genomic DNA

SEQ ID NO: 106383 - DNA, 59 bp, Homo sapiens; identical to SEQ ID NO: 43097
  misc_feature 1..59: note = chr11:61665728-61665787
  misc_feature 1..59: note = Hypo
  source 1..59: mol_type = genomic DNA

SEQ ID NO: 106384 - DNA, 140 bp, Homo sapiens; identical to SEQ ID NO: 73070
  misc_feature 1..140: note = chr11:61666088-61666228
  misc_feature 1..140: note = Hypo
  source 1..140: mol_type = genomic DNA

SEQ ID NO: 106385 - DNA, 174 bp, Homo sapiens; identical to SEQ ID NO: 73071
  misc_feature 1..174: note = chr11:61669877-61670051
  misc_feature 1..174: note = Hypo
  source 1..174: mol_type = genomic DNA

SEQ ID NO: 106386 - DNA, 244 bp, Homo sapiens; identical to SEQ ID NO: 73072
  misc_feature 1..244: note = chr11:61674856-61675100
  misc_feature 1..244: note = Hypo
  source 1..244: mol_type = genomic DNA

SEQ ID NO: 106387 - DNA, 245 bp, Homo sapiens; identical to SEQ ID NO: 73073
  misc_feature 1..245: note = chr11:61684587-61684832
  misc_feature 1..245: note = Hyper
  source 1..245: mol_type = genomic DNA

SEQ ID NO: 106388 - DNA, 499 bp, Homo sapiens
  misc_feature 1..499: note = chr11:61722682-61723181
  misc_feature 1..499: note = Hyper
  source 1..499: mol_type = genomic DNA
cccttctggctgttccgggtccctgtggccgcccaggctccagacaggccaggggaggatcacgaggagctgcggcaaggggctggggagggggcgggggaacgccagcggcaggtcggcgcctctctgtagggaaaggtgcggactgcagccagtgaaactgaagttagacgttaggtaagacgtcctgccgttagcaatgaaaaccccattttctgagggaagcgctgacatcatggtccctggagcccctgcgcgggaggggagggggtctggcggatttctgggaccagcagggggacccccgggtgacagaacccttggggctctcgcgcctccatgcgaggctctgcctgcctctcgctcccgagcgccttccaggagggctgggggctaggcccgctcgcagcagaaagctggaggagccgaggcatcgccgggcgctgggccctgggctctggccgcagcctggcccctcgcccctcgccccccgcccctc

SEQ ID NO: 106389 - DNA, 32 bp, Homo sapiens; identical to SEQ ID NO: 73075
  misc_feature 1..32: note = chr11:61736195-61736227
  misc_feature 1..32: note = Hypo
  source 1..32: mol_type = genomic DNA

SEQ ID NO: 106390 - DNA, 23 bp, Homo sapiens
  misc_feature 1..23: note = chr11:61736670-61736693
  misc_feature 1..23: note = Hypo
  source 1..23: mol_type = genomic DNA
ttgcctggggctgggcgcggtgg

SEQ ID NO: 106391 - DNA, 82 bp, Homo sapiens; identical to SEQ ID NO: 43102
  misc_feature 1..82: note = chr11:61736993-61737075
  misc_feature 1..82: note = Hypo
  source 1..82: mol_type = genomic DNA

SEQ ID NO: 106392 - DNA, 42 bp, Homo sapiens; identical to SEQ ID NO: 73078
  misc_feature 1..42: note = chr11:61753272-61753314
  misc_feature 1..42: note = Hypo
  source 1..42: mol_type = genomic DNA

SEQ ID NO: 106393 - DNA, 30 bp, Homo sapiens; identical to SEQ ID NO: 43103
  misc_feature 1..30: note = chr11:61784772-61784802
  misc_feature 1..30: note = Hypo
  source 1..30: mol_type = genomic DNA

SEQ ID NO: 106394 - DNA, 137 bp, Homo sapiens; identical to SEQ ID NO: 73080
  misc_feature 1..137: note = chr11:61793162-61793299
  misc_feature 1..137: note = Hyper
  source 1..137: mol_type = genomic DNA

SEQ ID NO: 106395 - DNA, 30 bp, Homo sapiens; identical to SEQ ID NO: 73081
  misc_feature 1..30: note = chr11:61899800-61899830
  misc_feature 1..30: note = Hypo
  source 1..30: mol_type = genomic DNA

SEQ ID NO: 106396 - DNA, 256 bp, Homo sapiens; identical to SEQ ID NO: 73082
  misc_feature 1..256: note = chr11:62105312-62105568
  misc_feature 1..256: note = Hyper
  source 1..256: mol_type = genomic DNA

SEQ ID NO: 106397 - DNA, 35 bp, Homo sapiens; identical to SEQ ID NO: 73083
  misc_feature 1..35: note = chr11:62184274-62184309
  misc_feature 1..35: note = Hypo
  source 1..35: mol_type = genomic DNA

SEQ ID NO: 106398 - DNA, 203 bp, Homo sapiens; identical to SEQ ID NO: 73084
  misc_feature 1..203: note = chr11:62191247-62191450
  misc_feature 1..203: note = Hypo
  source 1..203: mol_type = genomic DNA

SEQ ID NO: 106399 - DNA, 228 bp, Homo sapiens; identical to SEQ ID NO: 43104
  misc_feature 1..228: note = chr11:62370522-62370750
  misc_feature 1..228: note = Hypo
  source 1..228: mol_type = genomic DNA

SEQ ID NO: 106400 - DNA, 95 bp, Homo sapiens; identical to SEQ ID NO: 43105
  misc_feature 1..95: note = chr11:62421710-62421805
  misc_feature 1..95: note = Hypo
  source 1..95: mol_type = genomic DNA

SEQ ID NO: 106401 - DNA, 30 bp, Homo sapiens; identical to SEQ ID NO: 43106
  misc_feature 1..30: note = chr11:62440622-62440652
  misc_feature 1..30: note = Hypo
  source 1..30: mol_type = genomic DNA

SEQ ID NO: 106402 - DNA, 117 bp, Homo sapiens; identical to SEQ ID NO: 73088
  misc_feature 1..117: note = chr11:62445413-62445530
  misc_feature 1..117: note = Hypo
  source 1..117: mol_type = genomic DNA

SEQ ID NO: 106403 - DNA, 78 bp, Homo sapiens; identical to SEQ ID NO: 73089
  misc_feature 1..78: note = chr11:62450128-62450206
  misc_feature 1..78: note = Hypo
  source 1..78: mol_type = genomic DNA

SEQ ID NO: 106404 - DNA, 27 bp, Homo sapiens
  misc_feature 1..27: note = chr11:62497829-62497856
  misc_feature 1..27: note = Hypo
  source 1..27: mol_type = genomic DNA
agccactgcacccggcccagtaatttt

SEQ ID NO: 106405 - DNA, 40 bp, Homo sapiens; identical to SEQ ID NO: 73092
  misc_feature 1..40: note = chr11:62609977-62610017
  misc_feature 1..40: note = Hyper
  source 1..40: mol_type = genomic DNA

SEQ ID NO: 106406 - DNA, 43 bp, Homo sapiens; identical to SEQ ID NO: 73093
  misc_feature 1..43: note = chr11:62661211-62661254
  misc_feature 1..43: note = Hypo
  source 1..43: mol_type = genomic DNA

SEQ ID NO: 106407 - DNA, 209 bp, Homo sapiens; identical to SEQ ID NO: 73094
  misc_feature 1..209: note = chr11:62666677-62666886
  misc_feature 1..209: note = Hypo
  source 1..209: mol_type = genomic DNA

SEQ ID NO: 106408 - DNA, 160 bp, Homo sapiens
  misc_feature 1..160: note = chr11:63258610-63258770
  misc_feature 1..160: note = Hyper
  source 1..160: mol_type = genomic DNA
gcactgggggcggctcggggaggaaccgcggaggggaaagcgccgcgggctgcaaacggcagaggcgcgcggggtggcgacagtggcgcgggcgcagtgagcgcgtccgagaacagaatgggacgaaacggggcgcttagaggcccgggaatctgtgggt

SEQ ID NO: 106409 - DNA, 101 bp, Homo sapiens; identical to SEQ ID NO: 73100
  misc_feature 1..101: note = chr11:63374106-63374207
  misc_feature 1..101: note = Hypo
  source 1..101: mol_type = genomic DNA

SEQ ID NO: 106410 - DNA, 101 bp, Homo sapiens; identical to SEQ ID NO: 73102
  misc_feature 1..101: note = chr11:63537119-63537220
  misc_feature 1..101: note = Hyper
  source 1..101: mol_type = genomic DNA

SEQ ID NO: 106411 - DNA, 154 bp, Homo sapiens; identical to SEQ ID NO: 73103
  misc_feature 1..154: note = chr11:63572071-63572225
  misc_feature 1..154: note = Hypo
  source 1..154: mol_type = genomic DNA

SEQ ID NO: 106412 - DNA, 96 bp, Homo sapiens; identical to SEQ ID NO: 73104
  misc_feature 1..96: note = chr11:63609980-63610076
  misc_feature 1..96: note = Hypo
  source 1..96: mol_type = genomic DNA

SEQ ID NO: 106413 - DNA, 18 bp, Homo sapiens
  misc_feature 1..18: note = chr11:63641124-63641142
  misc_feature 1..18: note = Hypo
  source 1..18: mol_type = genomic DNA
tatttttttctgagacgg

SEQ ID NO: 106414 - DNA, 56 bp, Homo sapiens; identical to SEQ ID NO: 73106
  misc_feature 1..56: note = chr11:63652242-63652298
  misc_feature 1..56: note = Hypo
  source 1..56: mol_type = genomic DNA

SEQ ID NO: 106415 - DNA, 30 bp, Homo sapiens; identical to SEQ ID NO: 73110
  misc_feature 1..30: note = chr11:63735580-63735610
  misc_feature 1..30: note = Hypo
  source 1..30: mol_type = genomic DNA

SEQ ID NO: 106416 - DNA, 30 bp, Homo sapiens; identical to SEQ ID NO: 73111
  misc_feature 1..30: note = chr11:63743650-63743680
  misc_feature 1..30: note = Hypo
  source 1..30: mol_type = genomic DNA

SEQ ID NO: 106417 - DNA, 767 bp, Homo sapiens
  misc_feature 1..767: note = chr11:63767704-63768471
  misc_feature 1..767: note = Hyper
  source 1..767: mol_type = genomic DNA
ccgggagccgatagccgccggtgatcttggccttgccagtcttacagctctgcagggtccggcactcgtcggtaagcagggggccggcggcccgatgaatgcagccgtccactgcgggaagggcgggcgcgactgagctggcctggcaaggctgcggccccggggtgagcaccctcagtcccgagaagcccctcggcgatgcgaggacccatgcggagccgcgccccaaccccgtggcctccggccgcggccgctgcccccacccccgcccggaatgtttcacatctggggaaaccgaggcgcagagcgggacggccctgggcctggcgggaagtcgcgcaaggaggccggcagggggcgcacccggcccaccctgtcccttccaggccgcgccgccagggcccaggcagggcggctccgggaggcgggggccgccgggacaggaaccgccgcccgagccggggtgacggggaagcttcctccccgacgcccctccctagccctgtcccgggcgcgctgcagggcccgcgaccagtcgctgcctccgcccgggcctcagcgtcggtgcgatcccaaggcccacctccccaggcggcgccccatcacggggcggcggcaaaccctaggacccattttgcggatgaggaaaccgaggccaccttgttacagggtgatcagatctgtagctggagtctgggtcttccagccgcgcggggaggtgagcccgacgcccgggcccgagtctcctggcgcgcaaaccccagctg

SEQ ID NO: 106418 - DNA, 145 bp, Homo sapiens; identical to SEQ ID NO: 73114
  misc_feature 1..145: note = chr11:63779111-63779256
  misc_feature 1..145: note = Hypo
  source 1..145: mol_type = genomic DNA

SEQ ID NO: 106419 - DNA, 30 bp, Homo sapiens; identical to SEQ ID NO: 43111
  misc_feature 1..30: note = chr11:63780950-63780980
  misc_feature 1..30: note = Hypo
  source 1..30: mol_type = genomic DNA

SEQ ID NO: 106420 - DNA, 32 bp, Homo sapiens; identical to SEQ ID NO: 73116
  misc_feature 1..32: note = chr11:63783251-63783283
  misc_feature 1..32: note = Hypo
  source 1..32: mol_type = genomic DNA

SEQ ID NO: 106421 - DNA, 82 bp, Homo sapiens; identical to SEQ ID NO: 43112
  misc_feature 1..82: note = chr11:63783734-63783816
  misc_feature 1..82: note = Hypo
  source 1..82: mol_type = genomic DNA

SEQ ID NO: 106422 - DNA, 30 bp, Homo sapiens; identical to SEQ ID NO: 73118
  misc_feature 1..30: note = chr11:63785738-63785768
  misc_feature 1..30: note = Hypo
  source 1..30: mol_type = genomic DNA

SEQ ID NO: 106423 - DNA, 295 bp, Homo sapiens; identical to SEQ ID NO: 73119
  misc_feature 1..295: note = chr11:63803412-63803707
  misc_feature 1..295: note = Hyper
  source 1..295: mol_type = genomic DNA

SEQ ID NO: 106424 - DNA, 30 bp, Homo sapiens; identical to SEQ ID NO: 73120
  misc_feature 1..30: note = chr11:63804018-63804048
  misc_feature 1..30: note = Hyper
  source 1..30: mol_type = genomic DNA

SEQ ID NO: 106425 - DNA, 94 bp, Homo sapiens; identical to SEQ ID NO: 73121
  misc_feature 1..94: note = chr11:63804348-63804442
  misc_feature 1..94: note = Hyper
  source 1..94: mol_type = genomic DNA

SEQ ID NO: 106426 - DNA, 254 bp, Homo sapiens; identical to SEQ ID NO: 73122
  misc_feature 1..254: note = chr11:63849380-63849634
  misc_feature 1..254: note = Hypo
  source 1..254: mol_type = genomic DNA

SEQ ID NO: 106427 - DNA, 30 bp, Homo sapiens; identical to SEQ ID NO: 73123
  misc_feature 1..30: note = chr11:63906088-63906118
  misc_feature 1..30: note = Hypo
  source 1..30: mol_type = genomic DNA

SEQ ID NO: 106428 - DNA, 59 bp, Homo sapiens; identical to SEQ ID NO: 73124
  misc_feature 1..59: note = chr11:63916700-63916759
  misc_feature 1..59: note = Hypo
  source 1..59: mol_type = genomic DNA

SEQ ID NO: 106429 - DNA, 30 bp, Homo sapiens; identical to SEQ ID NO: 73125
  misc_feature 1..30: note = chr11:63920212-63920242
  misc_feature 1..30: note = Hypo
  source 1..30: mol_type = genomic DNA

SEQ ID NO: 106430 - DNA, 20 bp, Homo sapiens
  misc_feature 1..20: note = chr11:63934599-63934619
  misc_feature 1..20: note = Hypo
  source 1..20: mol_type = genomic DNA
aaacacgaggatggattttt

SEQ ID NO: 106431 - DNA, 30 bp, Homo sapiens; identical to SEQ ID NO: 73127
  misc_feature 1..30: note = chr11:63938071-63938101
  misc_feature 1..30: note = Hypo
  source 1..30: mol_type = genomic DNA

SEQ ID NO: 106432 - DNA, 37 bp, Homo sapiens; identical to SEQ ID NO: 73128
  misc_feature 1..37: note = chr11:63955145-63955182
  misc_feature 1..37: note = Hypo
  source 1..37: mol_type = genomic DNA

SEQ ID NO: 106433 - DNA, 129 bp, Homo sapiens; identical to SEQ ID NO: 73129
  misc_feature 1..129: note = chr11:63978732-63978861
  misc_feature 1..129: note = Hypo
  source 1..129: mol_type = genomic DNA

SEQ ID NO: 106434 - DNA, 40 bp, Homo sapiens; identical to SEQ ID NO: 73130
  misc_feature 1..40: note = chr11:64010257-64010297
  misc_feature 1..40: note = Hypo
  source 1..40: mol_type = genomic DNA

SEQ ID NO: 106435 - DNA, 80 bp, Homo sapiens; identical to SEQ ID NO: 73131
  misc_feature 1..80: note = chr11:64039207-64039287
  misc_feature 1..80: note = Hyper
  source 1..80: mol_type = genomic DNA

SEQ ID NO: 106436 - DNA, 67 bp, Homo sapiens; identical to SEQ ID NO: 73132
  misc_feature 1..67: note = chr11:64042943-64043010
  misc_feature 1..67: note = Hypo
  source 1..67: mol_type = genomic DNA

SEQ ID NO: 106437 - DNA, 99 bp, Homo sapiens; identical to SEQ ID NO: 73133
  misc_feature 1..99: note = chr11:64054286-64054385
  misc_feature 1..99: note = Hypo
  source 1..99: mol_type = genomic DNA

SEQ ID NO: 106438 - DNA, 1379 bp, Homo sapiens
  misc_feature 1..1379: note = chr11:64058814-64060193
  misc_feature 1..1379: note = Hyper
  source 1..1379: mol_type = genomic DNA
gttgcggacccttcccgatccggtaatgggcctgggagatgccagattagcgtggtgcctgtccggagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcaggtaaacggcttggggcggcgccggcggcgagggcgctgcacggagggaagcgcggcgccggaggggttaaccgcgggaggaggggggcttctgccggcgggaggggggtcccagccccggcggccgcccgctccgcccctgccgcctccgcggcccagtcggcaccggcgaggccgtgctggaacccgggcctcagccgcagccgcagcggggccgacagtaagtgcggtgcgggctccggtgcgcgggcaggactcaggggcagggacgccccaggggcgactggccgggcggggtgcccacctctcgcgcgtgggcgcctccgggagtggtgtggccgccggtcccgccgcccgccacgctccgaggcgtcgctgtgcggacgcgggggaggcggtgggagcgagctgcgggcgctgcgcggtggccctgctgtctggcgtgtgcacgctagtgtccacacacgtgtgcgtgggctctgggtgccctggcgcggccggcacgcccatgggggccggggatgccggggcgtctgcggagagtgcaggtggggtgcgtgcgtgcagcggggcggcgcggcgctgcagcctcgggatggagcgtgggcgcgcgggtctttgtgcccgcgcttggcggcgcgtgccggggcgtgtgtgcgcgtgggcgccgccgcccgctgtctcggactgacagctgtctcgggggctgtcgccccggtgtggcctttgcggacccccgccccgctttttccgggaactgggcgtccccagcacccctcctcgcctgggtgcggcggccgggacccgcccctgggttcctcgaaagcccggcggggcgcgggggcaccctggagggccagccaggaagcagggcgaggcgagaggggacggagaagccgcggagatgctgtcacagccgcagcgggcgagcagggacccaccattcccctgtccccgccttgcgctgtccggcctctcctccgggtttcccttcggacgcctccgagccccctcagcctcctcctcgagggccagctccccgcacccccaccaagctccacacatttcctcgctcgccccgcttccccctaggcaggcttaggctctctttcggcctcccactcgccttcctttcccttctcggtgccctcctctc

SEQ ID NO: 106439 - DNA, 420 bp, Homo sapiens; identical to SEQ ID NO: 73136
  misc_feature 1..420: note = chr11:64066842-64067262
  misc_feature 1..420: note = Hyper
  source 1..420: mol_type = genomic DNA

SEQ ID NO: 106440 - DNA, 215 bp, Homo sapiens; identical to SEQ ID NO: 73137
  misc_feature 1..215: note = chr11:64105859-64106074
  misc_feature 1..215: note = Hypo
  source 1..215: mol_type = genomic DNA

SEQ ID NO: 106441 - DNA, 108 bp, Homo sapiens
  misc_feature 1..108: note = chr11:64108263-64108371
  misc_feature 1..108: note = Hyper
  source 1..108: mol_type = genomic DNA
tgagaggaggggaagcgggtgggcggagcctgatgctcagtgggcggggcctgagggacggtgggcgaggcctgttgacgggaggcgggtcctcgagcccacctccgg

SEQ ID NO: 106442 - DNA, 95 bp, Homo sapiens; identical to SEQ ID NO: 73139
  misc_feature 1..95: note = chr11:64117072-64117167
  misc_feature 1..95: note = Hypo
  source 1..95: mol_type = genomic DNA

SEQ ID NO: 106443 - DNA, 105 bp, Homo sapiens; identical to SEQ ID NO: 73140
  misc_feature 1..105: note = chr11:64120222-64120327
  misc_feature 1..105: note = Hypo
  source 1..105: mol_type = genomic DNA

SEQ ID NO: 106444 - DNA, 126 bp, Homo sapiens; identical to SEQ ID NO: 73141
  misc_feature 1..126: note = chr11:64120822-64120948
  misc_feature 1..126: note = Hypo
  source 1..126: mol_type = genomic DNA

SEQ ID NO: 106445 - DNA, 30 bp, Homo sapiens; identical to SEQ ID NO: 73142
  misc_feature 1..30: note = chr11:64124074-64124104
  misc_feature 1..30: note = Hypo
  source 1..30: mol_type = genomic DNA

SEQ ID NO: 106446 - DNA, 88 bp, Homo sapiens; identical to SEQ ID NO: 73143
  misc_feature 1..88: note = chr11:64124704-64124792
  misc_feature 1..88: note = Hypo
  source 1..88: mol_type = genomic DNA

SEQ ID NO: 106447 - DNA, 66 bp, Homo sapiens; identical to SEQ ID NO: 73144
  misc_feature 1..66: note = chr11:64129402-64129468
  misc_feature 1..66: note = Hypo
  source 1..66: mol_type = genomic DNA

SEQ ID NO: 106448 - DNA, 41 bp, Homo sapiens; identical to SEQ ID NO: 73145
  misc_feature 1..41: note = chr11:64140397-64140438
  misc_feature 1..41: note = Hypo
  source 1..41: mol_type = genomic DNA

SEQ ID NO: 106449 - DNA, 30 bp, Homo sapiens; identical to SEQ ID NO: 73146
  misc_feature 1..30: note = chr11:64147610-64147640
  misc_feature 1..30: note = Hypo
  source 1..30: mol_type = genomic DNA

SEQ ID NO: 106450 - DNA, 104 bp, Homo sapiens; identical to SEQ ID NO: 73147
  misc_feature 1..104: note = chr11:64168551-64168655
  misc_feature 1..104: note = Hypo
  source 1..104: mol_type = genomic DNA

SEQ ID NO: 106451 - DNA, 21 bp, Homo sapiens
  misc_feature 1..21: note = chr11:64184141-64184162
  misc_feature 1..21: note = Hypo
  source 1..21: mol_type = genomic DNA
aagaatgaggctgggcgcggt

SEQ ID NO: 106452 - DNA, 76 bp, Homo sapiens; identical to SEQ ID NO: 73149
  misc_feature 1..76: note = chr11:64187500-64187576
  misc_feature 1..76: note = Hypo
  source 1..76: mol_type = genomic DNA

SEQ ID NO: 106453 - DNA, 209 bp, Homo sapiens; identical to SEQ ID NO: 73150
  misc_feature 1..209: note = chr11:64292291-64292500
  misc_feature 1..209: note = Hypo
  source 1..209: mol_type = genomic DNA

SEQ ID NO: 106454 - DNA, 44 bp, Homo sapiens; identical to SEQ ID NO: 73151
  misc_feature 1..44: note = chr11:64313087-64313131
  misc_feature 1..44: note = Hypo
  source 1..44: mol_type = genomic DNA

SEQ ID NO: 106455 - DNA, 62 bp, Homo sapiens; identical to SEQ ID NO: 73152
  misc_feature 1..62: note = chr11:64323679-64323741
  misc_feature 1..62: note = Hypo
  source 1..62: mol_type = genomic DNA

SEQ ID NO: 106456 - DNA, 126 bp, Homo sapiens; identical to SEQ ID NO: 73153
  misc_feature 1..126: note = chr11:64361015-64361141
  misc_feature 1..126: note = Hypo
  source 1..126: mol_type = genomic DNA

SEQ ID NO: 106457 - DNA, 522 bp, Homo sapiens
  misc_feature 1..522: note = chr11:64409914-64410436
  misc_feature 1..522: note = Hyper
  source 1..522: mol_type = genomic DNA
agctggggtggggcccgcgggggcccagctgcgcacacgggaagcgccccccgcccccgggccaaccgggtggccggcatctacagtgccacttaccgtggccgccgcgggtgaggaagggcatgcggttgatggcgatgggcacggtgccgtgcttgctgtggaagtggtggacgtggtgggtggtgctgaggctggaggagacccgggccccctcggccgcccccagcagcaacagcagcaacagcggcaacagcggcagcagaggtggcggcggcggcggtggaggcggcggcaggggcccagccagggccggggggcggcgcgggcacccccccggcccgctccccccggggggcatttcggcccgggggcgaccgcctcacagccccatggccgggggcggggacgcggggctgcgcagccccgcgaagcccccctccggctccgagctccgggagcggggtagggatgaagcggaggtaaaccagggcccaagcctcggtccggagccaacaaaat

SEQ ID NO: 106458 - DNA, 359 bp, Homo sapiens; identical to SEQ ID NO: 73156
  misc_feature 1..359: note = chr11:64410638-64410997
  misc_feature 1..359: note = Hyper
  source 1..359: mol_type = genomic DNA

SEQ ID NO: 106459 - DNA, 30 bp, Homo sapiens; identical to SEQ ID NO: 73157
  misc_feature 1..30: note = chr11:64411442-64411472
  misc_feature 1..30: note = Hyper
  source 1..30: mol_type = genomic DNA

SEQ ID NO: 106460 - DNA, 257 bp, Homo sapiens; identical to SEQ ID NO: 73158
  misc_feature 1..257: note = chr11:64478747-64479004
  misc_feature 1..257: note = Hyper
  source 1..257: mol_type = genomic DNA

SEQ ID NO: 106461 - DNA, 1003 bp, Homo sapiens
  misc_feature 1..1003: note = chr11:64480253-64481256
  misc_feature 1..1003: note = Hyper
  source 1..1003: mol_type = genomic DNA
ccaccgccaaccccacgcgccctcgcccggacacgcgtccccgcagccctggagcgctcgcacccactcacaagccctcgtgcccagcccccgtgcctcaggagcccacacacactccgacccccacgaagcgccccaggccctcacccccgcgcccaggcaccgggcggccgctccccggggctcaccttcgctgcagaacttgccgccgaagcccgtgtggctgcagtcgcagcccacctcgccgggggccagcacggtgcagaggccgccgttggcgcaggggttgcgcgcgggcgcgcacagcgggtcggcggtggcgccgcgcaggccctggctgcccagcagcgcggggggccgctcgcccagcttcaggttggccaagaggccgcggaagggcggctcgtacttgacggtgctcagcgtaagcgccgagaggcgcacgtcgggcgggatgccgcccacgaacaggtcgctggccacctgcatctcgcgccgcttggagcgcacctcggcggcgcgggcctcgccgtccaccgccagcgccgtgcggcgcgcgtcgcgggtcagcagcaccatgtgccagcggtcgtcggccaccggcgtgtccagctgcagcgtggccggctcggcgcacgaaagcgtgaagcgcagccgcaggcggccgtccaccagcagcagctccaggaagtcgcagtcgccgccgtcgtccaggtagagcagcagcgcgcgcgtggcgttggtgcgcaggctgaagctgagctcgccgctgctcgccgcgcccgcccagcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcagagccgcgggcgcatggggcgggagggggccggg

SEQ ID NO: 106462 - DNA, 214 bp, Homo sapiens; identical to SEQ ID NO: 73161
  misc_feature 1..214: note = chr11:64488458-64488672
  misc_feature 1..214: note = Hypo
  source 1..214: mol_type = genomic DNA

SEQ ID NO: 106463 - DNA, 33 bp, Homo sapiens; identical to SEQ ID NO: 73162
  misc_feature 1..33: note = chr11:64496441-64496474
  misc_feature 1..33: note = Hypo
  source 1..33: mol_type = genomic DNA

SEQ ID NO: 106464 - DNA, 30 bp, Homo sapiens; identical to SEQ ID NO: 43124
  misc_feature 1..30: note = chr11:64507459-64507489
  misc_feature 1..30: note = Hypo
  source 1..30: mol_type = genomic DNA

SEQ ID NO: 106465 - DNA, 30 bp, Homo sapiens; identical to SEQ ID NO: 73164
  misc_feature 1..30: note = chr11:64508029-64508059
  misc_feature 1..30: note = Hypo
  source 1..30: mol_type = genomic DNA

SEQ ID NO: 106466 - DNA, 202 bp, Homo sapiens; identical to SEQ ID NO: 73165
  misc_feature 1..202: note = chr11:64511882-64512084
  misc_feature 1..202: note = Hyper
  source 1..202: mol_type = genomic DNA

SEQ ID NO: 106467 - DNA, 850 bp, Homo sapiens; identical to SEQ ID NO: 73166
  misc_feature 1..850: note = chr11:64512898-64513748
  misc_feature 1..850: note = Hyper
  source 1..850: mol_type = genomic DNA

SEQ ID NO: 106468 - DNA, 43 bp, Homo sapiens; identical to SEQ ID NO: 73167
  misc_feature 1..43: note = chr11:64572043-64572086
  misc_feature 1..43: note = Hypo
  source 1..43: mol_type = genomic DNA

SEQ ID NO: 106469 - DNA, 80 bp, Homo sapiens; identical to SEQ ID NO: 73168
  misc_feature 1..80: note = chr11:64578524-64578604
  misc_feature 1..80: note = Hypo
  source 1..80: mol_type = genomic DNA

SEQ ID NO: 106470 - DNA, 58 bp, Homo sapiens; identical to SEQ ID NO: 73169
  misc_feature 1..58: note = chr11:64609349-64609407
  misc_feature 1..58: note = Hypo
  source 1..58: mol_type = genomic DNA

SEQ ID NO: 106471 - DNA, 53 bp, Homo sapiens; identical to SEQ ID NO: 73170
  misc_feature 1..53: note = chr11:64610107-64610160
  misc_feature 1..53: note = Hypo
  source 1..53: mol_type = genomic DNA

SEQ ID NO: 106472 - DNA, 87 bp, Homo sapiens; identical to SEQ ID NO: 43128
  misc_feature 1..87: note = chr11:64667987-64668074
  misc_feature 1..87: note = Hypo
  source 1..87: mol_type = genomic DNA

SEQ ID NO: 106473 - DNA, 96 bp, Homo sapiens; identical to SEQ ID NO: 43129
  misc_feature 1..96: note = chr11:64669480-64669576
  misc_feature 1..96: note = Hypo
  source 1..96: mol_type = genomic DNA

SEQ ID NO: 106474 - DNA, 30 bp, Homo sapiens; identical to SEQ ID NO: 73173
  misc_feature 1..30: note = chr11:64733479-64733509
  misc_feature 1..30: note = Hypo
  source 1..30: mol_type = genomic DNA

SEQ ID NO: 106475 - DNA, 602 bp, Homo sapiens; identical to SEQ ID NO: 73174
  misc_feature 1..602: note = chr11:64739234-64739836
  misc_feature 1..602: note = Hyper
  source 1..602: mol_type = genomic DNA

SEQ ID NO: 106476 - DNA, 30 bp, Homo sapiens; identical to SEQ ID NO: 73175
  misc_feature 1..30: note = chr11:64766930-64766960
  misc_feature 1..30: note = Hypo
  source 1..30: mol_type = genomic DNA

SEQ ID NO: 106477 - DNA, 19 bp, Homo sapiens
  misc_feature 1..19: note = chr11:64774608-64774627
  misc_feature 1..19: note = Hypo
  source 1..19: mol_type = genomic DNA
gagcacagcagctcacgcc

SEQ ID NO: 106478 - DNA, 30 bp, Homo sapiens; identical to SEQ ID NO: 73177
  misc_feature 1..30: note = chr11:64794372-64794402
  misc_feature 1..30: note = Hypo
  source 1..30: mol_type = genomic DNA

SEQ ID NO: 106479 - DNA, 152 bp, Homo sapiens; identical to SEQ ID NO: 73178
  misc_feature 1..152: note = chr11:64809453-64809605
  misc_feature 1..152: note = Hypo
  source 1..152: mol_type = genomic DNA

SEQ ID NO: 106480 - DNA, 31 bp, Homo sapiens; identical to SEQ ID NO: 73179
  misc_feature 1..31: note = chr11:64809845-64809876
  misc_feature 1..31: note = Hypo
  source 1..31: mol_type = genomic DNA

SEQ ID NO: 106481 - DNA, 30 bp, Homo sapiens; identical to SEQ ID NO: 73180
  misc_feature 1..30: note = chr11:64825805-64825835
  misc_feature 1..30: note = Hypo
  source 1..30: mol_type = genomic DNA

SEQ ID NO: 106482 - DNA, 337 bp, Homo sapiens; identical to SEQ ID NO: 73181
  misc_feature 1..337: note = chr11:64875821-64876158
  misc_feature 1..337: note = Hypo
  source 1..337: mol_type = genomic DNA

SEQ ID NO: 106483 - DNA, 96 bp, Homo sapiens; identical to SEQ ID NO: 73182
  misc_feature 1..96: note = chr11:64878797-64878893
  misc_feature 1..96: note = Hypo
  source 1..96: mol_type = genomic DNA

SEQ ID NO: 106484 - DNA, 30 bp, Homo sapiens; identical to SEQ ID NO: 73183
  misc_feature 1..30: note = chr11:64879104-64879134
  misc_feature 1..30: note = Hyper
  source 1..30: mol_type = genomic DNA

SEQ ID NO: 106485 - DNA, 200 bp, Homo sapiens; identical to SEQ ID NO: 73184
  misc_feature 1..200: note = chr11:64883895-64884095
  misc_feature 1..200: note = Hypo
  source 1..200: mol_type = genomic DNA

SEQ ID NO: 106486 - DNA, 29 bp, Homo sapiens
  misc_feature 1..29: note = chr11:64888917-64888946
  misc_feature 1..29: note = Hyper
  source 1..29: mol_type = genomic DNA
ccacactcactagacgcttaccggtactt

SEQ ID NO: 106487 - DNA, 79 bp, Homo sapiens; identical to SEQ ID NO: 73185
  misc_feature 1..79: note = chr11:64903249-64903328
  misc_feature 1..79: note = Hypo
  source 1..79: mol_type = genomic DNA

SEQ ID NO: 106488 - DNA, 19 bp, Homo sapiens
  misc_feature 1..19: note = chr11:64903448-64903467
  misc_feature 1..19: note = Hypo
  source 1..19: mol_type = genomic DNA
caggcgtgagccacaacac

SEQ ID NO: 106489 - DNA, 30 bp, Homo sapiens; identical to SEQ ID NO: 73187
  misc_feature 1..30: note = chr11:64937648-64937678
  misc_feature 1..30: note = Hypo
  source 1..30: mol_type = genomic DNA

SEQ ID NO: 106490 - DNA, 135 bp, Homo sapiens; identical to SEQ ID NO: 73188
  misc_feature 1..135: note = chr11:64950220-64950355
  misc_feature 1..135: note = Hypo
  source 1..135: mol_type = genomic DNA

SEQ ID NO: 106491 - DNA, 159 bp, Homo sapiens; identical to SEQ ID NO: 73189
  misc_feature 1..159: note = chr11:64951735-64951894
  misc_feature 1..159: note = Hypo
  source 1..159: mol_type = genomic DNA

SEQ ID NO: 106492 - DNA, 72 bp, Homo sapiens; identical to SEQ ID NO: 73191
  misc_feature 1..72: note = chr11:64975460-64975532
  misc_feature 1..72: note = Hypo
  source 1..72: mol_type = genomic DNA

SEQ ID NO: 106493 - DNA, 72 bp, Homo sapiens; identical to SEQ ID NO: 73192
  misc_feature 1..72: note = chr11:64977462-64977534
  misc_feature 1..72: note = Hypo
  source 1..72: mol_type = genomic DNA

SEQ ID NO: 106494 - DNA, 144 bp, Homo sapiens; identical to SEQ ID NO: 73193
  misc_feature 1..144: note = chr11:65028520-65028664
  misc_feature 1..144: note = Hypo
  source 1..144: mol_type = genomic DNA

SEQ ID NO: 106495 - DNA, 151 bp, Homo sapiens; identical to SEQ ID NO: 73194
  misc_feature 1..151: note = chr11:65091310-65091461
  misc_feature 1..151: note = Hypo
  source 1..151: mol_type = genomic DNA

SEQ ID NO: 106496 - DNA, 205 bp, Homo sapiens; identical to SEQ ID NO: 73195
  misc_feature 1..205: note = chr11:65127486-65127691
  misc_feature 1..205: note = Hypo
  source 1..205: mol_type = genomic DNA

SEQ ID NO: 106497 - DNA, 30 bp, Homo sapiens; identical to SEQ ID NO: 73196
  misc_feature 1..30: note = chr11:65168665-65168695
  misc_feature 1..30: note = Hypo
  source 1..30: mol_type = genomic DNA

SEQ ID NO: 106498 - DNA, 30 bp, Homo sapiens; identical to SEQ ID NO: 73197
  misc_feature 1..30: note = chr11:65182751-65182781
  misc_feature 1..30: note = Hypo
  source 1..30: mol_type = genomic DNA

SEQ ID NO: 106499 - DNA, 585 bp, Homo sapiens; identical to SEQ ID NO: 73198
  misc_feature 1..585: note = chr11:65185143-65185728
  misc_feature 1..585: note = Hyper
  source 1..585: mol_type = genomic DNA

SEQ ID NO: 106500 - DNA, 30 bp, Homo sapiens; identical to SEQ ID NO: 73199
  misc_feature 1..30: note = chr11:65192943-65192973
  misc_feature 1..30: note = Hyper
  source 1..30: mol_type = genomic DNA

SEQ ID NO: 106501 - DNA, 209 bp, Homo sapiens; identical to SEQ ID NO: 73200
  misc_feature 1..209: note = chr11:65197681-65197890
  misc_feature 1..209: note = Hyper
  source 1..209: mol_type = genomic DNA

SEQ ID NO: 106502 - DNA, 30 bp, Homo sapiens; identical to SEQ ID NO: 73201
  misc_feature 1..30: note = chr11:65259108-65259138
  misc_feature 1..30: note = Hypo
  source 1..30: mol_type = genomic DNA

SEQ ID NO: 106503 - DNA, 28 bp, Homo sapiens
  misc_feature 1..28: note = chr11:65276916-65276944
  misc_feature 1..28: note = Hypo
  source 1..28: mol_type = genomic DNA
gagccaccgatcccggcccacagttttg

SEQ ID NO: 106504 - DNA, 44 bp, Homo sapiens; identical to SEQ ID NO: 73203
  misc_feature 1..44: note = chr11:65306381-65306425
  misc_feature 1..44: note = Hypo
  source 1..44: mol_type = genomic DNA

SEQ ID NO: 106505 - DNA, 30 bp, Homo sapiens; identical to SEQ ID NO: 73204
  misc_feature 1..30: note = chr11:65306775-65306805
  misc_feature 1..30: note = Hypo
  source 1..30: mol_type = genomic DNA

SEQ ID NO: 106506 - DNA, 203 bp, Homo sapiens; identical to SEQ ID NO: 73205
  misc_feature 1..203: note = chr11:65309028-65309231
  misc_feature 1..203: note = Hypo
  source 1..203: mol_type = genomic DNA

SEQ ID NO: 106507 - DNA, 30 bp, Homo sapiens; identical to SEQ ID NO: 73206
  misc_feature 1..30: note = chr11:65360776-65360806
  misc_feature 1..30: note = Hypo
  source 1..30: mol_type = genomic DNA

SEQ ID NO: 106508 - DNA, 79 bp, Homo sapiens; identical to SEQ ID NO: 73207
  misc_feature 1..79: note = chr11:65405437-65405516
  misc_feature 1..79: note = Hyper
  source 1..79: mol_type = genomic DNA

SEQ ID NO: 106509 - DNA, 251 bp, Homo sapiens; identical to SEQ ID NO: 73208
  misc_feature 1..251: note = chr11:65413862-65414113
  misc_feature 1..251: note = Hypo
  source 1..251: mol_type = genomic DNA

SEQ ID NO: 106510 - DNA, 30 bp, Homo sapiens; identical to SEQ ID NO: 43146
  misc_feature 1..30: note = chr11:65463016-65463046
  misc_feature 1..30: note = Hypo
  source 1..30: mol_type = genomic DNA

SEQ ID NO: 106511 - DNA, 83 bp, Homo sapiens; identical to SEQ ID NO: 43147
  misc_feature 1..83: note = chr11:65478528-65478611
  misc_feature 1..83: note = Hypo
  source 1..83: mol_type = genomic DNA

SEQ ID NO: 106512 - DNA, 104 bp, Homo sapiens; identical to SEQ ID NO: 73211
  misc_feature 1..104: note = chr11:65511076-65511180
  misc_feature 1..104: note = Hypo
  source 1..104: mol_type = genomic DNA

SEQ ID NO: 106513 - DNA, 66 bp, Homo sapiens; identical to SEQ ID NO: 73212
  misc_feature 1..66: note = chr11:65511418-65511484
  misc_feature 1..66: note = Hypo
  source 1..66: mol_type = genomic DNA

SEQ ID NO: 106514 - DNA, 154 bp, Homo sapiens; identical to SEQ ID NO: 43150
  misc_feature 1..154: note = chr11:65551581-65551735
  misc_feature 1..154: note = Hypo
  source 1..154: mol_type = genomic DNA

SEQ ID NO: 106515 - DNA, 145 bp, Homo sapiens
  misc_feature 1..145: note = chr11:65553972-65554117
  misc_feature 1..145: note = Hyper
  source 1..145: mol_type = genomic DNA
tttgggatcccgcgccgcctgggcccaggcccggttcaacaagtgcggaccgggccgcccgttcccgcccggcggcttcgcgcctccccaggagcctcgggcgcgccgggttgggccggccccagtggggcgagtttcgtgtcat

SEQ ID NO: 106516 - DNA, 86 bp, Homo sapiens; identical to SEQ ID NO: 73215
  misc_feature 1..86: note = chr11:65554637-65554723
  misc_feature 1..86: note = Hyper
  source 1..86: mol_type = genomic DNA

SEQ ID NO: 106517 - DNA, 170 bp, Homo sapiens; identical to SEQ ID NO: 73216
  misc_feature 1..170: note = chr11:65577359-65577529
  misc_feature 1..170: note = Hypo
  source 1..170: mol_type = genomic DNA

SEQ ID NO: 106518 - DNA, 908 bp, Homo sapiens
  misc_feature 1..908: note = chr11:65600749-65601657
  misc_feature 1..908: note = Hyper
  source 1..908: mol_type = genomic DNA
ccccaggttttctctcgcagcatcggcacccccttgcagccccgctccagtggcgaccgttcgcggaccccggcctcgcttggggcgccctggccgcgggacttgtggagctccctagtcctcctaggctgcttaccccgccgctccctcccgtccaagagcggaaacctaaacagaccccccttctccacagacattgtcccctgccctcgcccctggtccaccacccacatccccaccactgcttcccattccctgtccccaccctgccaccctcaccctcttccccttccccttccccttccccactgcctggtgggcgccaaactgggcgagtgcgcacgcgcaggccgcacgtggccgttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtgtgtgtgt

SEQ ID NO: 106519 - DNA, 137 bp, Homo sapiens; identical to SEQ ID NO: 73219
  misc_feature 1..137: note = chr11:65629450-65629587
  misc_feature 1..137: note = Hypo
  source 1..137: mol_type = genomic DNA

SEQ ID NO: 106520 - DNA, 99 bp, Homo sapiens; identical to SEQ ID NO: 73220
  misc_feature 1..99: note = chr11:65640238-65640337
  misc_feature 1..99: note = Hyper
  source 1..99: mol_type = genomic DNA

SEQ ID NO: 106521 - DNA, 21 bp, Homo sapiens
  misc_feature 1..21: note = chr11:65665095-65665116
  misc_feature 1..21: note = Hypo
  source 1..21: mol_type = genomic DNA
ccacagcgcccagcctagtat

SEQ ID NO: 106522 - DNA, 68 bp, Homo sapiens; identical to SEQ ID NO: 73222
  misc_feature 1..68: note = chr11:65666703-65666771
  misc_feature 1..68: note = Hyper
  source 1..68: mol_type = genomic DNA

SEQ ID NO: 106523 - DNA, 243 bp, Homo sapiens; identical to SEQ ID NO: 73223
  misc_feature 1..243: note = chr11:65667149-65667392
  misc_feature 1..243: note = Hyper
  source 1..243: mol_type = genomic DNA

SEQ ID NO: 106524 - DNA, 30 bp, Homo sapiens; identical to SEQ ID NO: 73224
  misc_feature 1..30: note = chr11:65677170-65677200
  misc_feature 1..30: note = Hypo
  source 1..30: mol_type = genomic DNA

SEQ ID NO: 106525 - DNA, 212 bp, Homo sapiens; identical to SEQ ID NO: 73225
  misc_feature 1..212: note = chr11:65684960-65685172
  misc_feature 1..212: note = Hypo
  source 1..212: mol_type = genomic DNA

SEQ ID NO: 106526 - DNA, 30 bp, Homo sapiens; identical to SEQ ID NO: 73226
  misc_feature 1..30: note = chr11:65721988-65722018
  misc_feature 1..30: note = Hypo
  source 1..30: mol_type = genomic DNA

SEQ ID NO: 106527 - DNA, 36 bp, Homo sapiens; identical to SEQ ID NO: 73227
  misc_feature 1..36: note = chr11:65722778-65722814
  misc_feature 1..36: note = Hypo
  source 1..36: mol_type = genomic DNA

SEQ ID NO: 106528 - DNA, 30 bp, Homo sapiens; identical to SEQ ID NO: 43154
  misc_feature 1..30: note = chr11:65741409-65741439
  misc_feature 1..30: note = Hypo
  source 1..30: mol_type = genomic DNA

SEQ ID NO: 106529 - DNA, 398 bp, Homo sapiens; identical to SEQ ID NO: 73229
  misc_feature 1..398: note = chr11:65779206-65779604
  misc_feature 1..398: note = Hyper
  source 1..398: mol_type = genomic DNA

SEQ ID NO: 106530 - DNA, 272 bp, Homo sapiens
  misc_feature 1..272: note = chr11:65816447-65816719
  misc_feature 1..272: note = Hyper
  source 1..272: mol_type = genomic DNA
cctccaaccccatgccggccactgcagtactcacaccgcacgcctgggctctgcctctggcccgggttgggggcggccgccgctatctctggacccttgtctcgaaatccgcacggggtccgagggtgcccggggccctgcgcgccgagtgccggtggcttgcctctcagcgcctggatgggatcaggtggcagcgtccgctaggctcgctcctcccggctctgcccgccccccgccccccgccccccatcgcacaccggaggaaggcgagg

SEQ ID NO: 106531 - DNA, 30 bp, Homo sapiens; identical to SEQ ID NO: 73232
  misc_feature 1..30: note = chr11:65901677-65901707
  misc_feature 1..30: note = Hypo
  source 1..30: mol_type = genomic DNA

SEQ ID NO: 106532 - DNA, 166 bp, Homo sapiens; identical to SEQ ID NO: 73233
  misc_feature 1..166: note = chr11:66048056-66048222
  misc_feature 1..166: note = Hypo
  source 1..166: mol_type = genomic DNA

SEQ ID NO: 106533 - DNA, 217 bp, Homo sapiens; identical to SEQ ID NO: 73234
  misc_feature 1..217: note = chr11:66059146-66059363
  misc_feature 1..217: note = Hyper
  source 1..217: mol_type = genomic DNA

SEQ ID NO: 106534 - DNA, 33 bp, Homo sapiens; identical to SEQ ID NO: 73235
  misc_feature 1..33: note = chr11:66059580-66059613
  misc_feature 1..33: note = Hyper
  source 1..33: mol_type = genomic DNA

SEQ ID NO: 106535 - DNA, 60 bp, Homo sapiens; identical to SEQ ID NO: 73236
  misc_feature 1..60: note = chr11:66101601-66101661
  misc_feature 1..60: note = Hypo
  source 1..60: mol_type = genomic DNA

SEQ ID NO: 106536 - DNA, 30 bp, Homo sapiens; identical to SEQ ID NO: 73237
  misc_feature 1..30: note = chr11:66114013-66114043
  misc_feature 1..30: note = Hypo
  source 1..30: mol_type = genomic DNA

SEQ ID NO: 106537 - DNA, 86 bp, Homo sapiens; identical to SEQ ID NO: 73238
  misc_feature 1..86: note = chr11:66147017-66147103
  misc_feature 1..86: note = Hypo
  source 1..86: mol_type = genomic DNA

SEQ ID NO: 106538 - DNA, 68 bp, Homo sapiens; identical to SEQ ID NO: 73239
  misc_feature 1..68: note = chr11:66186333-66186401
  misc_feature 1..68: note = Hyper
  source 1..68: mol_type = genomic DNA

SEQ ID NO: 106539 - DNA, 107 bp, Homo sapiens; identical to SEQ ID NO: 73240
  misc_feature 1..107: note = chr11:66187360-66187467
  misc_feature 1..107: note = Hyper
  source 1..107: mol_type = genomic DNA

SEQ ID NO: 106540 - DNA, 30 bp, Homo sapiens; identical to SEQ ID NO: 73241
  misc_feature 1..30: note = chr11:66187796-66187826
  misc_feature 1..30: note = Hyper
  source 1..30: mol_type = genomic DNA

SEQ ID NO: 106541 - DNA, 1054 bp, Homo sapiens
  misc_feature 1..1054: note = chr11:66188095-66189149
  misc_feature 1..1054: note = Hyper
  source 1..1054: mol_type = genomic DNA
aattagtgtcagtgccggcccctctctgccctctgcggactcctgccgcgggcttcaggccgccctaaacctggccctgtcgcttccctcaactgaacgcattcagacgccagggtccccacactccattcaagctttcctaacgcagcgccttcctctccgctcagctcccgccaggcttggccccctccgcagcctcctgctcccccctcgcccgcctccctccctctctcattctacgtcatgagatgacgtcggaagccgggcgggaggaggagcccccctccccagtcagcggctcccgctgcagcttgcttagcccagcctcccgctctcccgcccccccggctctaaaacgagccccccacgcctggcaggagctatataaggcggcgtgaggcaggcgaggggggcagcgcagccgagcggagcccaggagagcagagagcgagcctgagcgagagacggggaagcacggaggaggaagccgccggtgcgtcgggacgggagcgcaggtgctcgggcacccgagctggagctccgcagccgccggtcatgtaccgctccaccaagggcgcctccaaggcgcgccgggaccagatcaacgccgagatccggaacctcaaggagctgctgccgctggccgaagcggacaaggtccggctgtcctacctgcacatcatgagcctcgcctgcatctacactcgcaagggcgtcttcttcgctggtggtgagcatgctggggctaccgcagatccgagctgccaggcgccggagaccctggagctgagggaacccgctggggctgtcgcatgtctagggcagcgtgctggcgagctggggagattcgggactcgggagattcgggactttctacttttcctcctgagctccctccagacctcaccttagttctgaatgagagttagagagcctggacggtgtccctaacaccagattatgagaggataagagccaggacagagcggcctcggtgcccgccagtgcagaagcgctccgggagccggggagggaagcccgggaagttgcaggg

SEQ ID NO: 106542 - DNA, 33 bp, Homo sapiens; identical to SEQ ID NO: 43156
  misc_feature 1..33: note = chr11:66324511-66324544
  misc_feature 1..33: note = Hypo
  source 1..33: mol_type = genomic DNA

SEQ ID NO: 106543 - DNA, 167 bp, Homo sapiens; identical to SEQ ID NO: 73246
  misc_feature 1..167: note = chr11:66325229-66325396
  misc_feature 1..167: note = Hypo
  source 1..167: mol_type = genomic DNA

SEQ ID NO: 106544 - DNA, 39 bp, Homo sapiens; identical to SEQ ID NO: 73247
  misc_feature 1..39: note = chr11:66327260-66327299
  misc_feature 1..39: note = Hypo
  source 1..39: mol_type = genomic DNA

SEQ ID NO: 106545 - DNA, 35 bp, Homo sapiens; identical to SEQ ID NO: 73248
  misc_feature 1..35: note = chr11:66332091-66332126
  misc_feature 1..35: note = Hypo
  source 1..35: mol_type = genomic DNA

SEQ ID NO: 106546 - DNA, 30 bp, Homo sapiens; identical to SEQ ID NO: 73249
  misc_feature 1..30: note = chr11:66346865-66346895
  misc_feature 1..30: note = Hyper
  source 1..30: mol_type = genomic DNA

SEQ ID NO: 106547 - DNA, 33 bp, Homo sapiens; identical to SEQ ID NO: 73250
  misc_feature 1..33: note = chr11:66347133-66347166
  misc_feature 1..33: note = Hypo
  source 1..33: mol_type = genomic DNA

SEQ ID NO: 106548 - DNA, 30 bp, Homo sapiens; identical to SEQ ID NO: 73251
  misc_feature 1..30: note = chr11:66410982-66411012
  misc_feature 1..30: note = Hypo
  source 1..30: mol_type = genomic DNA

SEQ ID NO: 106549 - DNA, 189 bp, Homo sapiens; identical to SEQ ID NO: 43158
  misc_feature 1..189: note = chr11:66411368-66411557
  misc_feature 1..189: note = Hypo
  source 1..189: mol_type = genomic DNA

SEQ ID NO: 106550 - DNA, 30 bp, Homo sapiens; identical to SEQ ID NO: 73253
  misc_feature 1..30: note = chr11:66454424-66454454
  misc_feature 1..30: note = Hypo
  source 1..30: mol_type = genomic DNA

SEQ ID NO: 106551 - DNA, 51 bp, Homo sapiens; identical to SEQ ID NO: 73254
  misc_feature 1..51: note = chr11:66494819-66494870
  misc_feature 1..51: note = Hyper
  source 1..51: mol_type = genomic DNA

SEQ ID NO: 106552 - DNA, 156 bp, Homo sapiens; identical to SEQ ID NO: 43159
  misc_feature 1..156: note = chr11:66511194-66511350
  misc_feature 1..156: note = Hypo
  source 1..156: mol_type = genomic DNA

SEQ ID NO: 106553 - DNA, 94 bp, Homo sapiens; identical to SEQ ID NO: 43160
  misc_feature 1..94: note = chr11:66513159-66513253
  misc_feature 1..94: note = Hypo
  source 1..94: mol_type = genomic DNA

SEQ ID NO: 106554 - DNA, 93 bp, Homo sapiens; identical to SEQ ID NO: 43161
  misc_feature 1..93: note = chr11:66513553-66513646
  misc_feature 1..93: note = Hypo
  source 1..93: mol_type = genomic DNA

SEQ ID NO: 106555 - DNA, 16 bp, Homo sapiens
  misc_feature 1..16: note = chr11:66515380-66515396
  misc_feature 1..16: note = Hypo
  source 1..16: mol_type = genomic DNA
gcgcagggcagcatta

SEQ ID NO: 106556 - DNA, 82 bp, Homo sapiens; identical to SEQ ID NO: 43163
  misc_feature 1..82: note = chr11:66557367-66557449
  misc_feature 1..82: note = Hypo
  source 1..82: mol_type = genomic DNA

SEQ ID NO: 106557 - DNA, 1097 bp, Homo sapiens; identical to SEQ ID NO: 73260
  misc_feature 1..1097: note = chr11:66625090-66626187
  misc_feature 1..1097: note = Hypo
  source 1..1097: mol_type = genomic DNA

SEQ ID NO: 106558 - DNA, 410 bp, Homo sapiens; identical to SEQ ID NO: 73261
  misc_feature 1..410: note = chr11:66626525-66626935
  misc_feature 1..410: note = Hypo
  source 1..410: mol_type = genomic DNA

SEQ ID NO: 106559 - DNA, 79 bp, Homo sapiens; identical to SEQ ID NO: 73262
  misc_feature 1..79: note = chr11:66627238-66627317
  misc_feature 1..79: note = Hypo
  source 1..79: mol_type = genomic DNA

SEQ ID NO: 106560 - DNA, 573 bp, Homo sapiens; identical to SEQ ID NO: 73263
  misc_feature 1..573: note = chr11:66631279-66631852
  misc_feature 1..573: note = Hypo
  source 1..573: mol_type = genomic DNA

SEQ ID NO: 106561 - DNA, 94 bp, Homo sapiens; identical to SEQ ID NO: 73264
  misc_feature 1..94: note = chr11:66633739-66633833
  misc_feature 1..94: note = Hypo
  source 1..94: mol_type = genomic DNA

SEQ ID NO: 106562 - DNA, 143 bp, Homo sapiens; identical to SEQ ID NO: 73265
  misc_feature 1..143: note = chr11:66637063-66637206
  misc_feature 1..143: note = Hypo
  source 1..143: mol_type = genomic DNA

SEQ ID NO: 106563 - DNA, 144 bp, Homo sapiens; identical to SEQ ID NO: 73266
  misc_feature 1..144: note = chr11:66648961-66649105
  misc_feature 1..144: note = Hypo
  source 1..144: mol_type = genomic DNA

SEQ ID NO: 106564 - DNA, 30 bp, Homo sapiens; identical to SEQ ID NO: 73267
  misc_feature 1..30: note = chr11:66658260-66658290
  misc_feature 1..30: note = Hypo
  source 1..30: mol_type = genomic DNA

SEQ ID NO: 106565 - DNA, 78 bp, Homo sapiens; identical to SEQ ID NO: 73268
  misc_feature 1..78: note = chr11:66683635-66683713
  misc_feature 1..78: note = Hypo
  source 1..78: mol_type = genomic DNA

SEQ ID NO: 106566 - DNA, 17 bp, Homo sapiens
  misc_feature 1..17: note = chr11:66683833-66683850
  misc_feature 1..17: note = Hypo
  source 1..17: mol_type = genomic DNA
ggcgtgagccactgtga

SEQ ID NO: 106567 - DNA, 408 bp, Homo sapiens; identical to SEQ ID NO: 73270
  misc_feature 1..408: note = chr11:66725945-66726353
  misc_feature 1..408: note = Hyper
  source 1..408: mol_type = genomic DNA

SEQ ID NO: 106568 - DNA, 978 bp, Homo sapiens
  misc_feature 1..978: note = chr11:66790528-66791506
  misc_feature 1..978: note = Hyper
  source 1..978: mol_type = genomic DNA
acccctgtccccaggcgtgggagcgaggggttgggcttggcctcagggcgtccctggatcccggacgcgcttggggatctccggctcggaccccaggagcagagacagcgctcgagcttgtcactttaaattcaagagggagcgggcgggcaagcgggcgagcgcgagggagcgcgcggcgggctcctgggagcgtgcccggactgcggcgcagctccggtccgccgccccggcccggccgagcccccggcccgcgccgcgctcctcggaggcgggagcccggcgacactgcaggggtggcgttgccgccggcggccgggctaggcgcaggtgcgtgcgcgctgcgggaggcgggccggcagctggagcccagccggagcggcggcccctccgcggagcccgggtgagtacgcaccccgccgacccccgtgcgcggccgggatcgcaccctgatcgcggacgcacgcagccccctcctcgggccctgggcccgggaccccagagccccgcgcactccgcgctcctgcacctccgcgccgcgcttgcacacgaacgaatgccgggcaccgcgcacgctgggcgcccttacccggcccggccactccgcgcagtgcgcatcgcatcgcacgccccgcatgtgcacacacgcggctcacccggccatttacacgcctccccgcgcccacgctgcacacacgcccctcactttcgcattcagcgccctgactgtcctcactgtccctgctctggcttcgcaccccctcccgacactccggtccccatacaccctggaggttcccgaggcaggagcgctgggtctgcaggaaccgtcccaatctggaggggaacgttgcaccccagcccgaggaggccctggccgtgtgaagagccagatatgaccctcagccgccggtggcaccagcctgagtggggggctttccagagcttaggagaggggtatggcggggcaggggagga

SEQ ID NO: 106569 - DNA, 241 bp, Homo sapiens; identical to SEQ ID NO: 73276
  misc_feature 1..241: note = chr11:66824362-66824603
  misc_feature 1..241: note = Hyper
  source 1..241: mol_type = genomic DNA

SEQ ID NO: 106570 - DNA, 307 bp, Homo sapiens
  misc_feature 1..307: note = chr11:66885504-66885811
  misc_feature 1..307: note = Hyper
  source 1..307: mol_type = genomic DNA
ccagggcggcagggtcgggccgggggccgggggcggcccgcgcacccctccgtggggggcgccccgactcgccgggggcggggtcacgtcccacccgggccgccgggggcaccggcgcggcggaaagctgagcgtggccgaggagcgggggcttcctgggccacctcgccgggcgcctccggccggcggtgggcgcgccggccgccaccgcccccgggccgtcgcggagaccgcttctgcgcctggtacctgtggacgcccttgttaagcgcctgcagcacccccggggagccgagcccaggacaga

SEQ ID NO: 106571 - DNA, 180 bp, Homo sapiens; identical to SEQ ID NO: 73277
  misc_feature 1..180: note = chr11:66897583-66897763
  misc_feature 1..180: note = Hypo
  source 1..180: mol_type = genomic DNA

SEQ ID NO: 106572 - DNA, 42 bp, Homo sapiens; identical to SEQ ID NO: 73278
  misc_feature 1..42: note = chr11:66897883-66897925
  misc_feature 1..42: note = Hypo
  source 1..42: mol_type = genomic DNA

SEQ ID NO: 106573 - DNA, 295 bp, Homo sapiens; identical to SEQ ID NO: 43169
  misc_feature 1..295: note = chr11:67072101-67072396
  misc_feature 1..295: note = Hypo
  source 1..295: mol_type = genomic DNA

SEQ ID NO: 106574 - DNA, 183 bp, Homo sapiens; identical to SEQ ID NO: 73280
  misc_feature 1..183: note = chr11:67179695-67179878
  misc_feature 1..183: note = Hypo
  source 1..183: mol_type = genomic DNA

SEQ ID NO: 106575 - DNA, 264 bp, Homo sapiens; identical to SEQ ID NO: 73281
  misc_feature 1..264: note = chr11:67209957-67210221
  misc_feature 1..264: note = Hypo
  source 1..264: mol_type = genomic DNA

SEQ ID NO: 106576 - DNA, 217 bp, Homo sapiens; identical to SEQ ID NO: 73282
  misc_feature 1..217: note = chr11:67230800-67231017
  misc_feature 1..217: note = Hypo
  source 1..217: mol_type = genomic DNA

SEQ ID NO: 106577 - DNA, 206 bp, Homo sapiens; identical to SEQ ID NO: 73283
  misc_feature 1..206: note = chr11:67232077-67232283
  misc_feature 1..206: note = Hyper
  source 1..206: mol_type = genomic DNA

SEQ ID NO: 106578 - DNA, 36 bp, Homo sapiens; identical to SEQ ID NO: 73284
  misc_feature 1..36: note = chr11:67258422-67258458
  misc_feature 1..36: note = Hypo
  source 1..36: mol_type = genomic DNA

SEQ ID NO: 106579 - DNA, 30 bp, Homo sapiens; identical to SEQ ID NO: 73285
  misc_feature 1..30: note = chr11:67291596-67291626
  misc_feature 1..30: note = Hypo
  source 1..30: mol_type = genomic DNA

SEQ ID NO: 106580 - DNA, 51 bp, Homo sapiens
  misc_feature 1..51: note = chr11:67350939-67350990
  misc_feature 1..51: note = Hyper
  source 1..51: mol_type = genomic DNA
gctccgggatcgcagcggtcttagggaatttccccccgcgatgtcccggcg

SEQ ID NO: 106581 - DNA, 30 bp, Homo sapiens; identical to SEQ ID NO: 73287
  misc_feature 1..30: note = chr11:67378945-67378975
  misc_feature 1..30: note = Hypo
  source 1..30: mol_type = genomic DNA

SEQ ID NO: 106582 - DNA, 155 bp, Homo sapiens; identical to SEQ ID NO: 73288
  misc_feature 1..155: note = chr11:67402314-67402469
  misc_feature 1..155: note = Hypo
  source 1..155: mol_type = genomic DNA

SEQ ID NO: 106583 - DNA, 32 bp, Homo sapiens; identical to SEQ ID NO: 73289
  misc_feature 1..32: note = chr11:67408869-67408901
  misc_feature 1..32: note = Hypo
  source 1..32: mol_type = genomic DNA

SEQ ID NO: 106584 - DNA, 128 bp, Homo sapiens; identical to SEQ ID NO: 73290
  misc_feature 1..128: note = chr11:67442012-67442140
  misc_feature 1..128: note = Hypo
  source 1..128: mol_type = genomic DNA

SEQ ID NO: 106585 - DNA, 215 bp, Homo sapiens; identical to SEQ ID NO: 73291
  misc_feature 1..215: note = chr11:67462618-67462833
  misc_feature 1..215: note = Hypo
  source 1..215: mol_type = genomic DNA

SEQ ID NO: 106586 - DNA, 573 bp, Homo sapiens
  misc_feature 1..573: note = chr11:67478792-67479365
  misc_feature 1..573: note = Hyper
  source 1..573: mol_type = genomic DNA
ataggaggtgcaaagcgcggtcacacgcggcccgggtccgcggccgacagctgggaggatctggagcggggccgggtcgcaagaagaccctgaccctgctcccgcgctggggcgcgtgctaagggcccgcagggtttcagctgtattttcgaacccctgtgcttggccgaggggttcccaaggctccactccgccttggagggggctgcggaagcccggaggtgacccgggctctgggaggggcgtccccaatgtgggggaggggagacaggggcctttgaatacagcgcgggactcagagggggtccccccgacctaagacgtggtaaactgaggccggcgaggagggaggctgagtccggggaccaggcggcccctcactgctcctccggtccgtctcccctctgcgcctgttcgtacgggcagggccggcggccgagtccagcgggctcggggccaggcctgggccccgcgggcggcgcctcctcctccgcgccgtccccatgctcgtcctcagcgtcgctctcctccgagttgtcctccaagtagcggtaaccgcgcaccttgtgctgg

SEQ ID NO: 106587 - DNA, 232 bp, Homo sapiens; identical to SEQ ID NO: 73294
  misc_feature 1..232: note = chr11:67764062-67764294
  misc_feature 1..232: note = Hypo
  source 1..232: mol_type = genomic DNA

SEQ ID NO: 106588 - DNA, 147 bp, Homo sapiens; identical to SEQ ID NO: 15585
  misc_feature 1..147: note = chr11:67781462-67781609
  misc_feature 1..147: note = Hypo
  source 1..147: mol_type = genomic DNA

SEQ ID NO: 106589 - DNA, 146 bp, Homo sapiens; identical to SEQ ID NO: 73296
  misc_feature 1..146: note = chr11:67797137-67797283
  misc_feature 1..146: note = Hypo
  source 1..146: mol_type = genomic DNA

SEQ ID NO: 106590 - DNA, 154 bp, Homo sapiens; identical to SEQ ID NO: 73297
  misc_feature 1..154: note = chr11:67811705-67811859
  misc_feature 1..154: note = Hypo
  source 1..154: mol_type = genomic DNA

SEQ ID NO: 106591 - DNA, 23 bp, Homo sapiens
  misc_feature 1..23: note = chr11:67865088-67865111
  misc_feature 1..23: note = Hypo
  source 1..23: mol_type = genomic DNA
caagactccgtctcaaaaaaaaa

SEQ ID NO: 106592 - DNA, 405 bp, Homo sapiens; identical to SEQ ID NO: 73299
  misc_feature 1..405: note = chr11:67895795-67896200
  misc_feature 1..405: note = Hyper
  source 1..405: mol_type = genomic DNA

SEQ ID NO: 106593 - DNA, 187 bp, Homo sapiens; identical to SEQ ID NO: 73300
  misc_feature 1..187: note = chr11:67915941-67916128
  misc_feature 1..187: note = Hypo
  source 1..187: mol_type = genomic DNA

SEQ ID NO: 106594 - DNA, 68 bp, Homo sapiens; identical to SEQ ID NO: 73301
  misc_feature 1..68: note = chr11:67984320-67984388
  misc_feature 1..68: note = Hypo
  source 1..68: mol_type = genomic DNA

SEQ ID NO: 106595 - DNA, 45 bp, Homo sapiens; identical to SEQ ID NO: 73302
  misc_feature 1..45: note = chr11:68096122-68096167
  misc_feature 1..45: note = Hyper
  source 1..45: mol_type = genomic DNA

SEQ ID NO: 106596 - DNA, 154 bp, Homo sapiens; identical to SEQ ID NO: 15587
  misc_feature 1..154: note = chr11:68111091-68111245
  misc_feature 1..154: note = Hypo
  source 1..154: mol_type = genomic DNA

SEQ ID NO: 106597 - DNA, 236 bp, Homo sapiens; identical to SEQ ID NO: 73304
  misc_feature 1..236: note = chr11:68132977-68133213
  misc_feature 1..236: note = Hypo
  source 1..236: mol_type = genomic DNA

SEQ ID NO: 106598 - DNA, 30 bp, Homo sapiens; identical to SEQ ID NO: 73305
  misc_feature 1..30: note = chr11:68133516-68133546
  misc_feature 1..30: note = Hypo
  source 1..30: mol_type = genomic DNA

SEQ ID NO: 106599 - DNA, 81 bp, Homo sapiens; identical to SEQ ID NO: 73306
  misc_feature 1..81: note = chr11:68210051-68210132
  misc_feature 1..81: note = Hypo
  source 1..81: mol_type = genomic DNA

SEQ ID NO: 106600 - DNA, 76 bp, Homo sapiens; identical to SEQ ID NO: 73307
  misc_feature 1..76: note = chr11:68225302-68225378
  misc_feature 1..76: note = Hypo
  source 1..76: mol_type = genomic DNA

SEQ ID NO: 106601 - DNA, 42 bp, Homo sapiens; identical to SEQ ID NO: 73308
  misc_feature 1..42: note = chr11:68226707-68226749
  misc_feature 1..42: note = Hypo
  source 1..42: mol_type = genomic DNA

SEQ ID NO: 106602 - DNA, 82 bp, Homo sapiens; identical to SEQ ID NO: 43183
  misc_feature 1..82: note = chr11:68385159-68385241
  misc_feature 1..82: note = Hypo
  source 1..82: mol_type = genomic DNA

SEQ ID NO: 106603 - DNA, 201 bp, Homo sapiens; identical to SEQ ID NO: 73310
  misc_feature 1..201: note = chr11:68385532-68385733
  misc_feature 1..201: note = Hypo
  source 1..201: mol_type = genomic DNA

SEQ ID NO: 106604 - DNA, 30 bp, Homo sapiens; identical to SEQ ID NO: 73311
  misc_feature 1..30: note = chr11:68400244-68400274
  misc_feature 1..30: note = Hypo
  source 1..30: mol_type = genomic DNA

SEQ ID NO: 106605 - DNA, 30 bp, Homo sapiens; identical to SEQ ID NO: 73312
  misc_feature 1..30: note = chr11:68409085-68409115
  misc_feature 1..30: note = Hypo
  source 1..30: mol_type = genomic DNA

SEQ ID NO: 106606 - DNA, 38 bp, Homo sapiens; identical to SEQ ID NO: 73313
  misc_feature 1..38: note = chr11:68409607-68409645
  misc_feature 1..38: note = Hypo
  source 1..38: mol_type = genomic DNA

SEQ ID NO: 106607 - DNA, 30 bp, Homo sapiens; identical to SEQ ID NO: 43185
  misc_feature 1..30: note = chr11:68412854-68412884
  misc_feature 1..30: note = Hypo
  source 1..30: mol_type = genomic DNA

SEQ ID NO: 106608 - DNA, 197 bp, Homo sapiens; identical to SEQ ID NO: 73315
  misc_feature 1..197: note = chr11:68417837-68418034
  misc_feature 1..197: note = Hypo
  source 1..197: mol_type = genomic DNA

SEQ ID NO: 106609 - DNA, 41 bp, Homo sapiens; identical to SEQ ID NO: 73316
  misc_feature 1..41: note = chr11:68418419-68418460
  misc_feature 1..41: note = Hypo
  source 1..41: mol_type = genomic DNA

SEQ ID NO: 106610 - DNA, 242 bp, Homo sapiens; identical to SEQ ID NO: 43187
  misc_feature 1..242: note = chr11:68432989-68433231
  misc_feature 1..242: note = Hypo
  source 1..242: mol_type = genomic DNA

SEQ ID NO: 106611 - DNA, 456 bp, Homo sapiens; identical to SEQ ID NO: 73318
  misc_feature 1..456: note = chr11:68437415-68437871
  misc_feature 1..456: note = Hypo
  source 1..456: mol_type = genomic DNA

SEQ ID NO: 106612 - DNA, 878 bp, Homo sapiens; identical to SEQ ID NO: 73319
  misc_feature 1..878: note = chr11:68451662-68452540
  misc_feature 1..878: note = Hyper
  source 1..878: mol_type = genomic DNA

SEQ ID NO: 106613 - DNA, 319 bp, Homo sapiens; identical to SEQ ID NO: 73320
  misc_feature 1..319: note = chr11:68460889-68461208
  misc_feature 1..319: note = Hypo
  source 1..319: mol_type = genomic DNA

SEQ ID NO: 106614 - DNA, 36 bp, Homo sapiens; identical to SEQ ID NO: 73321
  misc_feature 1..36: note = chr11:68564345-68564381
  misc_feature 1..36: note = Hypo
  source 1..36: mol_type = genomic DNA

SEQ ID NO: 106615 - DNA, 153 bp, Homo sapiens; identical to SEQ ID NO: 73322
  misc_feature 1..153: note = chr11:68607258-68607411
  misc_feature 1..153: note = Hyper
  source 1..153: mol_type = genomic DNA

SEQ ID NO: 106616 - DNA, 30 bp, Homo sapiens; identical to SEQ ID NO: 43189
  misc_feature 1..30: note = chr11:68672906-68672936
  misc_feature 1..30: note = Hypo
  source 1..30: mol_type = genomic DNA

SEQ ID NO: 106617 - DNA, 30 bp, Homo sapiens; identical to SEQ ID NO: 43190
  misc_feature 1..30: note = chr11:68692056-68692086
  misc_feature 1..30: note = Hypo
  source 1..30: mol_type = genomic DNA

SEQ ID NO: 106618 - DNA, 38 bp, Homo sapiens; identical to SEQ ID NO: 43191
  misc_feature 1..38: note = chr11:68771669-68771707
  misc_feature 1..38: note = Hypo
  source 1..38: mol_type = genomic DNA

SEQ ID NO: 106619 - DNA, 76 bp, Homo sapiens; identical to SEQ ID NO: 43192
  misc_feature 1..76: note = chr11:68804728-68804804
  misc_feature 1..76: note = Hypo
  source 1..76: mol_type = genomic DNA

SEQ ID NO: 106620 - DNA, 30 bp, Homo sapiens; identical to SEQ ID NO: 73327
  misc_feature 1..30: note = chr11:68902975-68903005
  misc_feature 1..30: note = Hypo
  source 1..30: mol_type = genomic DNA

SEQ ID NO: 106621 - DNA, 172 bp, Homo sapiens; identical to SEQ ID NO: 73328
  misc_feature 1..172: note = chr11:68965052-68965224
  misc_feature 1..172: note = Hypo
  source 1..172: mol_type = genomic DNA

SEQ ID NO: 106622 - DNA, 30 bp, Homo sapiens; identical to SEQ ID NO: 73329
  misc_feature 1..30: note = chr11:68975015-68975045
  misc_feature 1..30: note = Hypo
  source 1..30: mol_type = genomic DNA

SEQ ID NO: 106623 - DNA, 376 bp, Homo sapiens; identical to SEQ ID NO: 73330
  misc_feature 1..376: note = chr11:69192450-69192826
  misc_feature 1..376: note = Hypo
  source 1..376: mol_type = genomic DNA

SEQ ID NO: 106624 - DNA, 30 bp, Homo sapiens; identical to SEQ ID NO: 73331
  misc_feature 1..30: note = chr11:69193336-69193366
  misc_feature 1..30: note = Hypo
  source 1..30: mol_type = genomic DNA

SEQ ID NO: 106625 - DNA, 30 bp, Homo sapiens; identical to SEQ ID NO: 43195
  misc_feature 1..30: note = chr11:69206384-69206414
  misc_feature 1..30: note = Hypo
  source 1..30: mol_type = genomic DNA

SEQ ID NO: 106626 - DNA, 148 bp, Homo sapiens; identical to SEQ ID NO: 73333
  misc_feature 1..148: note = chr11:69227108-69227256
  misc_feature 1..148: note = Hypo
  source 1..148: mol_type = genomic DNA

SEQ ID NO: 106627 - DNA, 30 bp, Homo sapiens; identical to SEQ ID NO: 73334
  misc_feature 1..30: note = chr11:69253125-69253155
  misc_feature 1..30: note = Hypo
  source 1..30: mol_type = genomic DNA

SEQ ID NO: 106628 - DNA, 94 bp, Homo sapiens; identical to SEQ ID NO: 73335
  misc_feature 1..94: note = chr11:69269195-69269289
  misc_feature 1..94: note = Hypo
  source 1..94: mol_type = genomic DNA

SEQ ID NO: 106629 - DNA, 111 bp, Homo sapiens; identical to SEQ ID NO: 73336
  misc_feature 1..111: note = chr11:69279556-69279667
  misc_feature 1..111: note = Hypo
  source 1..111: mol_type = genomic DNA

SEQ ID NO: 106630 - DNA, 190 bp, Homo sapiens; identical to SEQ ID NO: 73337
  misc_feature 1..190: note = chr11:69280486-69280676
  misc_feature 1..190: note = Hypo
  source 1..190: mol_type = genomic DNA

SEQ ID NO: 106631 - DNA, 67 bp, Homo sapiens; identical to SEQ ID NO: 43197
  misc_feature 1..67: note = chr11:69339948-69340015
  misc_feature 1..67: note = Hypo
  source 1..67: mol_type = genomic DNA

SEQ ID NO: 106632 - DNA, 167 bp, Homo sapiens; identical to SEQ ID NO: 43198
  misc_feature 1..167: note = chr11:69360946-69361113
  misc_feature 1..167: note = Hypo
  source 1..167: mol_type = genomic DNA

SEQ ID NO: 106633 - DNA, 30 bp, Homo sapiens; identical to SEQ ID NO: 73340
  misc_feature 1..30: note = chr11:69431611-69431641
  misc_feature 1..30: note = Hypo
  source 1..30: mol_type = genomic DNA

SEQ ID NO: 106634 - DNA, 91 bp, Homo sapiens; identical to SEQ ID NO: 73341
  misc_feature 1..91: note = chr11:69452198-69452289
  misc_feature 1..91: note = Hyper
  source 1..91: mol_type = genomic DNA

SEQ ID NO: 106635 - DNA, 711 bp, Homo sapiens; identical to SEQ ID NO: 73342
  misc_feature 1..711: note = chr11:69452657-69453368
  misc_feature 1..711: note = Hyper
  source 1..711: mol_type = genomic DNA

SEQ ID NO: 106636 - DNA, 48 bp, Homo sapiens; identical to SEQ ID NO: 73343
  misc_feature 1..48: note = chr11:69458766-69458814
  misc_feature 1..48: note = Hypo
  source 1..48: mol_type = genomic DNA

SEQ ID NO: 106637 - DNA, 64 bp, Homo sapiens; identical to SEQ ID NO: 73344
  misc_feature 1..64: note = chr11:69466049-69466113
  misc_feature 1..64: note = Hypo
  source 1..64: mol_type = genomic DNA

SEQ ID NO: 106638 - DNA, 59 bp, Homo sapiens; identical to SEQ ID NO: 73345
  misc_feature 1..59: note = chr11:69468423-69468482
  misc_feature 1..59: note = Hypo
  source 1..59: mol_type = genomic DNA

SEQ ID NO: 106639 - DNA, 32 bp, Homo sapiens; identical to SEQ ID NO: 73347
  misc_feature 1..32: note = chr11:69481718-69481750
  misc_feature 1..32: note = Hypo
  source 1..32: mol_type = genomic DNA

SEQ ID NO: 106640 - DNA, 154 bp, Homo sapiens; identical to SEQ ID NO: 73348
  misc_feature 1..154: note = chr11:69498956-69499110
  misc_feature 1..154: note = Hypo
  source 1..154: mol_type = genomic DNA

SEQ ID NO: 106641 - DNA, 472 bp, Homo sapiens; identical to SEQ ID NO: 73349
  misc_feature 1..472: note = chr11:69516989-69517461
  misc_feature 1..472: note = Hyper
  source 1..472: mol_type = genomic DNA

SEQ ID NO: 106642 - DNA, 897 bp, Homo sapiens
  misc_feature 1..897: note = chr11:69517719-69518616
  misc_feature 1..897: note = Hyper
  source 1..897: mol_type = genomic DNA
aatatcaaaggaggccgaataatgggtttcctcggtccggctaggccggcctttgactcaattggaaatgcaaaggcagcttttgcctattctctggctgctggctgagaccctaaatttccgtaggaaatcgtcggacatgcacttaatcggtctttgcaatctttccctcgaagttgcacgcgggtctgggcggaggaggcgaggaaaccctggattcgaaccagcgcctttctctccttcaggcctccgcccggggacaggcgccggtcccccgccccggcgcatccgccccgtggggacacttaccagcccctgcatcttgccgtcggcgcccatgcagaggtaccgcacgctgtgcacgcccttgatggccacggtccgcagagcgactgccttgatctccagcaaacctaggcgcaggggaagcgagaagctgcagcaaggaccgctgggcccgcaccacgtgggtgcggtcggtccacaagcctgtgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgccccagccgtagtgcacgtggggccccgcgtccgagaaggcgagggggcgcccggccacggccagccagaggccggccaggatccata

SEQ ID NO: 106643 - DNA, 870 bp, Homo sapiens; identical to SEQ ID NO: 73352
  misc_feature 1..870: note = chr11:69519059-69519929
  misc_feature 1..870: note = Hyper
  source 1..870: mol_type = genomic DNA

SEQ ID NO: 106644 - DNA, 101 bp, Homo sapiens; identical to SEQ ID NO: 73353
  misc_feature 1..101: note = chr11:69533072-69533173
  misc_feature 1..101: note = Hyper
  source 1..101: mol_type = genomic DNA

SEQ ID NO: 106645 - DNA, 670 bp, Homo sapiens; identical to SEQ ID NO: 73354
  misc_feature 1..670: note = chr11:69588847-69589517
  misc_feature 1..670: note = Hyper
  source 1..670: mol_type = genomic DNA

SEQ ID NO: 106646 - DNA, 889 bp, Homo sapiens
  misc_feature 1..889: note = chr11:69589746-69590635
  misc_feature 1..889: note = Hyper
  source 1..889: mol_type = genomic DNA
tgggtgcagtgggtgcggcggcgccccctcggcccgcccagggcgccagcaaggccagcaggaccgccgggagcagcgctaccgcggccgtcccgggccccgacatcccggcccgagggccgtgcgtcggtcaggcggtcagtgcgcccgggaagctggggggcagagctgcgcctgtggcgtcccgcgggagcgcacggccgacctcgggcaggagtgcgcaaccgaggaggtgcgggaggcaagcgacggggcccccgggcgccgggctctaccccggctgcatggagcggcgagccgggcggaaagcgcgcggctggagctgggactctgaggagcagtgcgcgcctccctgagcgccaggcccgcccgaggccgagccgctatatatatagcccggcgccccctcctactcgcccgctcccgcggggggccgttcgcgttctcctgggcgcccggggcgctgtggcgttcgcggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacgggaacttggttcctttgctggggccttgaggaccggcctgggaaggaggggtggataagagcagtaagcgacaccggggcctggctggg

SEQ ID NO: 106647 - DNA, 99 bp, Homo sapiens; identical to SEQ ID NO: 73357
  misc_feature 1..99: note = chr11:69611957-69612056
  misc_feature 1..99: note = Hypo
  source 1..99: mol_type = genomic DNA

SEQ ID NO: 106648 - DNA, 184 bp, Homo sapiens; identical to SEQ ID NO: 73359
  misc_feature 1..184: note = chr11:69970448-69970632
  misc_feature 1..184: note = Hypo
  source 1..184: mol_type = genomic DNA

SEQ ID NO: 106649 - DNA, 50 bp, Homo sapiens; identical to SEQ ID NO: 73360
  misc_feature 1..50: note = chr11:70005678-70005728
  misc_feature 1..50: note = Hypo
  source 1..50: mol_type = genomic DNA

SEQ ID NO: 106650 - DNA, 36 bp, Homo sapiens; identical to SEQ ID NO: 73361
  misc_feature 1..36: note = chr11:70017163-70017199
  misc_feature 1..36: note = Hypo
  source 1..36: mol_type = genomic DNA

SEQ ID NO: 106651 - DNA, 30 bp, Homo sapiens; identical to SEQ ID NO: 43204
  misc_feature 1..30: note = chr11:70022959-70022989
  misc_feature 1..30: note = Hypo
  source 1..30: mol_type = genomic DNA

SEQ ID NO: 106652 - DNA, 30 bp, Homo sapiens; identical to SEQ ID NO: 73363
  misc_feature 1..30: note = chr11:70023256-70023286
  misc_feature 1..30: note = Hypo
  source 1..30: mol_type = genomic DNA

SEQ ID NO: 106653 - DNA, 265 bp, Homo sapiens; identical to SEQ ID NO: 73364
  misc_feature 1..265: note = chr11:70050901-70051166
  misc_feature 1..265: note = Hypo
  source 1..265: mol_type = genomic DNA

SEQ ID NO: 106654 - DNA, 42 bp, Homo sapiens; identical to SEQ ID NO: 73365
  misc_feature 1..42: note = chr11:70098175-70098217
  misc_feature 1..42: note = Hypo
  source 1..42: mol_type = genomic DNA

SEQ ID NO: 106655 - DNA, 98 bp, Homo sapiens; identical to SEQ ID NO: 73368
  misc_feature 1..98: note = chr11:71098921-71099019
  misc_feature 1..98: note = Hypo
  source 1..98: mol_type = genomic DNA

SEQ ID NO: 106656 - DNA, 30 bp, Homo sapiens; identical to SEQ ID NO: 73369
  misc_feature 1..30: note = chr11:71108366-71108396
  misc_feature 1..30: note = Hypo
  source 1..30: mol_type = genomic DNA

SEQ ID NO: 106657 - DNA, 57 bp, Homo sapiens; identical to SEQ ID NO: 43207
  misc_feature 1..57: note = chr11:71117658-71117715
  misc_feature 1..57: note = Hypo
  source 1..57: mol_type = genomic DNA

SEQ ID NO: 106658 - DNA, 185 bp, Homo sapiens; identical to SEQ ID NO: 73371
  misc_feature 1..185: note = chr11:71192648-71192833
  misc_feature 1..185: note = Hypo
  source 1..185: mol_type = genomic DNA

SEQ ID NO: 106659 - DNA, 54 bp, Homo sapiens; identical to SEQ ID NO: 33940
  misc_feature 1..54: note = chr11:71274712-71274766
  misc_feature 1..54: note = Hyper
  source 1..54: mol_type = genomic DNA

SEQ ID NO: 106660 - DNA, 783 bp, Homo sapiens
  misc_feature 1..783: note = chr11:71318274-71319057
  misc_feature 1..783: note = Hyper
  source 1..783: mol_type = genomic DNA
taggcggggaaggtgcggggcgaggcggccgcggctccctggcatccctctccttacccccaggctaagctggcggtgctgctggtgacgctggtggcggccgcggtctcctacctgcggatggagcagaagctgcggcggggcgtgcgccagccccgcatcccgtggccccagcacaaggtgcgcagttaccgctacttggaggaggacaactcggacgagagcgacgcggagggcgagcatggggacggcgcggaggaggaggcgccgcccgcggggaccaggcctggtcccgagcaggctggactcggccgccggccctgcccgtaggaacaggcgcaggggggcgactggccagaggagcagtgaggggccgcctggtccacggactcagcctccctcctcgccggccttagtttaccacttcttaggtcggggggaccccctccgagtcccgcgctgtcttcaaaggcccctgtctcccgtcccccacgttggggacgcccctcccagagcccaggtcacctccgggcttccgcagccccctccaaggcggagtggagctttgggaacccctcggccaagcacagcggttcgaaaatacagctgaaacccagcgggcccttagcacgcgccccagcgccggagcagggtcagggtcttcttgcgacccggctccgctccagatccccccagctctcggcggcggacccgggccgcgtgtgagcgcgctttgcacctcctatccccagggtccgccgagagccacgattttttacagaa

SEQ ID NO: 106661 - DNA, 98 bp, Homo sapiens; identical to SEQ ID NO: 73376
  misc_feature 1..98: note = chr11:71507939-71508037
  misc_feature 1..98: note = Hypo
  source 1..98: mol_type = genomic DNA

SEQ ID NO: 106662 - DNA, 29 bp, Homo sapiens
  misc_feature 1..29: note = chr11:71781578-71781607
  misc_feature 1..29: note = Hypo
  source 1..29: mol_type = genomic DNA
cccagtggctcacagcggtaatcccagca

SEQ ID NO: 106663 - DNA, 30 bp, Homo sapiens; identical to SEQ ID NO: 73378
  misc_feature 1..30: note = chr11:71792634-71792664
  misc_feature 1..30: note = Hypo
  source 1..30: mol_type = genomic DNA

SEQ ID NO: 106664 - DNA, 30 bp, Homo sapiens; identical to SEQ ID NO: 73379
  misc_feature 1..30: note = chr11:71850743-71850773
  misc_feature 1..30: note = Hypo
  source 1..30: mol_type = genomic DNA

SEQ ID NO: 106665 - DNA, 30 bp, Homo sapiens; identical to SEQ ID NO: 73380
  misc_feature 1..30: note = chr11:71939243-71939273
  misc_feature 1..30: note = Hypo
  source 1..30: mol_type = genomic DNA

SEQ ID NO: 106666 - DNA, 566 bp, Homo sapiens
  misc_feature 1..566: note = chr11:71951172-71951738
  misc_feature 1..566: note = Hyper
  source 1..566: mol_type = genomic DNA
ccgccgcgcccttggcgctggccgcgcgctcctgtttgcggaacttggcccggcggttctggaaccagacctgcgggcacaggggccagtcagcctggacgagggtcggagaacgcacggggtcagcccgcggccgcaaggctcgagtgagatcctggttcggaaagaaccgggcccgggttcttactagttggaggggccttcggccctccgcacgcagcccgctgcactccgcgctccactggcccctgcctccagatccctgggttcttgcccttgggatccactcacccgctgactctgctgcctcccagcactcttggtctcccggaggggaccctgccttcgttctcctcactctaagttcttcccccaattccttcttttaggaagctctgggacttccctcctggagtgttccagggccgtggagagcagtttagggcgccagtaaaccttttgtctagggcatccagtcaaggcgggccaactgaacatctgtacacggagttgtacaaatagacaacagtctgctctagcccggctctcttcggccctgtgcctgc

SEQ ID NO: 106667 - DNA, 406 bp, Homo sapiens
  misc_feature 1..406: note = chr11:71952135-71952541
  misc_feature 1..406: note = Hyper
  source 1..406: mol_type = genomic DNA
atacacgcacctgcacgcgagcctcagtgaggtcgatcttgagcgccagctcctcacgcgtgtaaatgtcggggtagtgggtctcagcgaaaacgcgctccagctccttgagctgcgcgctggtgaacgtggtgcggatgcgccgctgcttgcgcttctcgtgcaggccggatggctctgggaagaacttgtagggcactgcgggtgtgtgcaggggggccggggggggggcaaaaaggatgggggagtgagaagcagagttcaacccgttgtgtccagctccgggggaatcacacgcctcccccgtccctggcctgatccctcgtcttggtcccggcagcctggggccgagcgtcctccctattactcaatggagccggcgggataaaggcggagggagatcagg

SEQ ID NO: 106668 - DNA, 1784 bp, Homo sapiens
  misc_feature 1..1784: note = chr11:71954593-71956377
  misc_feature 1..1784: note = Hyper
  source 1..1784: mol_type = genomic DNA
ttgacctgaagggcacgagacagagatttggcaacgagaaaaaggaacaggagagatgagagggtgaggctcattcctgcggaggagaacctcgtattctgggggtctctcggggcattggagggtctggccaaggcaggaatgggggcggctgagggggacagtcgcattcacttggcgagcgggcccagggattctgcaggaattggagggagggttgggccggggctgcgctcacctgccgagtagggcgcgggctggtggtcgcgtagggcgccaagtgcgcagttggaggagccgagcgcggggcagggcggccctgccgcggggaaagcgggccgcagggggctgtattggaagccgccgggctggctgcaggcgccaaagtcgccgtaggcggacgcctccatggccgccacgcacgagtcgtacgaattgaggtaggagtagtccatcggcccggggggcgggggcgggggccgggccaggccgggtcggggtcggggtccgggtggaggtcggaagggaggttcgagcgccaggctccgaggacccgaggccagctctgagcgcccgagagtccgcccgccccgtcgcggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgacccccaccccgaagggtccccgccgccgtcttagggctcagaggtgtggagctgggatgcgcgggaccctatccccggagtccctatcctgccccaatccggaccagaccttcggtctctacacagcgtccgaggccagagggtcccgacccttttcccgggcctccccacctgcggccccgcggaagggaggggaggcaggcctggcggcgctcgtgtgaagaagttaattcaattcgctctgataaccgagttattccgatctggcccctcagccccgcccccagcgaggtcccatcccggcggagactgcggaggcggcccaggaagggggatggagaccgggaagagacggagcctgggatggggacagggaagggacgtggatagacagaggaaacagagaccgggagagaaaggggcagaaacagtgatggagacagggacaagagatacaggtacacagagggagacaaggacggaacatacacagcgaaagacaggatggagcggggacagggcagagacaggagatgagggtaagagagagacaggatggagcggggacagggcagagacaggagatgaggttaagagagagacaagaggagacagggagacagggggacgagaaagagagtgagggaggcatggagacagaaggggtcgggatgagacatggacggcaaccaggactgcggtggagagcaagggagggatgagacaaaacagaggcaggaatcgtgagacagacacatatgcccagggacagtctgagagagacagggccagggacagccacaagcgcgggagcagaggctgagagcggagagaaaacgcctccggggagcttagacacgagggctggagcgcagaggggcccagggatgatgctggaggctctggggtgcggcctccacggggctgcggagagggagggtcgtgggagccaggtccctctaccctgacttgtcccgaggcccacacgaccttgcaccttcagggcccgcctgcctctccccccgttccctcagctcc

SEQ ID NO: 106669 - DNA, 269 bp, Homo sapiens; identical to SEQ ID NO: 73390
  misc_feature 1..269: note = chr11:72109412-72109681
  misc_feature 1..269: note = Hypo
  source 1..269: mol_type = genomic DNA

SEQ ID NO: 106670 - DNA, 174 bp, Homo sapiens; identical to SEQ ID NO: 73391
  misc_feature 1..174: note = chr11:72125662-72125836
  misc_feature 1..174: note = Hypo
  source 1..174: mol_type = genomic DNA

SEQ ID NO: 106671 - DNA, 24 bp, Homo sapiens
  misc_feature 1..24: note = chr11:72146622-72146646
  misc_feature 1..24: note = Hypo
  source 1..24: mol_type = genomic DNA
gagccactgcgcctggccctgatt

SEQ ID NO: 106672 - DNA, 169 bp, Homo sapiens; identical to SEQ ID NO: 73393
  misc_feature 1..169: note = chr11:72388041-72388210
  misc_feature 1..169: note = Hyper
  source 1..169: mol_type = genomic DNA

SEQ ID NO: 106673 - DNA, 322 bp, Homo sapiens; identical to SEQ ID NO: 33953
  misc_feature 1..322: note = chr11:72432837-72433159
  misc_feature 1..322: note = Hyper
  source 1..322: mol_type = genomic DNA

SEQ ID NO: 106674 - DNA, 253 bp, Homo sapiens; identical to SEQ ID NO: 73395
  misc_feature 1..253: note = chr11:72433380-72433633
  misc_feature 1..253: note = Hyper
  source 1..253: mol_type = genomic DNA

SEQ ID NO: 106675 - DNA, 431 bp, Homo sapiens; identical to SEQ ID NO: 73396
  misc_feature 1..431: note = chr11:72465657-72466088
  misc_feature 1..431: note = Hypo
  source 1..431: mol_type = genomic DNA

SEQ ID NO: 106676 - DNA, 46 bp, Homo sapiens; identical to SEQ ID NO: 43212
  misc_feature 1..46: note = chr11:72475677-72475723
  misc_feature 1..46: note = Hypo
  source 1..46: mol_type = genomic DNA

SEQ ID NO: 106677 - DNA, 30 bp, Homo sapiens; identical to SEQ ID NO: 73398
  misc_feature 1..30: note = chr11:72492307-72492337
  misc_feature 1..30: note = Hyper
  source 1..30: mol_type = genomic DNA

SEQ ID NO: 106678 - DNA, 204 bp, Homo sapiens; identical to SEQ ID NO: 73399
  misc_feature 1..204: note = chr11:72532174-72532378
  misc_feature 1..204: note = Hypo
  source 1..204: mol_type = genomic DNA

SEQ ID NO: 106679 - DNA, 42 bp, Homo sapiens; identical to SEQ ID NO: 73400
  misc_feature 1..42: note = chr11:72532613-72532655
  misc_feature 1..42: note = Hypo
  source 1..42: mol_type = genomic DNA

SEQ ID NO: 106680 - DNA, 228 bp, Homo sapiens; identical to SEQ ID NO: 73407
  misc_feature 1..228: note = chr11:72905832-72906060
  misc_feature 1..228: note = Hypo
  source 1..228: mol_type = genomic DNA

SEQ ID NO: 106681 - DNA, 388 bp, Homo sapiens; identical to SEQ ID NO: 73408
  misc_feature 1..388: note = chr11:72929267-72929655
  misc_feature 1..388: note = Hyper
  source 1..388: mol_type = genomic DNA

SEQ ID NO: 106682 - DNA, 266 bp, Homo sapiens; identical to SEQ ID NO: 73409
  misc_feature 1..266: note = chr11:73019833-73020099
  misc_feature 1..266: note = Hyper
  source 1..266: mol_type = genomic DNA

SEQ ID NO: 106683 - DNA, 762 bp, Homo sapiens; identical to SEQ ID NO: 73410
  misc_feature 1..762: note = chr11:73072907-73073669
  misc_feature 1..762: note = Hypo
  source 1..762: mol_type = genomic DNA

SEQ ID NO: 106684 - DNA, 153 bp, Homo sapiens; identical to SEQ ID NO: 73411
  misc_feature 1..153: note = chr11:73310292-73310445
  misc_feature 1..153: note = Hypo
  source 1..153: mol_type = genomic DNA

SEQ ID NO: 106685 - DNA, 26 bp, Homo sapiens
  misc_feature 1..26: note = chr11:73507247-73507273
  misc_feature 1..26: note = Hypo
  source 1..26: mol_type = genomic DNA
ttccgagtgcagttacggccgcccaa

SEQ ID NO: 106686 - DNA, 135 bp, Homo sapiens; identical to SEQ ID NO: 73414
  misc_feature 1..135: note = chr11:73662980-73663115
  misc_feature 1..135: note = Hypo
  source 1..135: mol_type = genomic DNA

SEQ ID NO: 106687 - DNA, 84 bp, Homo sapiens; identical to SEQ ID NO: 73415
  misc_feature 1..84: note = chr11:73679409-73679493
  misc_feature 1..84: note = Hypo
  source 1..84: mol_type = genomic DNA

SEQ ID NO: 106688 - DNA, 30 bp, Homo sapiens; identical to SEQ ID NO: 73416
  misc_feature 1..30: note = chr11:73679852-73679882
  misc_feature 1..30: note = Hypo
  source 1..30: mol_type = genomic DNA

SEQ ID NO: 106689 - DNA, 30 bp, Homo sapiens; identical to SEQ ID NO: 73417
  misc_feature 1..30: note = chr11:73764263-73764293
  misc_feature 1..30: note = Hypo
  source 1..30: mol_type = genomic DNA

SEQ ID NO: 106690 - DNA, 30 bp, Homo sapiens; identical to SEQ ID NO: 43218
  misc_feature 1..30: note = chr11:73805524-73805554
  misc_feature 1..30: note = Hypo
  source 1..30: mol_type = genomic DNA

SEQ ID NO: 106691 - DNA, 33 bp, Homo sapiens; identical to SEQ ID NO: 73419
  misc_feature 1..33: note = chr11:73883502-73883535
  misc_feature 1..33: note = Hypo
  source 1..33: mol_type = genomic DNA

SEQ ID NO: 106692 - DNA, 37 bp, Homo sapiens; identical to SEQ ID NO: 73421
  misc_feature 1..37: note = chr11:74022679-74022716
  misc_feature 1..37: note = Hyper
  source 1..37: mol_type = genomic DNA

SEQ ID NO: 106693 - DNA, 141 bp, Homo sapiens; identical to SEQ ID NO: 73422
  misc_feature 1..141: note = chr11:74064904-74065045
  misc_feature 1..141: note = Hypo
  source 1..141: mol_type = genomic DNA

SEQ ID NO: 106694 - DNA, 23 bp, Homo sapiens
  misc_feature 1..23: note = chr11:74100854-74100877
  misc_feature 1..23: note = Hypo
  source 1..23: mol_type = genomic DNA
cttgaaggaactggccgggtgcg

SEQ ID NO: 106695 - DNA, 39 bp, Homo sapiens; identical to SEQ ID NO: 73424
  misc_feature 1..39: note = chr11:74107733-74107772
  misc_feature 1..39: note = Hypo
  source 1..39: mol_type = genomic DNA

SEQ ID NO: 106696 - DNA, 36 bp, Homo sapiens; identical to SEQ ID NO: 33956
  misc_feature 1..36: note = chr11:74178590-74178626
  misc_feature 1..36: note = Hyper
  source 1..36: mol_type = genomic DNA

SEQ ID NO: 106697 - DNA, 36 bp, Homo sapiens; identical to SEQ ID NO: 73426
  misc_feature 1..36: note = chr11:74246640-74246676
  misc_feature 1..36: note = Hypo
  source 1..36: mol_type = genomic DNA

SEQ ID NO: 106698 - DNA, 202 bp, Homo sapiens
  misc_feature 1..202: note = chr11:74302524-74302726
  misc_feature 1..202: note = Hypo
  source 1..202: mol_type = genomic DNA
caccgcgcccggtctgctaccctattttaaaccaccactatctttcacttaaaaatctcagaatgtaagttacatgtgaacaggctcggtttattattgctcatagctgcagccccagcacctcaacactcagaatagtatctggcctttctcaggattttgctatgctttgaatgaatgcatgtcgcgacaagcctttgaa

SEQ ID NO: 106699 - DNA, 242 bp, Homo sapiens; identical to SEQ ID NO: 73429
  misc_feature 1..242: note = chr11:74394395-74394637
  misc_feature 1..242: note = Hyper
  source 1..242: mol_type = genomic DNA

SEQ ID NO: 106700 - DNA, 37 bp, Homo sapiens; identical to SEQ ID NO: 73430
  misc_feature 1..37: note = chr11:74394860-74394897
  misc_feature 1..37: note = Hyper
  source 1..37: mol_type = genomic DNA

SEQ ID NO: 106701 - DNA, 1038 bp, Homo sapiens
  misc_feature 1..1038: note = chr11:74441835-74442873
  misc_feature 1..1038: note = Hyper
  source 1..1038: mol_type = genomic DNA
ctcccggtctacttacgggctcgagcgtgggagtccagggggaaccagagcagcgcgagtcccagcaaggaggagaggaccctcacctcgggaaccatcctttccccagggtcaggccgctggtccgggagcggagtcgggaggaagggagacgaaaaggacacggaggcacaggggccacagatcaacccacagaccccaggaggtctgctgctagagcggggtcggagaagggccaggaagcagcggtgggcaggaaaggagggcaggaagggaggtctaaggtgggaagaagagaaaggtggaaagagaacgcggggaaaggagggagagatggagagacgaaggaaggtccagcagaagggagaggcgatcaaagaaagggggaaggtgagagggagaggaggagaaagcagggagaggaccggcgtctgccgagcgcgcagcgccgggcgaggcgcgcgggaccagcgggtgttgcgggcgcgcgggctagaggcggccggcgccccctgctcggtgggctcggggtcgggccgcgggggcctggggcccggcggggcggcggtcccagcagcggcggcggcgcggcggccgcggagggaggctgagcgcgggccggctgtgctcgccaagggcttcaggcgccgcgctcgggcgcatttgtactttgccgcgggaagcaggcagcccggcctggcgctggcctagcgctggcgcctcctctggggcaccgcgggctcggtggattggccacccgagaaacaggcccactttttcccctcctctcttgtgcgggtctccgggacggacgctccaggcgcggcgccgagtggaggcgagggggctgcggagggggaaggggccacgcgggccacggggtttaacccctgactccccgcgacgccaagaatgcaggagggcagagttgagggagacctcaggtggaactttcaggtggggaaggctgagctgtcggggctgcgggtaccgggaaggctcagggtaaggcgctcggcggtgcgtgcccggaactcc

SEQ ID NO: 106702 - DNA, 167 bp, Homo sapiens; identical to SEQ ID NO: 73433
  misc_feature 1..167: note = chr11:74951632-74951799
  misc_feature 1..167: note = Hyper
  source 1..167: mol_type = genomic DNA

SEQ ID NO: 106703 - DNA, 1319 bp, Homo sapiens
  misc_feature 1..1319: note = chr11:74952123-74953442
  misc_feature 1..1319: note = Hyper
  source 1..1319: mol_type = genomic DNA
ccaggggctgctgctcgtggcggcggcgctgagccagcccgcggcaccctgccccttccagtgctactgcttcggcggccccaagctgctgctgcgctgcgcgtcgggagccgagctccgccagcctccgcgggacgtgccgcccgacgcgcgcaacctcaccatcgtaggcgccaacctgacggtgctgcgcgcggccgccttcgccggcggggacggggacggcgaccaggcggcgggcgtgcgcctgccgctcctgagcgcgctgcgcctcacgcacaaccacatcgaggtggtggaggacggcgccttcgacgggctgcccagcctggcggcgctcgacctcagccacaacccgctgcgcgccctgggcggcggcgccttccgcgggctgcccgcgctgcgctcgctgcagctcaaccacgcgctggtgcgcggcggccccgcgctgctggccgcgctggacgctgcgctggcaccgctggccgagcttcgcctgctgggcctagcgggcaacgcgctgagccgtctgccgccagccgccctgcgcctggcgcgcctggagcagctggacgtgcgcctcaacgcgctggccggcctggaccccgacgagctgcgcgcgctggagcgcgatggcggcctccccgggccgcgcctgctgctcgccgacaaccccctgcgctgcggctgtgccgcacgccccctgctggcctggctgcgcaacgccacggagcgcgtgcccgactcgcggcgcctgcgctgcgccgccccgcgggcgctgctagaccggccgctactggacctggacggggcgcggcttcgctgcgcggacagcggcgccgacgctcgcggagaggaggcggaggccgccggcccggagctggaagcctcctacgtgttcttcgggctggtgctggcactcatcggcctcatcttcctcatggtgctctacctaaaccgccgcggcatccagcgctggatgcgcaacctgcgcgaggcgtgccgggaccagatggagggctaccactaccgctacgagcaggacgccgacccgcgccgcgcgcccgcgcccgccgcgcccgcgggctcccgcgccacctccccgggctcggggctctgagcggcgcccccgggctcggggcttcccttgcctggcccgaagccgtggagatgagacacccgcgagccccgagctctgagaccttcccctgactcggaggcgctaagccgtaccctctcgttcccgcctccgagagctcccaccgtcaaagacccagagatagccggtccgaatccagaaaccccgcctgcccacccta

SEQ ID NO: 106704 - DNA, 35 bp, Homo sapiens; identical to SEQ ID NO: 43221
  misc_feature 1..35: note = chr11:75100584-75100619
  misc_feature 1..35: note = Hypo
  source 1..35: mol_type = genomic DNA

SEQ ID NO: 106705 - DNA, 33 bp, Homo sapiens; identical to SEQ ID NO: 73437
  misc_feature 1..33: note = chr11:75140949-75140982
  misc_feature 1..33: note = Hyper
  source 1..33: mol_type = genomic DNA

SEQ ID NO: 106706 - DNA, 660 bp, Homo sapiens; identical to SEQ ID NO: 73438
  misc_feature 1..660: note = chr11:75141202-75141862
  misc_feature 1..660: note = Hyper
  source 1..660: mol_type = genomic DNA

SEQ ID NO: 106707 - DNA, 30 bp, Homo sapiens; identical to SEQ ID NO: 73439
  misc_feature 1..30: note = chr11:75146658-75146688
  misc_feature 1..30: note = Hypo
  source 1..30: mol_type = genomic DNA

SEQ ID NO: 106708 - DNA, 56 bp, Homo sapiens; identical to SEQ ID NO: 43222
  misc_feature 1..56: note = chr11:75152480-75152536
  misc_feature 1..56: note = Hypo
  source 1..56: mol_type = genomic DNA

SEQ ID NO: 106709 - DNA, 30 bp, Homo sapiens; identical to SEQ ID NO: 73441
  misc_feature 1..30: note = chr11:75160673-75160703
  misc_feature 1..30: note = Hypo
  source 1..30: mol_type = genomic DNA

SEQ ID NO: 106710 - DNA, 30 bp, Homo sapiens; identical to SEQ ID NO: 73442
  misc_feature 1..30: note = chr11:75163174-75163204
  misc_feature 1..30: note = Hypo
  source 1..30: mol_type = genomic DNA

SEQ ID NO: 106711 - DNA, 49 bp, Homo sapiens; identical to SEQ ID NO: 73443
  misc_feature 1..49: note = chr11:75221046-75221095
  misc_feature 1..49: note = Hypo
  source 1..49: mol_type = genomic DNA

SEQ ID NO: 106712 - DNA, 30 bp, Homo sapiens; identical to SEQ ID NO: 73444
  misc_feature 1..30: note = chr11:75229378-75229408
  misc_feature 1..30: note = Hypo
  source 1..30: mol_type = genomic DNA

SEQ ID NO: 106713 - DNA, 381 bp, Homo sapiens
  misc_feature 1..381: note = chr11:75294375-75294756
  misc_feature 1..381: note = Hyper
  source 1..381: mol_type = genomic DNA
cactatccttcccaccggcccgatcccgcgtcccgaggtctcgcggggccaggctgcacgggcggcggagcccggagcccggggcggggccggagatgagcctgcaggcggggggctgtgcgagtgcgcggggacgggggctgctgtttccgagccgagagccctggtagcggggctctgtgggcggagacgccctcccgagcctgggcatcttcggagtgggactctcgggtcggagttccgccgccggcccatccagtttcagcgggtcgcctttgcctctgggccgggtggggagcctcccattccagagaccccccgactccctgcccctcgcggcgtaggggcgccctttctgcggcgccgcggggccgtcctctc

SEQ ID NO: 106714 - DNA, 1709 bp, Homo sapiens
  misc_feature 1..1709: note = chr11:75378401-75380110
  misc_feature 1..1709: note = Hyper
  source 1..1709: mol_type = genomic DNA
tggagggaggctgcacgctaggcctgcgctggggatcctgggccccgggcagcccgcggggagggtctgcgtggtgactcccccgcgctagcagcggccgcgtctcacctgtaggagctgctcactgcactcgccacctcctcgcggatttgccggttgagggcgtccgccgcggcgcgccccctgccagcctcggggccggtggcctggacctgggcctgggccgcgggcagcggcgtctgctcgtgccccaggccctcggcgcggcgcacaatccaggcaggcccggccttcctgcgcgtgtcgcgctcgtccgccccggacgcctttccggccgccaggccacccgctccgccgggggccgcctcctgctcccgggcctcagcggcggcctgcactggccagcgctcctggctctgcggccggcgcttgggcgccccgagaatgggcgccgacgcctgggaggccgcagagatctgcacgggcttggggatccacgggtggtccccgcggcgcggcagcggccaggcgcggaagtccttctggtactgggtctcgcgctcgaagggagcgtcggagggctggtattcgctgcgcggccggcagctgggctcgggccgctgcaccttccaggctcggtaatcctgccgcatcaccgagtccgcggggccggaggtggagccggagcccaggcccgggcccggcccgctccggccggggcccgccgccggctcgcgctcgccggtaggcccaggcgctggccccgttgcccgggcaactgcatccaactcgccctgggctggctgcgtctctatggcaaccgcgcgcgccgaggggggcgcgagcgccggctgcgcctgctgctgcggcggcggtggctgcggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgctgcagggaagcggccccaccctttt

SEQ ID NO: 106715 - DNA, 55 bp, Homo sapiens; identical to SEQ ID NO: 73449
  misc_feature 1..55: note = chr11:75428929-75428984
  misc_feature 1..55: note = Hypo
  source 1..55: mol_type = genomic DNA

SEQ ID NO: 106716 - DNA, 91 bp, Homo sapiens; identical to SEQ ID NO: 15601
  misc_feature 1..91: note = chr11:75459473-75459564
  misc_feature 1..91: note = Hypo
  source 1..91: mol_type = genomic DNA

SEQ ID NO: 106717 - DNA, 718 bp, Homo sapiens; identical to SEQ ID NO: 73451
  misc_feature 1..718: note = chr11:75863175-75863893
  misc_feature 1..718: note = Hyper
  source 1..718: mol_type = genomic DNA

SEQ ID NO: 106718 - DNA, 30 bp, Homo sapiens; identical to SEQ ID NO: 43224
  misc_feature 1..30: note = chr11:75879446-75879476
  misc_feature 1..30: note = Hypo
  source 1..30: mol_type = genomic DNA

SEQ ID NO: 106719 - DNA, 30 bp, Homo sapiens; identical to SEQ ID NO: 73453
  misc_feature 1..30: note = chr11:75921359-75921389
  misc_feature 1..30: note = Hyper
  source 1..30: mol_type = genomic DNA

SEQ ID NO: 106720 - DNA, 320 bp, Homo sapiens; identical to SEQ ID NO: 73454
  misc_feature 1..320: note = chr11:76032896-76033216
  misc_feature 1..320: note = Hyper
  source 1..320: mol_type = genomic DNA

SEQ ID NO: 106721 - DNA, 609 bp, Homo sapiens; identical to SEQ ID NO: 43225
  misc_feature 1..609: note = chr11:76371627-76372236
  misc_feature 1..609: note = Hypo
  source 1..609: mol_type = genomic DNA

SEQ ID NO: 106722 - DNA, 243 bp, Homo sapiens; identical to SEQ ID NO: 73458
  misc_feature 1..243: note = chr11:76382021-76382264
  misc_feature 1..243: note = Hyper
  source 1..243: mol_type = genomic DNA

SEQ ID NO: 106723 - DNA, 77 bp, Homo sapiens; identical to SEQ ID NO: 73459
  misc_feature 1..77: note = chr11:76510624-76510701
  misc_feature 1..77: note = Hyper
  source 1..77: mol_type = genomic DNA

SEQ ID NO: 106724 - DNA, 21 bp, Homo sapiens
  misc_feature 1..21: note = chr11:76571168-76571189
  misc_feature 1..21: note = Hypo
  source 1..21: mol_type = genomic DNA
cccagacgggggctgggagta

SEQ ID NO: 106725 - DNA, 282 bp, Homo sapiens; identical to SEQ ID NO: 73461
  misc_feature 1..282: note = chr11:76902405-76902687
  misc_feature 1..282: note = Hypo
  source 1..282: mol_type = genomic DNA

SEQ ID NO: 106726 - DNA, 18 bp, Homo sapiens
  misc_feature 1..18: note = chr11:77025115-77025133
  misc_feature 1..18: note = Hypo
  source 1..18: mol_type = genomic DNA
aaaaatatttaaggccgg

SEQ ID NO: 106727 - DNA, 154 bp, Homo sapiens; identical to SEQ ID NO: 73463
  misc_feature 1..154: note = chr11:77116020-77116174
  misc_feature 1..154: note = Hypo
  source 1..154: mol_type = genomic DNA

SEQ ID NO: 106728 - DNA, 40 bp, Homo sapiens; identical to SEQ ID NO: 73464
  misc_feature 1..40: note = chr11:77186167-77186207
  misc_feature 1..40: note = Hypo
  source 1..40: mol_type = genomic DNA

SEQ ID NO: 106729 - DNA, 41 bp, Homo sapiens; identical to SEQ ID NO: 73465
  misc_feature 1..41: note = chr11:77301363-77301404
  misc_feature 1..41: note = Hyper
  source 1..41: mol_type = genomic DNA

SEQ ID NO: 106730 - DNA, 94 bp, Homo sapiens; identical to SEQ ID NO: 73466
  misc_feature 1..94: note = chr11:77309684-77309778
  misc_feature 1..94: note = Hypo
  source 1..94: mol_type = genomic DNA

SEQ ID NO: 106731 - DNA, 101 bp, Homo sapiens; identical to SEQ ID NO: 73467
  misc_feature 1..101: note = chr11:77534272-77534373
  misc_feature 1..101: note = Hypo
  source 1..101: mol_type = genomic DNA

SEQ ID NO: 106732 - DNA, 30 bp, Homo sapiens; identical to SEQ ID NO: 73469
  misc_feature 1..30: note = chr11:78262164-78262194
  misc_feature 1..30: note = Hypo
  source 1..30: mol_type = genomic DNA

SEQ ID NO: 106733 - DNA, 30 bp, Homo sapiens; identical to SEQ ID NO: 73470
  misc_feature 1..30: note = chr11:78369244-78369274
  misc_feature 1..30: note = Hypo
  source 1..30: mol_type = genomic DNA

SEQ ID NO: 106734 - DNA, 30 bp, Homo sapiens; identical to SEQ ID NO: 73471
  misc_feature 1..30: note = chr11:78381201-78381231
  misc_feature 1..30: note = Hypo
  source 1..30: mol_type = genomic DNA

SEQ ID NO: 106735 - DNA, 162 bp, Homo sapiens; identical to SEQ ID NO: 73472
  misc_feature 1..162: note = chr11:78387174-78387336
  misc_feature 1..162: note = Hypo
  source 1..162: mol_type = genomic DNA

SEQ ID NO: 106736 - DNA, 427 bp, Homo sapiens; identical to SEQ ID NO: 33973
  misc_feature 1..427: note = chr11:78672891-78673318
  misc_feature 1..427: note = Hyper
  source 1..427: mol_type = genomic DNA

SEQ ID NO: 106737 - DNA, 30 bp, Homo sapiens; identical to SEQ ID NO: 73475
  misc_feature 1..30: note = chr11:78775970-78776000
  misc_feature 1..30: note = Hypo
  source 1..30: mol_type = genomic DNA

SEQ ID NO: 106738 - DNA, 135 bp, Homo sapiens; identical to SEQ ID NO: 73478
  misc_feature 1..135: note = chr11:79148413-79148548
  misc_feature 1..135: note = Hyper
  source 1..135: mol_type = genomic DNA

SEQ ID NO: 106739 - DNA, 204 bp, Homo sapiens; identical to SEQ ID NO: 73479
  misc_feature 1..204: note = chr11:79148811-79149015
  misc_feature 1..204: note = Hyper
  source 1..204: mol_type = genomic DNA

SEQ ID NO: 106740 - DNA, 1097 bp, Homo sapiens
  misc_feature 1..1097: note = chr11:79149239-79150336
  misc_feature 1..1097: note = Hyper
  source 1..1097: mol_type = genomic DNA
cttcagcgttccccacggctgtgtcagggctggggtggcttatccccctacagacgaaaatcaagatttaaaagcatactcttactgtggtttctctatcaaagcccatcaacgtgatacacaggctgcggcgctggagggaagcggcgaaacggggagaataaacgcaacagaagcaaactgctgtctgcagaggcgagaggcgaaggaacggaagccatacccgaccccagccccatcccgtccccatcagcgccgggctagcgcaggaaaccaggaataggtgtaggtaagggtggcagcccggcagagccagcgttctactccctctaacccctcgccagcgtgggcctggatggctgggctgcctgggcatctccaagggggaccaggcaccgcgggcaggtttctaaacacgtgaagggcacagggcttgaaagacaaggaggggcgcccaggaagggcggaaaagaggggctttggggctccccaggacaccaagtcagtttctgaaaacggcgttccctggaaggccttccaacacctccgagggaagacttggagctctgaagacccaatgaaacctcagttctgactgactcctcctctgcgatcaattccggatgcccccacttagtccctgcctcggtaaccggttctttggggacagcagcatcagcacccgacgcccatcgcacaagtgggcgccgtggtgcgaggcgtatcctagctacccaggccggggtgggggcgccccggtacttacactccccaagcaggcaaactttcaggcttgtctttcgagaaccgggagctcgcatcacagttccgggtaatcaccgaggcagcttatgtaattgcccgcgatgccgctcagcagatctctctccttactcggcctcagagctcagtacatgggcaccctcttccccccaccccccaccccggcgattggaatcccgagcttgccccaccaccgccttctacaaagcagcggggtgatctcgtgtgctacaaacaccaagccagtatgcaggttcaggcaaaactctggctgcctccctgcgcccctttcactgcgtcgatggtttacagat

SEQ ID NO: 106741 - DNA, 1849 bp, Homo sapiens
  misc_feature 1..1849: note = chr11:79150674-79152523
  misc_feature 1..1849: note = Hyper
  source 1..1849: mol_type = genomic DNA
tggttgtgtattcctcggttgcgtgtgtgtgtccacacacacacacacacacacacacacacgccgccccactaccttccagtctgctcctccaatgtaacgaccgcatttaaaaatggcaattaaaatgactgaggagctcggtgatcacatttcaacccagagcacatttcccgaagctgggggtgagagtagtcatacagtcacactcacacccgggagccctccaagcgtccatctggcggctgcagcctcagttggctcctagacgaacatcaataccgcggccgggcgcccggtgaggagaggcgggcgccccgcgggttgcagagggcgaggagctggggtcgcatctccaggatctgagctccaaccaccgcccgtgcggggctgctgcagccggcacttgccccgcagggcaggctgcagccgctgaagcccggcgccgcctcgcgggctcctccagcgcccgacgggggcctggggcgagctagtctgcagaggggctgcaggcgaccgggccggggcggggaacgggatccgggagaggcagacgaacctggggcgcgccgcctccctcccacccgcttcccacctccctgccctcccccaacccttgctcccaggctccagtccgcggcgggctccgggggctgcggcggctccaggctccagaacagcttgcctcttcggccacccgcgccctagcctccctcctcctgggccaggggagcaagcaaacatctcccggagccctcggcagccgcgtgagctacccgaaccctgcccgggccagcagtgcagagggcgatggagctggcgaggcgtcgccgcggtccccaaggcgcttttccgtagagcggatcacgccgccttaccgtggctgcaggctgctaccgccggggaagcggcgaggacggcggcagggaggcaaggcgccgcgccggtggctcctctctctctcggcggcgcggctcctctgctccgcgagccgtagcggggcgcccaggaaggagcaggtccgggctctgcgctcagctccagcgagaccaacaatagctcccgcggggagcggagccccagcgagcctccagccgcgcgcgcacgaccggctcccgctcccggccgctcccggccggcgtccctgccagcactgctgccccacatgaaacagctgcaatcccgaggcttctggggggttggggcgggtgtgtgcgcgcgcgtgtgtgagtgtgtgtgtgtgtgtgtgtgtttaatagcttcccttctcttcttcccctccctgcctgctcgcctgcctgcctccgtcccccaccctcgctctcttacacacagaaagagagggcgagcgagagagagacacacacacacacgcacacgcacacgcaggttacatgaatgggaggcggtagccaatcctacgaggccggcgagccgcgcggcgcactggcgctgggagcagggccgcactccggcgcgggggggcgccacgcaggtgatgggcgcctctccgggggccacgcgcggccgctccctcaccccagtctcggttcctctgtctccttcccccttcctctccgccgccttctccatcttctctccttttacctcctttgctttctcgagttctccgagctctctcagttcggtatctttctggtctctttcttcttttaccctccttgcttgctttctcttcccctttctgaaactttctcttttcctttctggactttcttgtacttcctctcctcttgccttttgttctttcctcctcctttggctttctctccaggctccccgtagcacggtctcgtcccctctccctcctcttcgcctttccctgggt

SEQ ID NO: 106742 - DNA, 151 bp, Homo sapiens; identical to SEQ ID NO: 73484
  misc_feature 1..151: note = chr11:79152734-79152885
  misc_feature 1..151: note = Hyper
  source 1..151: mol_type = genomic DNA

SEQ ID NO: 106743 - DNA, 24 bp, Homo sapiens
  misc_feature 1..24: note = chr11:81697887-81697911
  misc_feature 1..24: note = Hypo
  source 1..24: mol_type = genomic DNA
agaattcaagcatggcgtgggtgg

SEQ ID NO: 106744 - DNA, 44 bp, Homo sapiens; identical to SEQ ID NO: 73496
  misc_feature 1..44: note = chr11:82214275-82214319
  misc_feature 1..44: note = Hypo
  source 1..44: mol_type = genomic DNA

SEQ ID NO: 106745 - DNA, 1813 bp, Homo sapiens
  misc_feature 1..1813: note = chr11:82443379-82445192
  misc_feature 1..1813: note = Hyper
  source 1..1813: mol_type = genomic DNA
ctggtttcatctccacgtgcattttcccatcgttcttcagatttaggagaaacccacggaggcgcggcgctctccacagccgtctctaatgaagggaagcgtgcctcgaagtcagtcccggtgcgccccctcctcccccggcgccccttcccaaaccccgtcggatctccaaaggctggaataggcggtgcggctgtagcccgcgctgtaatcgtaggacacctgatggggcggcggcggcgggggcagggcgcagtctggaaagaagggggcgaaagaggccaaatggccccgcccgtcctccccgccgggagaatccgcagcggcggggtacagggggctcaagggctcgttcaaggtcaagccgccgcggggggcagtcagggggctctttttggtcggggagcagcccgggacgctccagggctcggggtacagtaggtttcccaccactgccggcggcggctcaaagaggccgggctccagctccgggggtccccgcagtacggaggctccggcggggaacacgtcgagaggctcggcggcaagcaagactgccgcctccgtgccggcgccgtagtcgggccccagcagctcaaagaactccacggcctccgcgcccttctccaggtcgcccaagctcacgtccggccccgacgggccacacccgccgccgcctgcccgggacggctccgtgaagaaggacggaggcagattgcgtgcccgcagcgggaccttcctggcccctgggatcgccgtggcccccgcggggcctgccacgtcccctcccgcgcccccagtgcccgcacctcctagcccggccgccggcgcagccacctcaccccccgccggctcggcacccccggggacgtggcgcagcgagtcgaagagcgcggccagacttcggctttgcaagctggcggccgcggcggcctgcgacgcctcccgccggggggcagccttgccgtgggccggggccgcgactgtcggggcgctaggggcggccagcggccgtttggctggcgtgtcggcggcgctcggggagggcgggccggggggcgcggcgcccatgaggccgctgcagcgcttgatctgcttctgcaggtacttgcggtggttcaccttccgcttcgacttgcccggcttgtccagcgccagcttgatgttgctggacgccgagtcaatgaagctgagtagatcgcgggtggcctcgcgcacgtcccctccttcggctcccgacagcagcgcacccgccggagccccggtctcatcgtcctcgaaacagcagcccttgtccagggctccgaaggcgccccctagcccgtccggggagcccccgaagccgaagggcacgaaagggtgcgtgctgaggagcgccgcctgcaccgccatcgccgcggctcccgggctgtccgcagcgctgcccgtgcgcccccgccagctcctgcccgccgcccagacccagctcccgccccggcgcggcgcgcgcggcgcagcctactagttccgggcctggctcgctgcgctgcctcccgggggagctcattaggtcttgtaagcaaggggcggagggagggagcgcgcggcgaccgtcccggtggtagaggggaggggcttacttagcctggcttggaggagtggggggtcgctttagttttctgagctttctgaagctcaacgccttaactccttcgtttccctttgccccgtggtgtttctcttgactcctctaaccgcaaggggtgaggaagagatggctggtctcaaactccagttcaggcccatgaggccgctgcagcgcttgataggcttc

SEQ ID NO: 106746 - DNA, 84 bp, Homo sapiens; identical to SEQ ID NO: 73505
  misc_feature 1..84: note = chr11:82851824-82851908
  misc_feature 1..84: note = Hypo
  source 1..84: mol_type = genomic DNA

SEQ ID NO: 106747 - DNA, 30 bp, Homo sapiens; identical to SEQ ID NO: 43229
  misc_feature 1..30: note = chr11:83561479-83561509
  misc_feature 1..30: note = Hypo
  source 1..30: mol_type = genomic DNA

SEQ ID NO: 106748 - DNA, 269 bp, Homo sapiens
  misc_feature 1..269: note = chr11:84431431-84431700
  misc_feature 1..269: note = Hyper
  source 1..269: mol_type = genomic DNA
aggggacattccttccgggctgcggcagtggcagctcgctgggggacccaaacgctgtgctcgccgggcacatggagcgacagcctagaccgagctgccgcttcgatcactgccccctgcacccgccgtggccatcccggagccccggtggaagcaacgccgcgggcaagtaccgagcctctcggggtctcccttccctggggaacgaggcgtgtggggggagggacagaaccaagaaagaatttttccccctacggtgaatttggggg

SEQ ID NO: 106749 - DNA, 316 bp, Homo sapiens; identical to SEQ ID NO: 33990
  misc_feature 1..316: note = chr11:84431954-84432270
  misc_feature 1..316: note = Hyper
  source 1..316: mol_type = genomic DNA

SEQ ID NO: 106750 - DNA, 45 bp, Homo sapiens; identical to SEQ ID NO: 73514
  misc_feature 1..45: note = chr11:84578824-84578869
  misc_feature 1..45: note = Hypo
  source 1..45: mol_type = genomic DNA

SEQ ID NO: 106751 - DNA, 198 bp, Homo sapiens; identical to SEQ ID NO: 73517
  misc_feature 1..198: note = chr11:85071077-85071275
  misc_feature 1..198: note = Hypo
  source 1..198: mol_type = genomic DNA

SEQ ID NO: 106752 - DNA, 150 bp, Homo sapiens; identical to SEQ ID NO: 73518
  misc_feature 1..150: note = chr11:85359853-85360003
  misc_feature 1..150: note = Hypo
  source 1..150: mol_type = genomic DNA

SEQ ID NO: 106753 - DNA, 40 bp, Homo sapiens; identical to SEQ ID NO: 73519
  misc_feature 1..40: note = chr11:85379748-85379788
  misc_feature 1..40: note = Hypo
  source 1..40: mol_type = genomic DNA

SEQ ID NO: 106754 - DNA, 30 bp, Homo sapiens; identical to SEQ ID NO: 73521
  misc_feature 1..30: note = chr11:85521596-85521626
  misc_feature 1..30: note = Hyper
  source 1..30: mol_type = genomic DNA

SEQ ID NO: 106755 - DNA, 213 bp, Homo sapiens; identical to SEQ ID NO: 73522
  misc_feature 1..213: note = chr11:85564766-85564979
  misc_feature 1..213: note = Hypo
  source 1..213: mol_type = genomic DNA

SEQ ID NO: 106756 - DNA, 39 bp, Homo sapiens; identical to SEQ ID NO: 73525
  misc_feature 1..39: note = chr11:85906236-85906275
  misc_feature 1..39: note = Hypo
  source 1..39: mol_type = genomic DNA

SEQ ID NO: 106757 - DNA, 250 bp, Homo sapiens
  misc_feature 1..250: note = chr11:86085741-86085991
  misc_feature 1..250: note = Hyper
  source 1..250: mol_type = genomic DNA
ctaagggggtgaggtcgaatcccagccttgacgccttagcaaccgagcgagcctttctcgcgtcccagcaacgcgcccttccctctgccgggcctattctccctggtgcccctcccttcctcgaggctgcagctcacccctcattgggtctctcgttggtcaggagggcgcgggtctgcacactctcactcggtgccggacatcagttcctgcggctcttgctgtgggagctgcccgagagccagagcag

SEQ ID NO: 106758 - DNA, 259 bp, Homo sapiens; identical to SEQ ID NO: 73532
  misc_feature 1..259: note = chr11:86382846-86383105
  misc_feature 1..259: note = Hyper
  source 1..259: mol_type = genomic DNA

SEQ ID NO: 106759 - DNA, 69 bp, Homo sapiens; identical to SEQ ID NO: 73533
  misc_feature 1..69: note = chr11:86385660-86385729
  misc_feature 1..69: note = Hypo
  source 1..69: mol_type = genomic DNA

SEQ ID NO: 106760 - DNA, 33 bp, Homo sapiens; identical to SEQ ID NO: 73536
  misc_feature 1..33: note = chr11:86641548-86641581
  misc_feature 1..33: note = Hypo
  source 1..33: mol_type = genomic DNA

SEQ ID NO: 106761 - DNA, 217 bp, Homo sapiens; identical to SEQ ID NO: 73541
  misc_feature 1..217: note = chr11:87908267-87908484
  misc_feature 1..217: note = Hyper
  source 1..217: mol_type = genomic DNA

SEQ ID NO: 106762 - DNA, 965 bp, Homo sapiens
  misc_feature 1..965: note = chr11:88241705-88242670
  misc_feature 1..965: note = Hyper
  source 1..965: mol_type = genomic DNA
gaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtaggacgagcagagcggggcgccgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcagcgacggcacatcgtcgtccgtgcggctggccgagcccgcgcggtggctcagcgtgctgatgggcgacggtgagcgcggccgcgcgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccccggctgctcttctcattctgggcccacgtgacggattttccattgg

SEQ ID NO: 106763 - DNA, 30 bp, Homo sapiens; identical to SEQ ID NO: 73546
  misc_feature 1..30: note = chr11:88796652-88796682
  misc_feature 1..30: note = Hyper
  source 1..30: mol_type = genomic DNA

SEQ ID NO: 106764 - DNA, 481 bp, Homo sapiens
  misc_feature 1..481: note = chr11:88798746-88799227
  misc_feature 1..481: note = Hyper
  source 1..481: mol_type = genomic DNA
aaacttgcaggacctcgtagcgttcctggctctaccagccctccacctgcccaccacttgccctcctgggtctttttagccccagctcccgccccttgcttgattgctctccatccctgcactgggggaggggctccagcggtatcctatatccgtggtaactatagccaagagaaagaaaaaggcgctgtgcttaccaggtgcgcgccctgagccttgcgcccccaggcagccgctcctcgagggcttcctgcgctctcgtagcggccttggctgcagctggagcgctagtgtcggcgatggaggcagcggtgacagcaggcagaacggctgcggggcccgcggcggtggcgctcgctctctcgcgccagcgccgggagcacgtgccgcgctcgggcagacgcagctggaagcgcagcgcagggctggcttatactcccgcagcgcgcggcgggggttggcagaacggccagggcataga

SEQ ID NO: 106765 - DNA, 475 bp, Homo sapiens
  misc_feature 1..475: note = chr11:89224313-89224788
  misc_feature 1..475: note = Hyper
  source 1..475: mol_type = genomic DNA
gcaggacagagagaacgcaaggagagcctagcccgccatcctaccaggcagaggtgtttaaccccttcgttggcgagccagctcctccaggacacagccatgccgccggccccgccgcgctgcgctctgtgcccgccggaccgagaaggagcgggcggcggccggggcagcggttacagttgtgcggcctgccgggccgctgagcgaggaccgagggtcaaagactgagtggaagcccgaaggcccggcgccgagccagcccgggcggggtctgctacccagagccgggttttccgggcgccctgactcccacccgcaccgggtcagctctgcccactcagctgcccagacgcccagcgctctgagcgcgcggcccaggctgcaccagtctgctccgccgcgccggcccctttgtctaggggcgagcctgttgttgtggctgctgctgttcaggatgtcccgggtgggaacttgg

SEQ ID NO: 106766 - DNA, 95 bp, Homo sapiens
  misc_feature 1..95: note = chr11:89785685-89785780
  misc_feature 1..95: note = Hyper
  source 1..95: mol_type = genomic DNA
agtttttggagccctcgggcttctgcgccctctcgtggagcggaggcagctcaagctggtacttttcccccaaccgctcccggcaggggcgctcc

SEQ ID NO: 106767 - DNA, 21 bp, Homo sapiens
  misc_feature 1..21: note = chr11:89899713-89899734
  misc_feature 1..21: note = Hypo
  source 1..21: mol_type = genomic DNA
tacagattggctgggcgcggt

SEQ ID NO: 106768 - DNA, 30 bp, Homo sapiens; identical to SEQ ID NO: 73554
  misc_feature 1..30: note = chr11:89957319-89957349
  misc_feature 1..30: note = Hypo
  source 1..30: mol_type = genomic DNA

SEQ ID NO: 106769 - DNA, 30 bp, Homo sapiens; identical to SEQ ID NO: 73556
  misc_feature 1..30: note = chr11:90705557-90705587
  misc_feature 1..30: note = Hypo
  source 1..30: mol_type = genomic DNA

SEQ ID NO: 106770 - DNA, 2314 bp, Homo sapiens
  misc_feature 1..2314: note = chr11:91957315-91959629
  misc_feature 1..2314: note = Hyper
  source 1..2314: mol_type = genomic DNA
gaagagattggaccacgttagctgcttagtctagttccctcctccacaaggcaatcggatgaccccaggatctcaatgtttaggaaagtcgtaggagccctcactgggaggcacatttttagtccagaggcacgacatttgatggtttaatcttcacactacaaactagccttgggacgttatataaaccatgttaacctcgatgtgcctcagtttcctctttgtcccaggagagtaacgcgttctctgtcttcacagggatgtggtgcgggtgagactcaatgcactgtgcgaaagctctcccaagccagcaagcaccacgctctccccgcggcaggaaagtacgttggtgtcatcctagagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggaggagactgcgagagacaagcgcgagggggagactggagaggggcttggccgtgcgtcggcgtcggctgtgatggggagcccggagcagccaggcggcgagcagtagcggcggcggctgcagctcggagcagacaggagagccggcgctcctccccgcaggctgcgctgtgaactggcctgcggattgggatctcgcgcctcccgtccctctcctcccgctgctgttctcttcatctcggctcccctcctccgcttgcgaacccccggcggcggcggcggcggcgtcccgagcgcagagcgcttctgctcgcggcctcagtcccggctagcgcgcggtgggcgctgcggcggcagcagccgggggaccggctcgcccggagcaagagcgccgagcaccgggtgaagaagaccacgggggaggcgcctcgtagagccgtggatcgccagcggaggcaagggtgcgtggggatttgtagcgtgatgatttggctgcctggtgcaccgactggagcgcgcctgccggagcacagcctcagctgctgggtgcaaatgggctgcgaggtgggctggggaggcgagagccgacgaagcgcgtgggggaaacttttcaccttgtaaagttccaacctccgcgcagccccgagccgccgttgctaccgctgcaaacaggagaagagggtggcttggccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcagccggtgcctctcgggcgcagtgggggatgttcagatgccgatggatgatgcacttaggggaccccgaggtgcaagttgggtcatcgctaggcgaggcgcggcgcagagagggagcccagcctccactttcgctaggaaagggaaagggttaccagtctgcgggtccgttccccacgcctgactcgggcttgcggggcttgtggtcagggtgagatgtagtgaacggcggcggcggctcttcgactggggacgacatcctttacggagtggttggggacagagactgtccctgctatcttgacaaggagagggaaccggaatgctttgcgagagtgcatgatttttggcgggcgtgtgggaaggctgcttgtctttgaaaagaaagcagcgcgggtctgaccatccccaggagtgcggaggagctgtctccggattgggggcgagaacgccaggggcaccagctccgagctcaggccccactcccgggcggttcgggacgaatcccctctacaggccagtgtgtgtgcagggcaagtgtagggggctgaggggcgctggcggggaggcagtagaggtggcctggaccatcttggcgcggcgcgcggtgagcgcgaggattccgccagtgggagtcgctgagctaaagtgcatctggccccccggcttgcatgatggcgagcccggatatttttagctgtgctgtgatctgaattccctcctctcctctctcgttgacttttgtcacatgtgctttccgagatggtttaacattgaacatgattgggctttgcggaaagcaacttttattcactttccaccgttctcctcttgtgggcggggggtggcgggggcgtgcttggggcaaggatgcaggggtggccggagtttggctgcg

SEQ ID NO: 106771 - DNA, 128 bp, Homo sapiens; identical to SEQ ID NO: 73563
  misc_feature 1..128: note = chr11:91959986-91960114
  misc_feature 1..128: note = Hyper
  source 1..128: mol_type = genomic DNA

SEQ ID NO: 106772 - DNA, 101 bp, Homo sapiens; identical to SEQ ID NO: 34006
  misc_feature 1..101: note = chr11:91960369-91960470
  misc_feature 1..101: note = Hyper
  source 1..101: mol_type = genomic DNA

SEQ ID NO: 106773 - DNA, 73 bp, Homo sapiens; identical to SEQ ID NO: 34007
  misc_feature 1..73: note = chr11:92675236-92675309
  misc_feature 1..73: note = Hyper
  source 1..73: mol_type = genomic DNA

SEQ ID NO: 106774 - DNA, 85 bp, Homo sapiens; identical to SEQ ID NO: 73567
  misc_feature 1..85: note = chr11:92929479-92929564
  misc_feature 1..85: note = Hypo
  source 1..85: mol_type = genomic DNA

SEQ ID NO: 106775 - DNA, 30 bp, Homo sapiens; identical to SEQ ID NO: 73568
  misc_feature 1..30: note = chr11:92931349-92931379
  misc_feature 1..30: note = Hyper
  source 1..30: mol_type = genomic DNA

SEQ ID NO: 106776 - DNA, 610 bp, Homo sapiens; identical to SEQ ID NO: 73569
  misc_feature 1..610: note = chr11:93063447-93064057
  misc_feature 1..610: note = Hyper
  source 1..610: mol_type = genomic DNA

SEQ ID NO: 106777 - DNA, 88 bp, Homo sapiens; identical to SEQ ID NO: 73570
  misc_feature 1..88: note = chr11:93476681-93476769
  misc_feature 1..88: note = Hypo
  source 1..88: mol_type = genomic DNA

SEQ ID NO: 106778 - DNA, 21 bp, Homo sapiens
  misc_feature 1..21: note = chr11:94064788-94064809
  misc_feature 1..21: note = Hypo
  source 1..21: mol_type = genomic DNA
ccaccgcgcctggcccaagaa

SEQ ID NO: 106779 - DNA, 812 bp, Homo sapiens
  misc_feature 1..812: note = chr11:94134049-94134861
  misc_feature 1..812: note = Hyper
  source 1..812: mol_type = genomic DNA
gcgtgatcattatgtcggcaactgccaggttgacgatgaagaggctggtggccgagtgcattcgctggttcttgaagatgacatgacagaccaggacgttgccaaagagtgagaagacaatgatgaaggagtaagccacaatgagcagggctttcaccgtggggttctgggactcagcgccgtagcgcctcctgcccacaaagttctgccagtcggagaaggtgtagttgttccaagagaagaagtgcgaggcattgggcacggccagggccgcctccgcgctctgctcgtcggcccggccctcgtggggctcggtggctcgcaccaaggggaggagacagagcagcaagaggtgagggaccattttgcaggagccacccctcccctgggagcctgcgggccgggcgtcccctcccgctgggatcggagcgcgcagccggggtgcggggcgcacagcatacaaggccgtcccgaggagccagggagcccggacgcgcggagcaccgcgccgcccgccaccagcccgcggtcggcacgccagctccgggtttgttggagcacttttatatctctgctcccaccaggctgctagggagcgcctctgcctattgggcagcgcggcgtctctcgcggcgacggtgacgcgctctggctctgacaagcctggctccccccaccctaccgggtggcgccgttgctgaccccacgcccagccgttcccactcccgcctgaaactcctccgacagggcttcgcttcgggggctcagtccccagcgcgtacacactcgcgtggtgtcggcttagcctcttg

SEQ ID NO: 106780 - DNA, 169 bp, Homo sapiens; identical to SEQ ID NO: 73576
  misc_feature 1..169: note = chr11:94156922-94157091
  misc_feature 1..169: note = Hypo
  source 1..169: mol_type = genomic DNA

SEQ ID NO: 106781 - DNA, 30 bp, Homo sapiens; identical to SEQ ID NO: 73577
  misc_feature 1..30: note = chr11:94275224-94275254
  misc_feature 1..30: note = Hypo
  source 1..30: mol_type = genomic DNA

SEQ ID NO: 106782 - DNA, 26 bp, Homo sapiens
  misc_feature 1..26: note = chr11:94275794-94275820
  misc_feature 1..26: note = Hypo
  source 1..26: mol_type = genomic DNA
ttttttttttttttccgagacggagt

SEQ ID NO: 106783 - DNA, 26 bp, Homo sapiens
  misc_feature 1..26: note = chr11:94276060-94276086
  misc_feature 1..26: note = Hypo
  source 1..26: mol_type = genomic DNA
gggagtataggcgtgagccaccgcgc

SEQ ID NO: 106784 - DNA, 313 bp, Homo sapiens
  misc_feature 1..313: note = chr11:94277810-94278123
  misc_feature 1..313: note = Hyper
  source 1..313: mol_type = genomic DNA
gctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggc

SEQ ID NO: 106785 - DNA, 487 bp, Homo sapiens
  misc_feature 1..487: note = chr11:94473423-94473910
  misc_feature 1..487: note = Hyper
  source 1..487: mol_type = genomic DNA
agcccacagaacaaacgatttcccaagcatcagaggagggcagacataacataacagagcagggaatcgggttagaacgggttatgctctgattttttggaaaatgggcaaacggggcggggactagggaggattccgccagccgggagttgggaggccgcgcgcgcctctgcggagcgtgacggccacggtcgcctagcaacgagcggggatgcgcggggcgcctgggtgggcgaggggtgctcgccgccgccgccgcgcgccctcgggcccccgggaccgcgggaaaacttcgcggctcctcggcgctggggcgtcggcgccaggcccggcagacagagcaatgcgccccgcgggctgagggcagaggatgcggccgcggcccagcgcccggccgggggagccgcggggtggcacgcggggaaagttggcgcgcgcctgaccgcgcctggaagccgcgcggtgccagggccgagttgtcccccaa

SEQ ID NO: 106786 - DNA, 58 bp, Homo sapiens; identical to SEQ ID NO: 34015
  misc_feature 1..58: note = chr11:94474489-94474547
  misc_feature 1..58: note = Hyper
  source 1..58: mol_type = genomic DNA

SEQ ID NO: 106787 - DNA, 653 bp, Homo sapiens
  misc_feature 1..653: note = chr11:94501445-94502098
  misc_feature 1..653: note = Hyper
  source 1..653: mol_type = genomic DNA
gtagggttctagtgacgagcccgggcgaccctccccggcccgcgcgcggggagcggggagcgcggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaaggtaaccagcccccactcgaggtgccgggagggcgtctccgagtctcccacgcgaagaacccagtcgccccgggctccccgggcccctgctgctcacggaagggggcagcttctgggggcccggggctgagatcccagattgttgtttttaagcgggttcccttgccccgctccaggtccagttgcctgcgggccgggcctcagcgtcttgccgccccgcgacccacgttgactgaagttgtggccccggggtttgggccccggggtgctgcgcgcccgacgcggggctggcctttcctgaggggcgcagccatatggccagacactccgaggcgcgcccgcgcccgcgcgcgggtctcgcggcgagggaggg

SEQ ID NO: 106788 - DNA, 400 bp, Homo sapiens
  misc_feature 1..400: note = chr11:94502372-94502772
  misc_feature 1..400: note = Hyper
  source 1..400: mol_type = genomic DNA
acaataatctgctttcgcggggagaaaatttaaactttccaaatggaactgttttttcttggaatgtgacatttgtggcaggagggagagtggtacgttggccgatgacagccgagcggaacggtggcctagtgccgggacagggaccgagcgtgccccataggcggccgggctggaggacgcggcggcagagcagacgagccctggcgcgcacctctagggcctccgctacctggactgcgctcgcggcgacgtgtccaagtttcccccctcagagccccaggccgagaatcccgggtatctgcgcaaagctcccgcgcctcgcccaccctactcttcctatctttactgatgactaggaagactttccttttccatttttgttcgaagatttttgcct

SEQ ID NO: 106789 - DNA, 247 bp, Homo sapiens; identical to SEQ ID NO: 73588
  misc_feature 1..247: note = chr11:94884155-94884402
  misc_feature 1..247: note = Hyper
  source 1..247: mol_type = genomic DNA

SEQ ID NO: 106790 - DNA, 18 bp, Homo sapiens
  misc_feature 1..18: note = chr11:94885458-94885476
  misc_feature 1..18: note = Hypo
  source 1..18: mol_type = genomic DNA
agtaggataaaaggccgg

SEQ ID NO: 106791 - DNA, 26 bp, Homo sapiens
  misc_feature 1..26: note = chr11:94892054-94892080
  misc_feature 1..26: note = Hypo
  source 1..26: mol_type = genomic DNA
tcctccctgggcgacaaagcaagact

SEQ ID NO: 106792 - DNA, 24 bp, Homo sapiens
  misc_feature 1..24: note = chr11:94895717-94895741
  misc_feature 1..24: note = Hypo
  source 1..24: mol_type = genomic DNA
gcgagactccgtctcaaaaaaaaa

SEQ ID NO: 106793 - DNA, 30 bp, Homo sapiens; identical to SEQ ID NO: 43237
  misc_feature 1..30: note = chr11:94924721-94924751
  misc_feature 1..30: note = Hypo
  source 1..30: mol_type = genomic DNA

SEQ ID NO: 106794 - DNA, 30 bp, Homo sapiens; identical to SEQ ID NO: 73593
  misc_feature 1..30: note = chr11:94965054-94965084
  misc_feature 1..30: note = Hyper
  source 1..30: mol_type = genomic DNA

SEQ ID NO: 106795 - DNA, 146 bp, Homo sapiens; identical to SEQ ID NO: 73594
  misc_feature 1..146: note = chr11:95007432-95007578
  misc_feature 1..146: note = Hypo
  source 1..146: mol_type = genomic DNA

SEQ ID NO: 106796 - DNA, 30 bp, Homo sapiens; identical to SEQ ID NO: 73595
  misc_feature 1..30: note = chr11:95462538-95462568
  misc_feature 1..30: note = Hypo
  source 1..30: mol_type = genomic DNA

SEQ ID NO: 106797 - DNA, 94 bp, Homo sapiens; identical to SEQ ID NO: 73596
  misc_feature 1..94: note = chr11:95488635-95488729
  misc_feature 1..94: note = Hypo
  source 1..94: mol_type = genomic DNA

SEQ ID NO: 106798 - DNA, 43 bp, Homo sapiens; identical to SEQ ID NO: 73597
  misc_feature 1..43: note = chr11:95658708-95658751
  misc_feature 1..43: note = Hypo
  source 1..43: mol_type = genomic DNA

SEQ ID NO: 106799 - DNA, 172 bp, Homo sapiens; identical to SEQ ID NO: 73602
  misc_feature 1..172: note = chr11:98437969-98438141
  misc_feature 1..172: note = Hypo
  source 1..172: mol_type = genomic DNA

SEQ ID NO: 106800 - DNA, 120 bp, Homo sapiens; identical to SEQ ID NO: 73603
  misc_feature 1..120: note = chr11:98480681-98480801
  misc_feature 1..120: note = Hypo
  source 1..120: mol_type = genomic DNA

SEQ ID NO: 106801 - DNA, 30 bp, Homo sapiens; identical to SEQ ID NO: 73605
  misc_feature 1..30: note = chr11:98627345-98627375
  misc_feature 1..30: note = Hypo
  source 1..30: mol_type = genomic DNA

SEQ ID NO: 106802 - DNA, 818 bp, Homo sapiens; identical to SEQ ID NO: 73607
  misc_feature 1..818: note = chr11:98891098-98891916
  misc_feature 1..818: note = Hyper
  source 1..818: mol_type = genomic DNA

SEQ ID NO: 106803 - DNA, 1217 bp, Homo sapiens
  misc_feature 1..1217: note = chr11:100997659-100998876
  misc_feature 1..1217: note = Hyper
  source 1..1217: mol_type = genomic DNA
gctttcggttctggccggccacctctcaagtcccacccctcccgggggaacggtgccttaactcctctccaagacaagcactcctggtaaacgtccttcttctaagaaagaagcatttcataaagcccccaactcgccgcgcactttctgccccactgggctacagcggacctagtgtgacgctgcacgttttaaatcggggttggttctgcttcggaatctggaagattcggaaagttaaaaaacaaacaaaaaaacagctttcagggaggcacgccccaaaaatagtatattctgcgcccaccttcgtgtccccaagagtgaggagaggagggaagaagaagggaggcaactgcccctgtgctgtgtcccgctgcccaccctctccggccgccccggggagcgcagcggtgcgctggggctggggctgagggttggcggccgccgccgccaacggaaccgctactcccggacgcgctgggcgtgccccgtcccgggccctcacctcaggtagttgagatagggcgggtagacctgcggcaggccctccttgagcacggcggcctggtagccgagctgcgggagcccgttgaggccgagtgcagggtagagcgcgggggccgccccggcggcggcggcagaggcggaggtggagggcaggccgtcccgcgggagcaggcagccgctcgcgcccggcgccttgcagggcggcggcgcgaacgggccctgctggggcggcgcgccctccgctttgtacaggatgcactccagggtcgaccccgaggaggacgcagacgagactgaggcactggcgggtgcggccgtcaccgccgcttccccgggtctggatggggtcgctcgcggcggcagcgggggcggtggccccaacgggaaatccgggaaggctgcggggttggcaccggccacaaggtaggaacgcggggagcgcgcggaggcctccgcgccttcctcctcctcctttatctttagagcgggcggctggaagtcgctatagagagggtacgcgtcgtccttgggctcggcgtcgggcgggtacgcgcagtcggggaagtcgcctacagcgaccggggtggacgaggcacagggtgaactccgcggcggggcaaaggcgctggcagccccggccccgccgtcgtaactttcgtcttccagcagctgccgagtgcgggctgccaataaggcgtgattgagaggca

SEQ ID NO: 106804 - DNA, 40 bp, Homo sapiens; identical to SEQ ID NO: 71886
  misc_feature 1..40: note = chr11:100999320-100999360
  misc_feature 1..40: note = Hyper
  source 1..40: mol_type = genomic DNA

SEQ ID NO: 106805 - DNA, 118 bp, Homo sapiens; identical to SEQ ID NO: 71887
  misc_feature 1..118: note = chr11:100999601-100999719
  misc_feature 1..118: note = Hyper
  source 1..118: mol_type = genomic DNA

SEQ ID NO: 106806 - DNA, 74 bp, Homo sapiens; identical to SEQ ID NO: 71888
  misc_feature 1..74: note = chr11:101000148-101000222
  misc_feature 1..74: note = Hyper
  source 1..74: mol_type = genomic DNA

SEQ ID NO: 106807 - DNA, 18 bp, Homo sapiens
  misc_feature 1..18: note = chr11:101361883-101361901
  misc_feature 1..18: note = Hypo
  source 1..18: mol_type = genomic DNA
ttagaaaatcctaaccgg

SEQ ID NO: 106808 - DNA, 463 bp, Homo sapiens
  misc_feature 1..463: note = chr11:101453090-101453553
  misc_feature 1..463: note = Hyper
  source 1..463: mol_type = genomic DNA
tagagctgagaacctcgggaaaccgcttgcgggtggatgtgacaagtcaggaaacttgactacccaatcacccaaaggggcaatgggacagaaatgctatctgcccgctgcacatgtggtcacagcggtgtcggggaagcggagtcttttcttctggagtccactctgcttactccctacctcccctcccgccacccacccagctaaaaaaaaaaataccctagattcataaacaaaagcttgcagttacccacagcccaatacaaacgacccgacgccctcacttctatagcccgtgagtctcccagcccctaacaggctcgtctccccagacgccccgggtgaaaaggttcgcgccgccggtggagagtcctattggttctatttctgtcttcactccaaggccccaggaccggggagaggtcctggtctaactttggctgtcccacggtccaaggacctc

SEQ ID NO: 106809 - DNA, 602 bp, Homo sapiens
  misc_feature 1..602: note = chr11:101454145-101454747
  misc_feature 1..602: note = Hyper
  source 1..602: mol_type = genomic DNA
tcctggctctcgttgcgccgcgcagcggctccggcagcgccccggggagaactgcccctccggggcccgaacgccgggctctggctcatggcgggaacgcccgactggcctgggccccgctcccgggggagccgagtgggcagttccagcggggacccggtgcggagggttcgcgtcagcggccgaactggacctgggcagaccggtgcccaggggacgacggtgaagcagggggtgcagacgcccgccgcaagtggctcgcccactggcccggggaaaagtcaccacttaagggggtgcaaagaggatcttgacctgagcaggtcaggccgaggagaccccgcgaggatgcgtctggggcgcccgggcagagagggcacaggcggggccgctggtggtagcgaagcgtaagagcggagagcaagggagacggagctgaagagttactatgtcaacagagactctccagccctcagctcccgccttcatcccccgcactctccgtcaagatccccacctttaaagggatccgagcgacgttctagaaagcagccaaagcctgtcctgtagccacaactttcaggaggcggtatgagcctgaa

SEQ ID NO: 106810 - DNA, 330 bp, Homo sapiens; identical to SEQ ID NO: 71893
  misc_feature 1..330: note = chr11:101918176-101918506
  misc_feature 1..330: note = Hyper
  source 1..330: mol_type = genomic DNA

SEQ ID NO: 106811 - DNA, 330 bp, Homo sapiens; identical to SEQ ID NO: 71894
  misc_feature 1..330: note = chr11:101981634-101981964
  misc_feature 1..330: note = Hyper
  source 1..330: mol_type = genomic DNA

SEQ ID NO: 106812 - DNA, 89 bp, Homo sapiens; identical to SEQ ID NO: 71895
  misc_feature 1..89: note = chr11:101982771-101982860
  misc_feature 1..89: note = Hyper
  source 1..89: mol_type = genomic DNA

SEQ ID NO: 106813 - DNA, 20 bp, Homo sapiens
  misc_feature 1..20: note = chr11:102158481-102158501
  misc_feature 1..20: note = Hypo
  source 1..20: mol_type = genomic DNA
gcgcccggcccctgtttact

SEQ ID NO: 106814 - DNA, 31 bp, Homo sapiens; identical to SEQ ID NO: 71903
  misc_feature 1..31: note = chr11:102961347-102961378
  misc_feature 1..31: note = Hypo
  source 1..31: mol_type = genomic DNA

SEQ ID NO: 106815 - DNA, 29 bp, Homo sapiens
  misc_feature 1..29: note = chr11:102980027-102980056
  misc_feature 1..29: note = Hyper
  source 1..29: mol_type = genomic DNA
tgaccgcagggagccgctgaagagctccg

SEQ ID NO: 106816 - DNA, 66 bp, Homo sapiens; identical to SEQ ID NO: 71904
  misc_feature 1..66: note = chr11:102980422-102980488
  misc_feature 1..66: note = Hyper
  source 1..66: mol_type = genomic DNA

SEQ ID NO: 106817 - DNA, 96 bp, Homo sapiens; identical to SEQ ID NO: 71908
  misc_feature 1..96: note = chr11:103327717-103327813
  misc_feature 1..96: note = Hypo
  source 1..96: mol_type = genomic DNA

SEQ ID NO: 106818 - DNA, 36 bp, Homo sapiens; identical to SEQ ID NO: 71909
  misc_feature 1..36: note = chr11:103327933-103327969
  misc_feature 1..36: note = Hypo
  source 1..36: mol_type = genomic DNA

SEQ ID NO: 106819 - DNA, 1176 bp, Homo sapiens
  misc_feature 1..1176: note = chr11:104034042-104035218
  misc_feature 1..1176: note = Hyper
  source 1..1176: mol_type = genomic DNA
actgctagattgaaacgcacgatttctcctctcactcgtaaaaataaataaataaataaataaaatttaaataaacgtctatcacccagggaaagctactcttgactccttccacctatcaaaattgcctaagaaaggttgagtctgaccaaggggcggcgcagcttgcaactttcgccaactccgggatgaggcaccgcatcctggtaccagaggcttggacaccaaaatgacttctctagggtgcagcaaggtgagccacctggcttatcctatccccatcagcacgcgtcccacacctctcagtcccattccggaaatggagctctctcaggactggatacaggcaggagacctccctccccaaacaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctcgccctgcgctggcccgggtcgctgtgctaatcgccgagctctccccaaacttcctgcatgctgaactttccgagcgcgtgtgggtgccgcacttccttgtggtgctgagctgataaatggtgacgggacaaacaacaggttgacgtttgtttgttcgccccctccggtggccggcagctgcagcacaggctgcagggggcgggcagcgccgaatctagcggggcaggcgagcggagcagcagcgttctccagccccggccgcggcccctgagaggcgcgcactcgggctcagagcggcggcgcgagcacctcagctccccagtttcccaggccgggcctaaacctgctctgccactgagcatgcccagtttaatcgccggccgggactcttcccaccgccctgggctttaccctcctggttggacctgtaagggctcaggaaacaaactcgccaggaggaagtg

SEQ ID NO: 106820 - DNA, 21 bp, Homo sapiens
  misc_feature 1..21: note = chr11:104099607-104099628
  misc_feature 1..21: note = Hypo
  source 1..21: mol_type = genomic DNA
agccaccgtgcccggctattc

SEQ ID NO: 106821 - DNA, 1156 bp, Homo sapiens
  misc_feature 1..1156: note = chr11:105480721-105481877
  misc_feature 1..1156: note = Hyper
  source 1..1156: mol_type = genomic DNA
ggctctccagattcccgggctgtttgctggtgagaaatctttgctgcagcgaggaccggagtcccccgcgcgcagcccagtggcagaagagggctaggctgagagggaagccaggactgtaggagagggaggcagcccgtcctcctcacgaacctgcaaggatgcggcaggggcctgggggcatggggaggtactaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccggtgagcacccagggggtgaagccagccgagcggtgggcgaggggcgtgcggagggagtgcgcgctcgaggaggggacgccaggagggcagcgatgctccgggctggtgcaggcttgctgggggatgtcggctgatgcgagctggagagcgcgtgtggcggccgcggcgccagtgtttgtgtgtatgtgagaaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttctttttttttttttttttttggttgattttaattttagcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtaaggtgtgctccgatggggtgtgcatgtggctggttgtagcagatatccgaaagtgagttaaa

SEQ ID NO: 106822 - DNA, 808 bp, Homo sapiens; identical to SEQ ID NO: 34035
  misc_feature 1..808: note = chr11:106888283-106889091
  misc_feature 1..808: note = Hyper
  source 1..808: mol_type = genomic DNA

SEQ ID NO: 106823 - DNA, 850 bp, Homo sapiens
  misc_feature 1..850: note = chr11:106889348-106890198
  misc_feature 1..850: note = Hyper
  source 1..850: mol_type = genomic DNA
tgggagtctctgcctcgcctgtcgccacgtttcaggagcaacgaggacacttcgttgctgtcctctgcgcgccctccctgctccgaggaggtgcgcacaggagctcgggtcggactgagggccccaaccccaaacgccttatcctcggccctcgggagcagatgggtcccggcggcgctggtggggagaagggctcggggctggggggcgagaggcctccccctggagccaccttggggaaacctgacagtgtgaagtgggggttagggtccatgttgtcctttctccgagtttatttaggaagttccgaggcaaaagggaaaggccaagcgtccagccagcccactccagaggagacgctttcaggggaagggaaggacaggggcaacattttggcgcccatcctgctggagcagctcctggggacttgtgttccccgcctcgtgcgaggccgtgtgggcgcggagcgagcccagaaaggggcggcagtgaggacagcgtctgctctgacaagacagcactgttgctgagcctcagccgggcggggtgcgcggggctcccggctccgctggctcctcactagtgctggacagctccgcttgccacctatagccgcctttgcaggcgttgagaactggagaacagttcctcctcaaacgacctagcacctggcccgggggaaaccggggaatgatcccacgtccctcatcctcagggctctttgcgccaaatatgcgatctgtttgcacctgactgcaaatgctgctcagaaagctaaggggagtagggataaatgcttctcgaactgactcgccacagcgcgagcatgtcttgccgcgagttttcagct

SEQ ID NO: 106824 - DNA, 30 bp, Homo sapiens; identical to SEQ ID NO: 71929
  misc_feature 1..30: note = chr11:107047782-107047812
  misc_feature 1..30: note = Hypo
  source 1..30: mol_type = genomic DNA

SEQ ID NO: 106825 - DNA, 1339 bp, Homo sapiens; identical to SEQ ID NO: 71930
  misc_feature 1..1339: note = chr11:107461396-107462735
  misc_feature 1..1339: note = Hyper
  source 1..1339: mol_type = genomic DNA

SEQ ID NO: 106826 - DNA, 1236 bp, Homo sapiens; identical to SEQ ID NO: 71933
  misc_feature 1..1236: note = chr11:107798867-107800103
  misc_feature 1..1236: note = Hyper
  source 1..1236: mol_type = genomic DNA

SEQ ID NO: 106827 - DNA, 48 bp, Homo sapiens; identical to SEQ ID NO: 71943
  misc_feature 1..48: note = chr11:108540610-108540658
  misc_feature 1..48: note = Hypo
  source 1..48: mol_type = genomic DNA

SEQ ID NO: 106828 - DNA, 30 bp, Homo sapiens; identical to SEQ ID NO: 71945
  misc_feature 1..30: note = chr11:108603360-108603390
  misc_feature 1..30: note = Hypo
  source 1..30: mol_type = genomic DNA

SEQ ID NO: 106829 - DNA, 471 bp, Homo sapiens
  misc_feature 1..471: note = chr11:109292773-109293244
  misc_feature 1..471: note = Hyper
  source 1..471: mol_type = genomic DNA
ggcttggagccctggcggtggctgcctgacgtcaccggcctctctggcaataggctgcgagctcagctccctgaagcggcggcgaaggcggcggcggcggcggcggcggcggcagcagcgcggctcggtctctggtccattcactccacgctttctgcagccgccactgcagccgcgcggcgggggctccctccttgcagccagccggcggtccaggtaagagacaaggtgtgagtaaaggcttctgatggccgggtggcctgacggccaggtgcgagtggggaggacagctcacgcggcctgagcagccacccctggccatagctccagcccccgcccctgcccccggcccctgccctggcttgcttgcgcgctacctcgctactccgcagtgcaacagtttgcagctgcctcttgggagcagcaaggaggctctcctgtgcgctgcgggtctaccggctccagtatgcc

SEQ ID NO: 106830 - DNA, 393 bp, Homo sapiens
  misc_feature 1..393: note = chr11:109293506-109293899
  misc_feature 1..393: note = Hyper
  source 1..393: mol_type = genomic DNA
agaagagatggagcgcgttcctgcgcgtcagccgcggtcgcggacagaggcagagtgggatgtggtgccaggggtatccccctgggaatgggacccaagggatctgacgctgtccagggagggcgagtctggacggggagggaaaggaagggaggactgcgtacccggagcccgcgcggcggcccggagtgggtgctgggaagggtaggatccaggcgaagacatcaaccgagagggcgcagaaaagaggagagccggcgctctgggaagtagggacttcaaccaaagcggctgcgtgtctgttgcaattataaagttgtgaagggcggaagggaggctgccttatctgctgagtaatctgcacctccgcggtgccggcgcagaccccatcct

SEQ ID NO: 106831 - DNA, 76 bp, Homo sapiens; identical to SEQ ID NO: 71951
  misc_feature 1..76: note = chr11:109294113-109294189
  misc_feature 1..76: note = Hyper
  source 1..76: mol_type = genomic DNA

SEQ ID NO: 106832 - DNA, 21 bp, Homo sapiens
  misc_feature 1..21: note = chr11:109661438-109661459
  misc_feature 1..21: note = Hypo
  source 1..21: mol_type = genomic DNA
ccaccacgcccggccgatatt

SEQ ID NO: 106833 - DNA, 30 bp, Homo sapiens; identical to SEQ ID NO: 43243
  misc_feature 1..30: note = chr11:109880267-109880297
  misc_feature 1..30: note = Hypo
  source 1..30: mol_type = genomic DNA

SEQ ID NO: 106834 - DNA, 170 bp, Homo sapiens; identical to SEQ ID NO: 71958
  misc_feature 1..170: note = chr11:110089331-110089501
  misc_feature 1..170: note = Hypo
  source 1..170: mol_type = genomic DNA

SEQ ID NO: 106835 - DNA, 30 bp, Homo sapiens; identical to SEQ ID NO: 71959
  misc_feature 1..30: note = chr11:110132980-110133010
  misc_feature 1..30: note = Hypo
  source 1..30: mol_type = genomic DNA

SEQ ID NO: 106836 - DNA, 2402 bp, Homo sapiens
  misc_feature 1..2402: note = chr11:110581773-110584175
  misc_feature 1..2402: note = Hyper
  source 1..2402: mol_type = genomic DNA
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgacccccacctgggagacccggaatcatccaggaccctggtgtggggggcagtactccccatatctgccccccgaaaactgctatggagcagccgcgcctcggcgggcaggtgagggggccgagcccaccagcgccgcagccccgctgcctaccttcttcagcgccggctgccgctcccgggcagacatcgccggccctgactttggggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagggaagaggagcgccccggctgtccccctagagtctcctgctggggggacatcgcttccatgaagaaaatcttcaaacaaatcccagcccaggaggaggctacacgatcatgtccgcgggctgccggccggaggggcgaggacgcgcgggcggaggcgcggctgccgtgctcaggcagggagccgagctccgggtgctcgccgcgcgcctcccgtcggggccatgtacctccgcctgcgctcgacaccgcgggctggaggcgagtgcagcggcgacagcccgtcagcgccgcggcccgccccgcctcgggcccgccccctccgctccgggcgccctgcgccggggcccgcccccgcagccctcctcagccctcctccagcctgggccctcctagcctcgtcccagcctgcggcgcgcctggcgggcgtctctctatatatgttagcacaccggccaccggctgaccttttcggtctgtgactccgcgtgggtgcagcccgcaggagctcatcggcctgtgtcacgcacgggggcctctagtgcacggacacgcgcctctcccgccacctgcccactcccaccagaccccatcccttcccgcgccgtgcccgcggcggaaggcgcccctgcagcgcgtgcatccgcggagcggtggcgacctcagcctgagcagaggagttgcagtgattcctgcctcgctttcagcggactgcggagggaatcccccaccccaccccactggggatagggtggcacgtcgcagagtgtcgcagctgtacaaatttggaagcccacagcatcgcctgacctcttgtgcaatcccgaacgctagcctgttcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaaggacaccacgctatgatattagg

SEQ ID NO: 106837 - DNA, 30 bp, Homo sapiens; identical to SEQ ID NO: 71964
  misc_feature 1..30: note = chr11:111089918-111089948
  misc_feature 1..30: note = Hypo
  source 1..30: mol_type = genomic DNA

SEQ ID NO: 106838 - DNA, 397 bp, Homo sapiens; identical to SEQ ID NO: 71965
  misc_feature 1..397: note = chr11:111154359-111154756
  misc_feature 1..397: note = Hypo
  source 1..397: mol_type = genomic DNA

SEQ ID NO: 106839 - DNA, 100 bp, Homo sapiens; identical to SEQ ID NO: 43245
  misc_feature 1..100: note = chr11:111156679-111156779
  misc_feature 1..100: note = Hypo
  source 1..100: mol_type = genomic DNA

SEQ ID NO: 106840 - DNA, 379 bp, Homo sapiens; identical to SEQ ID NO: 71967
  misc_feature 1..379: note = chr11:111169972-111170351
  misc_feature 1..379: note = Hyper
  source 1..379: mol_type = genomic DNA

SEQ ID NO: 106841 - DNA, 780 bp, Homo sapiens
  misc_feature 1..780: note = chr11:111383125-111383905
  misc_feature 1..780: note = Hyper
  source 1..780: mol_type = genomic DNA
ctcccccacccgccccgtctcgcgcccgccccgcccctcggcccgcggggttccaaggacggttggtcgcccccgccacagtcactcggccgctcagagcggcggggcgcacggggtcgagagagccagctctagggtttggggctgggaactgaagcctggcgtgaaggaagtgggagcccgggccgaggaggcgaaggggaaaggaaaagcgaggggaacctgagcgggagggccctgagaggagcgggaggctgcgggaaggggaggcctggcactcctgggggtcatgggggtcggggcgcggctcccggcctgggagggcgcgggtcctccccggcagcgccgcccgctggcccagctacgcgtgttgtgcgctgcgaggccggcgggggtcccgctgggcccgggggtgtcctcgggggccgcttgcgcccagccatggtagggcgtcccccggtgaaatggggtccgaggcgggccccgaccccgcgtcggcgctgcggaccgtccgggagctgcagccgcgggtgcccggtgctcggtttgtaggcagtgtcattagctgattgtactgtggtggttacaatcactaactccactgccatcaaaacaaggcacagcatcaccgccgcccggccgggaagaagacgccggctcgggcagcccgcagccttcgagagaagatgcctgagaagcgcggcgtcggcgtgggtcctgcgcagcctgccccgcgagcgcccgctgcaagtgcgaggaaacccgcggtttctccagata

SEQ ID NO: 106842 - DNA, 218 bp, Homo sapiens; identical to SEQ ID NO: 71971
  misc_feature 1..218: note = chr11:111385246-111385464
  misc_feature 1..218: note = Hyper
  source 1..218: mol_type = genomic DNA

SEQ ID NO: 106843 - DNA, 1192 bp, Homo sapiens
  misc_feature 1..1192: note = chr11:111411112-111412304
  misc_feature 1..1192: note = Hyper
  source 1..1192: mol_type = genomic DNA
cttggctaaggtcagcgggagaggaggggtgagatgtggtgctagttttaggcacactgtgctcgttatcagattgcctaggggcccgactgaagtattcctccgcccagcgcctcgggcaaacgcgggatctcccagggaagctcggagggggacagggagctggttcccctctgcgactcgcccctctctggctggccgagtgtctggcgccaacctcgctggaggaggctgtcgggggcgggccagccagcggggctgccctcctcgcagtgacgtcccagggggcggaggggcgaccgactgactccgcgccctcccccccgcctcccgtgcggtccgtcggtggcctagagatgctgctgccgcggttgcagttgtcgcgcacgcctctgcccgccagcccgctccaccgccgtagcgcccgagtgtcggggggcgcacccgagtcgggccatgaggccgggaaccgcgctacaggccgtgctgctggccgtgctgctggtggggctgcgggccgcgacgggtcgcctgctgagtggtgagtgcgcgcgctggggcgggggctggtgccggggtgggctcactgcaccccagctgctgctgaccctcttctgggtcgccacgtatgggactagaaggccgtcccatgccccactcccagacgcagcccttcggagtctcttgcgttctgggggcagtcgcacggcgtctgagacccacgccagttcccggagctgcgcagttccctgcgcgtcctggaacgctcgaagcccgttcccagtccagagttatgggggtgggttggagaatgtaggagaggtggggcagtgggcaaacctgccccagtgggtgccccttcggcccgctcctttacacgcatcgaatcagtccttgggaccacccccgcggggcaggcttgccagctggcccccgcctaccgcccgctccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctctgcttccttcctcctgttgtgtcactgcagcctcggatttggacctca

SEQ ID NO: 106844 - DNA, 30 bp, Homo sapiens; identical to SEQ ID NO: 34057
  misc_feature 1..30: note = chr11:111412594-111412624
  misc_feature 1..30: note = Hyper
  source 1..30: mol_type = genomic DNA

SEQ ID NO: 106845 - DNA, 30 bp, Homo sapiens; identical to SEQ ID NO: 71978
  misc_feature 1..30: note = chr11:112370516-112370546
  misc_feature 1..30: note = Hypo
  source 1..30: mol_type = genomic DNA

SEQ ID NO: 106846 - DNA, 30 bp, Homo sapiens; identical to SEQ ID NO: 71979
  misc_feature 1..30: note = chr11:112651559-112651589
  misc_feature 1..30: note = Hypo
  source 1..30: mol_type = genomic DNA

SEQ ID NO: 106847 - DNA, 177 bp, Homo sapiens; identical to SEQ ID NO: 71980
  misc_feature 1..177: note = chr11:113258642-113258819
  misc_feature 1..177: note = Hyper
  source 1..177: mol_type = genomic DNA

SEQ ID NO: 106848 - DNA, 56 bp, Homo sapiens; identical to SEQ ID NO: 71981
  misc_feature 1..56: note = chr11:113286309-113286365
  misc_feature 1..56: note = Hypo
  source 1..56: mol_type = genomic DNA

SEQ ID NO: 106849 - DNA, 744 bp, Homo sapiens; identical to SEQ ID NO: 71982
  misc_feature 1..744: note = chr11:113344994-113345738
  misc_feature 1..744: note = Hyper
  source 1..744: mol_type = genomic DNA

SEQ ID NO: 106850 - DNA, 102 bp, Homo sapiens; identical to SEQ ID NO: 34060
  misc_feature 1..102: note = chr11:113346239-113346341
  misc_feature 1..102: note = Hyper
  source 1..102: mol_type = genomic DNA

SEQ ID NO: 106851 - DNA, 23 bp, Homo sapiens
  misc_feature 1..23: note = chr11:113373844-113373867
  misc_feature 1..23: note = Hypo
  source 1..23: mol_type = genomic DNA
cgagactccgtctcaaaaaaaaa

SEQ ID NO: 106852 - DNA, 265 bp, Homo sapiens; identical to SEQ ID NO: 71985
  misc_feature 1..265: note = chr11:113552719-113552984
  misc_feature 1..265: note = Hypo
  source 1..265: mol_type = genomic DNA

SEQ ID NO: 106853 - DNA, 262 bp, Homo sapiens; identical to SEQ ID NO: 71986
  misc_feature 1..262: note = chr11:113560957-113561219
  misc_feature 1..262: note = Hypo
  source 1..262: mol_type = genomic DNA

SEQ ID NO: 106854 - DNA, 93 bp, Homo sapiens; identical to SEQ ID NO: 71988
  misc_feature 1..93: note = chr11:113902101-113902194
  misc_feature 1..93: note = Hypo
  source 1..93: mol_type = genomic DNA

SEQ ID NO: 106855 - DNA, 59 bp, Homo sapiens; identical to SEQ ID NO: 71989
  misc_feature 1..59: note = chr11:113907046-113907105
  misc_feature 1..59: note = Hyper
  source 1..59: mol_type = genomic DNA

SEQ ID NO: 106856 - DNA, 525 bp, Homo sapiens; identical to SEQ ID NO: 71990
  misc_feature 1..525: note = chr11:113929598-113930123
  misc_feature 1..525: note = Hyper
  source 1..525: mol_type = genomic DNA

SEQ ID NO: 106857 - DNA, 434 bp, Homo sapiens; identical to SEQ ID NO: 71991
  misc_feature 1..434: note = chr11:113930367-113930801
  misc_feature 1..434: note = Hyper
  source 1..434: mol_type = genomic DNA

SEQ ID NO: 106858 - DNA, 37 bp, Homo sapiens; identical to SEQ ID NO: 71992
  misc_feature 1..37: note = chr11:113931030-113931067
  misc_feature 1..37: note = Hyper
  source 1..37: mol_type = genomic DNA

SEQ ID NO: 106859 - DNA, 821 bp, Homo sapiens; identical to SEQ ID NO: 71993
  misc_feature 1..821: note = chr11:113931299-113932120
  misc_feature 1..821: note = Hyper
  source 1..821: mol_type = genomic DNA

SEQ ID NO: 106860 - DNA, 48 bp, Homo sapiens; identical to SEQ ID NO: 71995
  misc_feature 1..48: note = chr11:114112577-114112625
  misc_feature 1..48: note = Hypo
  source 1..48: mol_type = genomic DNA

SEQ ID NO: 106861 - DNA, 87 bp, Homo sapiens; identical to SEQ ID NO: 71996
  misc_feature 1..87: note = chr11:114112965-114113052
  misc_feature 1..87: note = Hypo
  source 1..87: mol_type = genomic DNA

SEQ ID NO: 106862 - DNA, 183 bp, Homo sapiens; identical to SEQ ID NO: 71997
  misc_feature 1..183: note = chr11:114115465-114115648
  misc_feature 1..183: note = Hypo
  source 1..183: mol_type = genomic DNA

SEQ ID NO: 106863 - DNA, 248 bp, Homo sapiens; identical to SEQ ID NO: 71998
  misc_feature 1..248: note = chr11:114120983-114121231
  misc_feature 1..248: note = Hypo
  source 1..248: mol_type = genomic DNA

SEQ ID NO: 106864 - DNA, 30 bp, Homo sapiens; identical to SEQ ID NO: 72000
  misc_feature 1..30: note = chr11:114314811-114314841
  misc_feature 1..30: note = Hypo
  source 1..30: mol_type = genomic DNA

SEQ ID NO: 106865 - DNA, 136 bp, Homo sapiens; identical to SEQ ID NO: 72001
  misc_feature 1..136: note = chr11:114494121-114494257
  misc_feature 1..136: note = Hypo
  source 1..136: mol_type = genomic DNA

SEQ ID NO: 106866 - DNA, 30 bp, Homo sapiens; identical to SEQ ID NO: 72003
  misc_feature 1..30: note = chr11:114743244-114743274
  misc_feature 1..30: note = Hypo
  source 1..30: mol_type = genomic DNA

SEQ ID NO: 106867 - DNA, 1514 bp, Homo sapiens; identical to SEQ ID NO: 72007
  misc_feature 1..1514: note = chr11:115373239-115374753
  misc_feature 1..1514: note = Hyper
  source 1..1514: mol_type = genomic DNA

SEQ ID NO: 106868 - DNA, 443 bp, Homo sapiens; identical to SEQ ID NO: 72008
  misc_feature 1..443: note = chr11:115374991-115375434
  misc_feature 1..443: note = Hyper
  source 1..443: mol_type = genomic DNA

SEQ ID NO: 106869 - DNA, 62 bp, Homo sapiens; identical to SEQ ID NO: 72009
  misc_feature 1..62: note = chr11:115375832-115375894
  misc_feature 1..62: note = Hyper
  source 1..62: mol_type = genomic DNA

SEQ ID NO: 106870 - DNA, 579 bp, Homo sapiens
  misc_feature 1..579: note = chr11:115529982-115530561
  misc_feature 1..579: note = Hyper
  source 1..579: mol_type = genomic DNA
ctcccatctctacagcgactcccctatgaccgtcccccacccggtgctctcgggccacggggaagggacactcgggaaagacaccagagaccgggagggtgcagctgggctcttcgcggggagcgggcgggaggccttcctgttacatgtcgcagctgggacacagacggcagcgctccagggtccacttgccggcttcggttccctcaggcccaggaccaggctccacaccgctgtcgcgtcccttagccgtgtgggctgtagcacagagggggcaaacacctccaggggcttgtgccaagtaattaccaagcaaattcccggcgatttcctctcctccccccgcccccccgggcagtgcccgctgcgtgttccctgattcggcccccggctgtgcaatcagctccaggtaacctgcggggacccgtaattgctctggagttgcctgcgagtttgcaaggtaagcacgcgcggcgcttctccctggccctggggcgcgcggtggagcgccttgcgcccgcccccgatgggccggatgccggggacctgcggaagcagaggctgcgggggtagagatcc

SEQ ID NO: 106871 - DNA, 190 bp, Homo sapiens; identical to SEQ ID NO: 72014
  misc_feature 1..190: note = chr11:115587766-115587956
  misc_feature 1..190: note = Hypo
  source 1..190: mol_type = genomic DNA

SEQ ID NO: 106872 - DNA, 997 bp, Homo sapiens
  misc_feature 1..997: note = chr11:115630411-115631408
  misc_feature 1..997: note = Hyper
  source 1..997: mol_type = genomic DNA
ccccttctccagcctcgcctccccaatgcgcttcccgcctctgcatcgccgccggccccttcacgcctctaccttgggcgggtttggggtaagggccgcgcagaccctaagggaaggcccgaggtcgccggagctcctcctctcgcggctgagtgagggtctgggaggccagatgaagggagctgctcggctgagctgcggaccagcgcgagagcagcgggcagtggcggaccagcgccagggcagggcaggggtggacagagggctctccccacccttccctcctccagtgaaagtaccagaagagatggcggccgctccgccgagtgtcattaccgcggaagcagcagaagccggcggcaggagcgggcccgagagcccgcggccagtggcctgcgcaccccgcgcccagcgcccccgccgcgggtcatcagtgtcagcgttgaggggtcccggggagcggttgcagggcggcggcggcggccgggtcatcagaagcacagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagccctgctcttcagcaaacggtgtatttcagcccgagtttccttccgggggtttggctgtgagtgtgtgtgacctcccagatggcggcacggttcagatcccat

SEQ ID NO: 106873 - DNA, 163 bp, Homo sapiens; identical to SEQ ID NO: 72019
  misc_feature 1..163: note = chr11:115733020-115733183
  misc_feature 1..163: note = Hypo
  source 1..163: mol_type = genomic DNA

SEQ ID NO: 106874 - DNA, 30 bp, Homo sapiens; identical to SEQ ID NO: 43252
  misc_feature 1..30: note = chr11:115763341-115763371
  misc_feature 1..30: note = Hypo
  source 1..30: mol_type = genomic DNA

SEQ ID NO: 106875 - DNA, 30 bp, Homo sapiens; identical to SEQ ID NO: 72021
  misc_feature 1..30: note = chr11:115771022-115771052
  misc_feature 1..30: note = Hypo
  source 1..30: mol_type = genomic DNA

SEQ ID NO: 106876 - DNA, 42 bp, Homo sapiens; identical to SEQ ID NO: 72023
  misc_feature 1..42: note = chr11:116146911-116146953
  misc_feature 1..42: note = Hypo
  source 1..42: mol_type = genomic DNA

SEQ ID NO: 106877 - DNA, 64 bp, Homo sapiens; identical to SEQ ID NO: 72026
  misc_feature 1..64: note = chr11:116451313-116451377
  misc_feature 1..64: note = Hyper
  source 1..64: mol_type = genomic DNA

SEQ ID NO: 106878 - DNA, 30 bp, Homo sapiens; identical to SEQ ID NO: 72027
  misc_feature 1..30: note = chr11:116453617-116453647
  misc_feature 1..30: note = Hypo
  source 1..30: mol_type = genomic DNA

SEQ ID NO: 106879 - DNA, 596 bp, Homo sapiens; identical to SEQ ID NO: 72028
  misc_feature 1..596: note = chr11:116706286-116706882
  misc_feature 1..596: note = Hyper
  source 1..596: mol_type = genomic DNA

SEQ ID NO: 106880 - DNA, 32 bp, Homo sapiens; identical to SEQ ID NO: 15607
  misc_feature 1..32: note = chr11:116890012-116890044
  misc_feature 1..32: note = Hypo
  source 1..32: mol_type = genomic DNA

SEQ ID NO: 106881 - DNA, 75 bp, Homo sapiens; identical to SEQ ID NO: 43254
  misc_feature 1..75: note = chr11:116952331-116952406
  misc_feature 1..75: note = Hypo
  source 1..75: mol_type = genomic DNA

SEQ ID NO: 106882 - DNA, 30 bp, Homo sapiens; identical to SEQ ID NO: 72031
  misc_feature 1..30: note = chr11:116976981-116977011
  misc_feature 1..30: note = Hypo
  source 1..30: mol_type = genomic DNA

SEQ ID NO: 106883 - DNA, 39 bp, Homo sapiens; identical to SEQ ID NO: 72032
  misc_feature 1..39: note = chr11:117010334-117010373
  misc_feature 1..39: note = Hypo
  source 1..39: mol_type = genomic DNA

SEQ ID NO: 106884 - DNA, 30 bp, Homo sapiens; identical to SEQ ID NO: 43256
  misc_feature 1..30: note = chr11:117054963-117054993
  misc_feature 1..30: note = Hypo
  source 1..30: mol_type = genomic DNA

SEQ ID NO: 106885 - DNA, 37 bp, Homo sapiens; identical to SEQ ID NO: 72034
  misc_feature 1..37: note = chr11:117068532-117068569
  misc_feature 1..37: note = Hypo
  source 1..37: mol_type = genomic DNA

SEQ ID NO: 106886 - DNA, 62 bp, Homo sapiens; identical to SEQ ID NO: 72035
  misc_feature 1..62: note = chr11:117186235-117186297
  misc_feature 1..62: note = Hyper
  source 1..62: mol_type = genomic DNA

SEQ ID NO: 106887 - DNA, 43 bp, Homo sapiens; identical to SEQ ID NO: 72036
  misc_feature 1..43: note = chr11:117307989-117308032
  misc_feature 1..43: note = Hypo
  source 1..43: mol_type = genomic DNA

SEQ ID NO: 106888 - DNA, 30 bp, Homo sapiens; identical to SEQ ID NO: 72037
  misc_feature 1..30: note = chr11:117344740-117344770
  misc_feature 1..30: note = Hypo
  source 1..30: mol_type = genomic DNA

SEQ ID NO: 106889 - DNA, 190 bp, Homo sapiens; identical to SEQ ID NO: 72038
  misc_feature 1..190: note = chr11:117376155-117376345
  misc_feature 1..190: note = Hypo
  source 1..190: mol_type = genomic DNA

SEQ ID NO: 106890 - DNA, 1130 bp, Homo sapiens; identical to SEQ ID NO: 72039
  misc_feature 1..1130: note = chr11:117667010-117668140
  misc_feature 1..1130: note = Hyper
  source 1..1130: mol_type = genomic DNA

SEQ ID NO: 106891 - DNA, 178 bp, Homo sapiens; identical to SEQ ID NO: 34080
  misc_feature 1..178: note = chr11:117746361-117746539
  misc_feature 1..178: note = Hyper
  source 1..178: mol_type = genomic DNA

SEQ ID NO: 106892 - DNA, 62 bp, Homo sapiens; identical to SEQ ID NO: 72041
  misc_feature 1..62: note = chr11:117747138-117747200
  misc_feature 1..62: note = Hyper
  source 1..62: mol_type = genomic DNA

SEQ ID NO: 106893 - DNA, 257 bp, Homo sapiens; identical to SEQ ID NO: 72042
  misc_feature 1..257: note = chr11:117747499-117747756
  misc_feature 1..257: note = Hyper
  source 1..257: mol_type = genomic DNA

SEQ ID NO: 106894 - DNA, 30 bp, Homo sapiens; identical to SEQ ID NO: 72043
  misc_feature 1..30: note = chr11:117973031-117973061
  misc_feature 1..30: note = Hypo
  source 1..30: mol_type = genomic DNA

SEQ ID NO: 106895 - DNA, 48 bp, Homo sapiens; identical to SEQ ID NO: 72044
  misc_feature 1..48: note = chr11:118023387-118023435
  misc_feature 1..48: note = Hyper
  source 1..48: mol_type = genomic DNA

SEQ ID NO: 106896 - DNA, 450 bp, Homo sapiens; identical to SEQ ID NO: 72045
  misc_feature 1..450: note = chr11:118023775-118024225
  misc_feature 1..450: note = Hyper
  source 1..450: mol_type = genomic DNA

SEQ ID NO: 106897 - DNA, 254 bp, Homo sapiens; identical to SEQ ID NO: 72046
  misc_feature 1..254: note = chr11:118663050-118663304
  misc_feature 1..254: note = Hyper
  source 1..254: mol_type = genomic DNA

SEQ ID NO: 106898 - DNA, 32 bp, Homo sapiens; identical to SEQ ID NO: 72047
  misc_feature 1..32: note = chr11:118663788-118663820
  misc_feature 1..32: note = Hyper
  source 1..32: mol_type = genomic DNA

SEQ ID NO: 106899 - DNA, 52 bp, Homo sapiens; identical to SEQ ID NO: 43257
  misc_feature 1..52: note = chr11:118768516-118768568
  misc_feature 1..52: note = Hypo
  source 1..52: mol_type = genomic DNA

SEQ ID NO: 106900 - DNA, 30 bp, Homo sapiens; identical to SEQ ID NO: 72049
  misc_feature 1..30: note = chr11:118769490-118769520
  misc_feature 1..30: note = Hypo
  source 1..30: mol_type = genomic DNA

SEQ ID NO: 106901 - DNA, 41 bp, Homo sapiens; identical to SEQ ID NO: 72050
  misc_feature 1..41: note = chr11:118769734-118769775
  misc_feature 1..41: note = Hypo
  source 1..41: mol_type = genomic DNA

SEQ ID NO: 106902 - DNA, 30 bp, Homo sapiens; identical to SEQ ID NO: 72051
  misc_feature 1..30: note = chr11:118780738-118780768
  misc_feature 1..30: note = Hypo
  source 1..30: mol_type = genomic DNA

SEQ ID NO: 106903 - DNA, 32 bp, Homo sapiens; identical to SEQ ID NO: 43258
  misc_feature 1..32: note = chr11:118781045-118781077
  misc_feature 1..32: note = Hypo
  source 1..32: mol_type = genomic DNA

SEQ ID NO: 106904 - DNA, 40 bp, Homo sapiens; identical to SEQ ID NO: 72053
  misc_feature 1..40: note = chr11:118997065-118997105
  misc_feature 1..40: note = Hypo
  source 1..40: mol_type = genomic DNA

SEQ ID NO: 106905 - DNA, 30 bp, Homo sapiens; identical to SEQ ID NO: 72054
  misc_feature 1..30: note = chr11:119040119-119040149
  misc_feature 1..30: note = Hyper
  source 1..30: mol_type = genomic DNA

SEQ ID NO: 106906 - DNA, 30 bp, Homo sapiens; identical to SEQ ID NO: 72055
  misc_feature 1..30: note = chr11:119058038-119058068
  misc_feature 1..30: note = Hypo
  source 1..30: mol_type = genomic DNA

SEQ ID NO: 106907 - DNA, 515 bp, Homo sapiens; identical to SEQ ID NO: 72056
  misc_feature 1..515: note = chr11:119191642-119192157
  misc_feature 1..515: note = Hyper
  source 1..515: mol_type = genomic DNA

SEQ ID NO: 106908 - DNA, 993 bp, Homo sapiens
  misc_feature 1..993: note = chr11:119210435-119211428
  misc_feature 1..993: note = Hyper
  source 1..993: mol_type = genomic DNA
tctcggagcgcttggcgctgaaggcggatcgcggaggcaccgagcactccccggcaggcccggtgggccccgcgggtcccgcctctcctcgcggcccggggtcccctcgaggtcccggcagtcctgcggggtaagcggggcggcagggtgagagtagcggcggctcagcccgcagcggggcggcgactctaaggtcaccgtacccctccccgcccctgcctgagcttcggccagcgcctcctcccgcacgggtacctcctccaccccttcccgcagggcagatctggggggctggccaagggggctcccgccgcctgggcccctcccccgctcagggctgcaaagcgcggggagtggcgccccctggcgggagacccgagtcccggacaccgggagctggagctgcggccgcgcctgctcggacatcgccaccgatagccgcggcggtgccttcttacccggcctcccgccctcgcctttctctcccggagccccgggcgcgccgtcgcggccgtcgcggccatcgcggcccggcaagccctggctgccatggtggcccggcgtgcctggaaggccggggtgccccgggcagaggctggggatcttgttgtcgtccagtgggggcgagccggccgccaggcccaggagcagcaggacgaggagtggcctcatagcgctggcaccgggagcccggacgccggggtcctctcgcagtctgtggaccaggcaggactggagtcgggacccagaatcctgggacctgcctctctccccaccccggcgcggcccagtcggtccccaccccactgccgtgcccctgaggctgagcgctcgcagggccgagcatccggagagcacaggcaggcgcgagagggtgggagcggccagccctccctcccaccgccggcccgcgccagcctttcccacagtcccctccccagcccctttcccctcctccgccagactcaccccccctcccggctccccgatggc

SEQ ID NO: 106909 - DNA, 378 bp, Homo sapiens; identical to SEQ ID NO: 72058
  misc_feature 1..378: note = chr11:119234569-119234947
  misc_feature 1..378: note = Hyper
  source 1..378: mol_type = genomic DNA

SEQ ID NO: 106910 - DNA, 158 bp, Homo sapiens; identical to SEQ ID NO: 72059
  misc_feature 1..158: note = chr11:119292746-119292904
  misc_feature 1..158: note = Hyper
  source 1..158: mol_type = genomic DNA

SEQ ID NO: 106911 - DNA, 767 bp, Homo sapiens
  misc_feature 1..767: note = chr11:119293305-119294072
  misc_feature 1..767: note = Hyper
  source 1..767: mol_type = genomic DNA
agctctcccctcccccgtccgcccgccttccacccagtccccgcctgcggcactgcggcttccttctcctccggtgccccgcacccagcccgccgcgaggtcacccggcagattccctctagctcgccatcctccatcctctccccgcagtttcatccgtcctcctccccgcctctgcgagctgggtttggggacgtctgggtggaatgtagacccacaggctgtccttggtgcccttcctccctgttctccagcgccccagccccagacaccagtcccccagcgggcgaaagcccgggagcgccttccccgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggctcagccaatcagaggcggagattgggggagaaaggacggcagggtggggtggggggtggggaaggaagagaaggcggtcccgcattggtgtgagagtggcaggttgcggcggaagggggccctc

SEQ ID NO: 106912 - DNA, 30 bp, Homo sapiens; identical to SEQ ID NO: 72063
  misc_feature 1..30: note = chr11:119354677-119354707
  misc_feature 1..30: note = Hypo
  source 1..30: mol_type = genomic DNA

SEQ ID NO: 106913 - DNA, 30 bp, Homo sapiens; identical to SEQ ID NO: 72064
  misc_feature 1..30: note = chr11:119487017-119487047
  misc_feature 1..30: note = Hypo
  source 1..30: mol_type = genomic DNA

SEQ ID NO: 106914 - DNA, 46 bp, Homo sapiens; identical to SEQ ID NO: 43259
  misc_feature 1..46: note = chr11:119524180-119524226
  misc_feature 1..46: note = Hypo
  source 1..46: mol_type = genomic DNA

SEQ ID NO: 106915 - DNA, 37 bp, Homo sapiens; identical to SEQ ID NO: 72066
  misc_feature 1..37: note = chr11:119600611-119600648
  misc_feature 1..37: note = Hyper
  source 1..37: mol_type = genomic DNA

SEQ ID NO: 106916 - DNA, 143 bp, Homo sapiens; identical to SEQ ID NO: 72067
  misc_feature 1..143: note = chr11:119608970-119609113
  misc_feature 1..143: note = Hypo
  source 1..143: mol_type = genomic DNA

SEQ ID NO: 106917 - DNA, 30 bp, Homo sapiens; identical to SEQ ID NO: 72068
  misc_feature 1..30: note = chr11:119609728-119609758
  misc_feature 1..30: note = Hypo
  source 1..30: mol_type = genomic DNA

SEQ ID NO: 106918 - DNA, 29 bp, Homo sapiens
  misc_feature 1..29: note = chr11:119611794-119611823
  misc_feature 1..29: note = Hypo
  source 1..29: mol_type = genomic DNA
tctgattggtctggcgcagaatggtcaag

SEQ ID NO: 106919 - DNA, 398 bp, Homo sapiens
  misc_feature 1..398: note = chr11:119612034-119612432
  misc_feature 1..398: note = Hyper
  source 1..398: mol_type = genomic DNA
gcatggacaaatgcacgaatgaatgagactgcgggaatgctgcccccacctcctctccgcctccccacctcgcctccaggtaccctgggcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccaccgcctctgtcggccccattctctaggtccacagagggtagagacactcgggggaacgtacttttactggggtacggggagccctgccccacggctgtcagctcgggtcgggcgcgccgggtgcccaggaggcagcctcccaccctcccccgcacacgtcgttcc

SEQ ID NO: 106920 - DNA, 27 bp, Homo sapiens
  misc_feature 1..27: note = chr11:119612791-119612818
  misc_feature 1..27: note = Hyper
  source 1..27: mol_type = genomic DNA
aggcacacacagaggcgcacacacaca

SEQ ID NO: 106921 - DNA, 446 bp, Homo sapiens; identical to SEQ ID NO: 72072
  misc_feature 1..446: note = chr11:119612998-119613444
  misc_feature 1..446: note = Hyper
  source 1..446: mol_type = genomic DNA

SEQ ID NO: 106922 - DNA, 147 bp, Homo sapiens; identical to SEQ ID NO: 72073
  misc_feature 1..147: note = chr11:119884295-119884442
  misc_feature 1..147: note = Hyper
  source 1..147: mol_type = genomic DNA

SEQ ID NO: 106923 - DNA, 652 bp, Homo sapiens; identical to SEQ ID NO: 72074
  misc_feature 1..652: note = chr11:120008071-120008723
  misc_feature 1..652: note = Hypo
  source 1..652: mol_type = genomic DNA

SEQ ID NO: 106924 - DNA, 222 bp, Homo sapiens; identical to SEQ ID NO: 72075
  misc_feature 1..222: note = chr11:120039752-120039974
  misc_feature 1..222: note = Hyper
  source 1..222: mol_type = genomic DNA

SEQ ID NO: 106925 - DNA, 30 bp, Homo sapiens; identical to SEQ ID NO: 72076
  misc_feature 1..30: note = chr11:120081073-120081103
  misc_feature 1..30: note = Hyper
  source 1..30: mol_type = genomic DNA

SEQ ID NO: 106926 - DNA, 118 bp, Homo sapiens; identical to SEQ ID NO: 34096
  misc_feature 1..118: note = chr11:120110849-120110967
  misc_feature 1..118: note = Hyper
  source 1..118: mol_type = genomic DNA

SEQ ID NO: 106927 - DNA, 93 bp, Homo sapiens; identical to SEQ ID NO: 72081
  misc_feature 1..93: note = chr11:120367603-120367696
  misc_feature 1..93: note = Hypo
  source 1..93: mol_type = genomic DNA

SEQ ID NO: 106928 - DNA, 80 bp, Homo sapiens; identical to SEQ ID NO: 72082
  misc_feature 1..80: note = chr11:120382368-120382448
  misc_feature 1..80: note = Hyper
  source 1..80: mol_type = genomic DNA

SEQ ID NO: 106929 - DNA, 131 bp, Homo sapiens; identical to SEQ ID NO: 34097
  misc_feature 1..131: note = chr11:120382817-120382948
  misc_feature 1..131: note = Hyper
  source 1..131: mol_type = genomic DNA

SEQ ID NO: 106930 - DNA, 148 bp, Homo sapiens; identical to SEQ ID NO: 72084
  misc_feature 1..148: note = chr11:120383999-120384147
  misc_feature 1..148: note = Hypo
  source 1..148: mol_type = genomic DNA

SEQ ID NO: 106931 - DNA, 30 bp, Homo sapiens; identical to SEQ ID NO: 43264
  misc_feature 1..30: note = chr11:120410117-120410147
  misc_feature 1..30: note = Hypo
  source 1..30: mol_type = genomic DNA

SEQ ID NO: 106932 - DNA, 30 bp, Homo sapiens
  misc_feature 1..30: note = chr11:120434939-120434969
  misc_feature 1..30: note = Hyper
  source 1..30: mol_type = genomic DNA
tccagccccttgttacgggggaaaatgctc

SEQ ID NO: 106933 - DNA, 787 bp, Homo sapiens; identical to SEQ ID NO: 72087
  misc_feature 1..787: note = chr11:120435208-120435995
  misc_feature 1..787: note = Hyper
  source 1..787: mol_type = genomic DNA

SEQ ID NO: 106934 - DNA, 30 bp, Homo sapiens; identical to SEQ ID NO: 72088
  misc_feature 1..30: note = chr11:120449384-120449414
  misc_feature 1..30: note = Hypo
  source 1..30: mol_type = genomic DNA

SEQ ID NO: 106935 - DNA, 109 bp, Homo sapiens; identical to SEQ ID NO: 43265
  misc_feature 1..109: note = chr11:120748772-120748881
  misc_feature 1..109: note = Hypo
  source 1..109: mol_type = genomic DNA

SEQ ID NO: 106936 - DNA, 321 bp, Homo sapiens; identical to SEQ ID NO: 72090
  misc_feature 1..321: note = chr11:120772435-120772756
  misc_feature 1..321: note = Hypo
  source 1..321: mol_type = genomic DNA

SEQ ID NO: 106937 - DNA, 30 bp, Homo sapiens; identical to SEQ ID NO: 72091
  misc_feature 1..30: note = chr11:120773074-120773104
  misc_feature 1..30: note = Hypo
  source 1..30: mol_type = genomic DNA

SEQ ID NO: 106938 - DNA, 179 bp, Homo sapiens; identical to SEQ ID NO: 72092
  misc_feature 1..179: note = chr11:120837755-120837934
  misc_feature 1..179: note = Hypo
  source 1..179: mol_type = genomic DNA

SEQ ID NO: 106939 - DNA, 30 bp, Homo sapiens; identical to SEQ ID NO: 72093
  misc_feature 1..30: note = chr11:120937707-120937737
  misc_feature 1..30: note = Hypo
  source 1..30: mol_type = genomic DNA

SEQ ID NO: 106940 - DNA, 231 bp, Homo sapiens; identical to SEQ ID NO: 72094
  misc_feature 1..231: note = chr11:120998602-120998833
  misc_feature 1..231: note = Hypo
  source 1..231: mol_type = genomic DNA

SEQ ID NO: 106941 - DNA, 30 bp, Homo sapiens; identical to SEQ ID NO: 43269
  misc_feature 1..30: note = chr11:121000904-121000934
  misc_feature 1..30: note = Hypo
  source 1..30: mol_type = genomic DNA

SEQ ID NO: 106942 - DNA, 209 bp, Homo sapiens; identical to SEQ ID NO: 72096
  misc_feature 1..209: note = chr11:121023611-121023820
  misc_feature 1..209: note = Hypo
  source 1..209: mol_type = genomic DNA

SEQ ID NO: 106943 - DNA, 139 bp, Homo sapiens; identical to SEQ ID NO: 72097
  misc_feature 1..139: note = chr11:121152146-121152285
  misc_feature 1..139: note = Hypo
  source 1..139: mol_type = genomic DNA

SEQ ID NO: 106944 - DNA, 30 bp, Homo sapiens; identical to SEQ ID NO: 72098
  misc_feature 1..30: note = chr11:121192536-121192566
  misc_feature 1..30: note = Hyper
  source 1..30: mol_type = genomic DNA

SEQ ID NO: 106945 - DNA, 316 bp, Homo sapiens; identical to SEQ ID NO: 72099
  misc_feature 1..316: note = chr11:121297857-121298173
  misc_feature 1..316: note = Hyper
  source 1..316: mol_type = genomic DNA

SEQ ID NO: 106946 - DNA, 202 bp, Homo sapiens; identical to SEQ ID NO: 72104
  misc_feature 1..202: note = chr11:121546780-121546982
  misc_feature 1..202: note = Hypo
  source 1..202: mol_type = genomic DNA

SEQ ID NO: 106947 - DNA, 257 bp, Homo sapiens; identical to SEQ ID NO: 72106
  misc_feature 1..257: note = chr11:121593379-121593636
  misc_feature 1..257: note = Hyper
  source 1..257: mol_type = genomic DNA

SEQ ID NO: 106948 - DNA, 30 bp, Homo sapiens; identical to SEQ ID NO: 43272
  misc_feature 1..30: note = chr11:121910451-121910481
  misc_feature 1..30: note = Hypo
  source 1..30: mol_type = genomic DNA

SEQ ID NO: 106949 - DNA, 30 bp, Homo sapiens; identical to SEQ ID NO: 72115
  misc_feature 1..30: note = chr11:122311181-122311211
  misc_feature 1..30: note = Hyper
  source 1..30: mol_type = genomic DNA

SEQ ID NO: 106950 - DNA, 157 bp, Homo sapiens; identical to SEQ ID NO: 72116
  misc_feature 1..157: note = chr11:122402591-122402748
  misc_feature 1..157: note = Hypo
  source 1..157: mol_type = genomic DNA

SEQ ID NO: 106951 - DNA, 98 bp, Homo sapiens; identical to SEQ ID NO: 72117
  misc_feature 1..98: note = chr11:122511898-122511996
  misc_feature 1..98: note = Hypo
  source 1..98: mol_type = genomic DNA

SEQ ID NO: 106952 - DNA, 75 bp, Homo sapiens; identical to SEQ ID NO: 72118
  misc_feature 1..75: note = chr11:122575506-122575581
  misc_feature 1..75: note = Hypo
  source 1..75: mol_type = genomic DNA

SEQ ID NO: 106953 - DNA, 30 bp, Homo sapiens; identical to SEQ ID NO: 72119
  misc_feature 1..30: note = chr11:122659896-122659926
  misc_feature 1..30: note = Hypo
  source 1..30: mol_type = genomic DNA

SEQ ID NO: 106954 - DNA, 139 bp, Homo sapiens; identical to SEQ ID NO: 72120
  misc_feature 1..139: note = chr11:122752920-122753059
  misc_feature 1..139: note = Hypo
  source 1..139: mol_type = genomic DNA

SEQ ID NO: 106955 - DNA, 473 bp, Homo sapiens; identical to SEQ ID NO: 72121
  misc_feature 1..473: note = chr11:122753630-122754103
  misc_feature 1..473: note = Hyper
  source 1..473: mol_type = genomic DNA

SEQ ID NO: 106956 - DNA, 1641 bp, Homo sapiens
  misc_feature 1..1641: note = chr11:122847129-122848770
  misc_feature 1..1641: note = Hyper
  source 1..1641: mol_type = genomic DNA
taatgaaaggttattcgcaagttcatttctacagggactaggaaactgcctagggccgaggggagggggcgtacgcgtaggagaacgcggtggcaaaccattcctggaaacgcgtgatcattcccagttttgccctgcgagcctacaaacccggtaaaagaataagagacctcccaggggaaaaggagaggggtaaagcgcaaagtcaatcagacccccgccccatctattccccaaacaggtgcacgcccggaacgcctttagccttaaccctttggccttcatcttgatttcctaaaatgcactgagaatgaatatttccacacacaacccgaggaacactcacttttaaaatatcagtagcccgtggaacgtggaagcgttgcgggacaggagcgcaacaagttcgggaagcagaaattgctctaggggttttctgtgcccaagtttcccgccgcgcgctggcgccgcgcagtacgcgggaggcagggcgtaaggggcgtctgcgcctgggggctacaaactcaggaagggtgccaggatgcagaaccgcgagctctagaggagaacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggtccctgaccccaaggacgacggacgcaggaaaatgggcgcccgggcgcacagtctcccgtggctgggaccgggagggctagaggggaggcgggaggccgggccgcgggccgtgctggctccgcaccggcctggaggacaggtgggttttgtttgtcttccaggagcggatttccaaggcccgccacgagactggagtctgagtcttccggtccaggagggaaccgcgctcggccccgcagtctcctcccctgcctactaccctccccagcctggcggctcagagcacgtgcggccctgagcccagctccccctcgtctccaatgtccacctcgtcctctggctcggtcagcacgaagggaccggcgggcaggctcagccgagcctcggcggcggtggcggcctctgaaccgcgggggctgccctcggggctttctggcccgtctggtgctttgggttcgtcttggcttttccgcagttgctttttatgcttcatccgccggttctggaaccacgttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaacagtctgaggc

SEQ ID NO: 106957 - DNA, 1485 bp, Homo sapiens
  misc_feature 1..1485: note = chr11:122849807-122851292
  misc_feature 1..1485: note = Hyper
  source 1..1485: mol_type = genomic DNA
ggccaggtgtaggtaattttacgaaagctcttgggaaaggcttagaataagcgtcagcggggtctatttctactcgaactccacaaggtcccgaaggtattaagacttgaaggcagagaggaacgaagcagagatcagggcctccctctcctcccgcccacctgcgtctcggacaggctgagggccgtggccagctccactcgttctggcgtggacaggtagcgctggatctcgaacctcttctccaagcccgagagctgcgagtcagagaaaaccgtgcgggctttgcggcggcggcagtgcttccccggcagctccgcgtgctgcgggtgcgggaacagcgctgggactggcatccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataaaacagaaaagaaaatcggaaaatagatccggaggctgtttaaaaatgtcttcttggagagacttccgtagggtcggccagcgcggagtcttcagttgcgcctggccaagttttttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctttgttctggattccagcgcgcacaaactgcctcctgtcttgcccccagcccctccaccgaccatggttgttgccgcctctgagctatgagtctggactcaacgaattattctattc

SEQ ID NO: 106958 - DNA, 482 bp, Homo sapiens; identical to SEQ ID NO: 34105
  misc_feature 1..482: note = chr11:122852370-122852852
  misc_feature 1..482: note = Hyper
  source 1..482: mol_type = genomic DNA

SEQ ID NO: 106959 - DNA, 30 bp, Homo sapiens; identical to SEQ ID NO: 72127
  misc_feature 1..30: note = chr11:122854391-122854421
  misc_feature 1..30: note = Hyper
  source 1..30: mol_type = genomic DNA

SEQ ID NO: 106960 - DNA, 142 bp, Homo sapiens
  misc_feature 1..142: note = chr11:122854915-122855057
  misc_feature 1..142: note = Hyper
  source 1..142: mol_type = genomic DNA
ggccctgctctcaggcggagaagccaggagcgatgaggggcggggcggctcccggcgccctcttttccagccccgctcccgcgctgccgccggagagggactcggggcgcagccgccccgcctctgccggggccccaggagg

SEQ ID NO: 106961 - DNA, 137 bp, Homo sapiens; identical to SEQ ID NO: 72130
  misc_feature 1..137: note = chr11:122855295-122855432
  misc_feature 1..137: note = Hyper
  source 1..137: mol_type = genomic DNA

SEQ ID NO: 106962 - DNA, 142 bp, Homo sapiens
  misc_feature 1..142: note = chr11:122855676-122855818
  misc_feature 1..142: note = Hyper
  source 1..142: mol_type = genomic DNA
accttcctgcctgctcgagccctaacccccaccccacccaccagccgcgggccccagggctgcccagggaaggagtacatttttagacatttttagatagcttgcaaaggttgtctgtggcagggaacggggacagggaaac

SEQ ID NO: 106963 - DNA, 768 bp, Homo sapiens; identical to SEQ ID NO: 72135
  misc_feature 1..768: note = chr11:123065429-123066197
  misc_feature 1..768: note = Hyper
  source 1..768: mol_type = genomic DNA

SEQ ID NO: 106964 - DNA, 63 bp, Homo sapiens; identical to SEQ ID NO: 72136
  misc_feature 1..63: note = chr11:123066400-123066463
  misc_feature 1..63: note = Hyper
  source 1..63: mol_type = genomic DNA

SEQ ID NO: 106965 - DNA, 183 bp, Homo sapiens; identical to SEQ ID NO: 72137
  misc_feature 1..183: note = chr11:123169348-123169531
  misc_feature 1..183: note = Hypo
  source 1..183: mol_type = genomic DNA

SEQ ID NO: 106966 - DNA, 575 bp, Homo sapiens
  misc_feature 1..575: note = chr11:123172454-123173029
  misc_feature 1..575: note = Hyper
  source 1..575: mol_type = genomic DNA
cgcagcgggcagggacggaggcgcccaggggcaggcggcagcacgggaagaggccagcaggtggcgcggtcgcccaacccggccgccccccgggcgccgagggaagcgggtcaggggcgtccccacctgcccaagcgccggctctcccaggcagcaggggcggcggcggcctggctggctgcgctgcagagcggagagcaggagcggcgtgggaggaattcggagcactttcgccgcctgcctccttttactgctggttgccctcaaaggagccctctccctccacacgcctttgggccttaccagccgccggaagcggcggcatccatcccagcaaagcgtgcattccatcctctggaaaaaaagtctttgagcttcctttacagtgaccttactttggggactgaaccgttgcgactaagaaaacccctcctcaagtttaatggaacgatcacatgacacgtggttgacgaagccattccctccttgctacttgccttgtgtgatacactgtcacggcccgggcttctggcttggtggaggggacaccaccgcggctccggctgcggacttcg

SEQ ID NO: 106967 - DNA, 968 bp, Homo sapiens
  misc_feature 1..968: note = chr11:123228623-123229591
  misc_feature 1..968: note = Hyper
  source 1..968: mol_type = genomic DNA
cagatgcttccccatcgtgaagatcctccgggtcacctatgcactcctgctaatctctgccatttgccttcttacaccctttccataccttcccgtggaacacggtaatctggtttccagatgggctaatgtctcctcctagctgcaaggcagcggcgcttctggcgttggtttccgcactaaacttgatggtctgattttaaaggttgattttaaagaaactgtctggttgtatgtccccgagttacactgcagtgctaaatgttggagcgaggcaataccgggagaatccaggctgcaggcttcacccagagagggagggtgaggggaggagagagacggagagaggagagagggggaatgaaaggggagagagagggaccaagaccggcgagcgggagacaggagcggaaaccacagaggtagagtcagggccgacactgaagaaacgtagatgcacagggaggggccaatattagtgtacagagagaaagagggaacacggtgcggtgacacctagcctcggagacagtgggagctccgagcccacggagagcgggggagttccgcttcctcccgccccagcggctcccgccccgcctgggcgcagccggccgtcccggctccgagggtgcagcgcgcccgggcgcagcgcgagtgcgtggagccgggctccagcacgaccccgccgctcgggtttgggtgtcctcaggctccgcgctcctcctcccctcctccagatgggactggctctcctctttgcaaagccaggctcgcggggagacgtggtgagcagtagccagcagctggtgtgccgtggacgccgctgaccgccgcgcgcccgaaccgggtgtccacatgagtgcctctcccagcagatccaggtaagaacttcctgaccttcctgagccctaggaggaacacacatggatgccgagtgatggtgagggatccgggtgaaactggag

SEQ ID NO: 106968 - DNA, 144 bp, Homo sapiens; identical to SEQ ID NO: 72144
  misc_feature 1..144: note = chr11:123300811-123300955
  misc_feature 1..144: note = Hyper
  source 1..144: mol_type = genomic DNA

SEQ ID NO: 106969 - DNA, 1104 bp, Homo sapiens
  misc_feature 1..1104: note = chr11:123301015-123302119
  misc_feature 1..1104: note = Hyper
  source 1..1104: mol_type = genomic DNA
ctgcctcttcctcccgctctctacctccctgcagcgccaagccggctccccaacctggtctgctgaacgcaaaccgctgagagtttgctgcaccgccccctggggcccctggctgccgagtcccgctaaggcaaagacgccagcaagcgaggaagcgcagcggaagaaaaacaagcgggcgcgcgaggggagccccaggagggctgccgagtggctggcaggcggctcccgcccctcccgggtggcctcgccggcggctgacggcccggaggacgcgcgctccgaaaagttagactccgggcggcggcgcgctacgccgcgtcccctcgcgtcccttcctcgctgcgctccgggaaaggaacttgttccttcggccccaggattggggagtgtgccgcggggccgagggtggggaacagccagagggagacgcgaaccaggccgctggcggagggctcagggggagcgcagaggcgacggcccccatgccggcggccaacatgatggagaaccggccgctgcccgccctgcaggtgcccgagccgcagggtgcgcccgagggcagcccggtctggtccagttcgtcgacccccacgcttcgccgccggcgcttcaagatgcgccgcatgaagaacgtacaggagcagagcctggaggccgggctggcccgggacctgcccgccgtcttggcccccggcaaggagttcctgcagctgccgtccatcgagatcacgccctccagcgacgaggacaccccgtggtccaactgctccacacccagcgcgtccccgcgccgaaaacgcttcctcctccgcaagtggctgagggtgagggagcggaaggagtgcagtgaaagcaggtacgtccccgttccgcccgtctccttcccttccctcccgtcctctccagagccgtccagggccccggggcattctgggggaaacgtcctgggggagaacaggagcccgtcaccagaggcgcttctggagggcgctgcgcctggtcccagggatggtggcattcagcttccacgcgtgccacccgctccccaactcagggtgaggggcttcatgttgcacgacacgtttacgtggggctttacgc

SEQ ID NO: 106970 - DNA, 74 bp, Homo sapiens; identical to SEQ ID NO: 72147
  misc_feature 1..74: note = chr11:123443648-123443722
  misc_feature 1..74: note = Hypo
  source 1..74: mol_type = genomic DNA

SEQ ID NO: 106971 - DNA, 47 bp, Homo sapiens; identical to SEQ ID NO: 72148
  misc_feature 1..47: note = chr11:123457217-123457264
  misc_feature 1..47: note = Hypo
  source 1..47: mol_type = genomic DNA

SEQ ID NO: 106972 - DNA, 439 bp, Homo sapiens; identical to SEQ ID NO: 72149
  misc_feature 1..439: note = chr11:123524538-123524977
  misc_feature 1..439: note = Hyper
  source 1..439: mol_type = genomic DNA

SEQ ID NO: 106973 - DNA, 79 bp, Homo sapiens; identical to SEQ ID NO: 72150
  misc_feature 1..79: note = chr11:123525394-123525473
  misc_feature 1..79: note = Hyper
  source 1..79: mol_type = genomic DNA

SEQ ID NO: 106974 - DNA, 30 bp, Homo sapiens; identical to SEQ ID NO: 72151
  misc_feature 1..30: note = chr11:123543339-123543369
  misc_feature 1..30: note = Hypo
  source 1..30: mol_type = genomic DNA

SEQ ID NO: 106975 - DNA, 78 bp, Homo sapiens; identical to SEQ ID NO: 72152
  misc_feature 1..78: note = chr11:123885065-123885143
  misc_feature 1..78: note = Hypo
  source 1..78: mol_type = genomic DNA

SEQ ID NO: 106976 - DNA, 30 bp, Homo sapiens; identical to SEQ ID NO: 72158
  misc_feature 1..30: note = chr11:124522134-124522164
  misc_feature 1..30: note = Hypo
  source 1..30: mol_type = genomic DNA

SEQ ID NO: 106977 - DNA, 30 bp, Homo sapiens; identical to SEQ ID NO: 43276
  misc_feature 1..30: note = chr11:124526915-124526945
  misc_feature 1..30: note = Hypo
  source 1..30: mol_type = genomic DNA

SEQ ID NO: 106978 - DNA, 68 bp, Homo sapiens; identical to SEQ ID NO: 72160
  misc_feature 1..68: note = chr11:124588270-124588338
  misc_feature 1..68: note = Hyper
  source 1..68: mol_type = genomic DNA

SEQ ID NO: 106979 - DNA, 163 bp, Homo sapiens
  misc_feature 1..163: note = chr11:124629399-124629562
  misc_feature 1..163: note = Hyper
  source 1..163: mol_type = genomic DNA
ctcggccctctgcctcggagcggaagacgccacctccgcgtggcgagcaggcggccaacgccgcgggaagaggccgcagccaggccccgctctccaccctcgccctaggagagccaggctgaaggcctctaagggctgggagccgatccggccaggatgcaag

SEQ ID NO: 106980 - DNA, 408 bp, Homo sapiens; identical to SEQ ID NO: 72163
  misc_feature 1..408: note = chr11:124631502-124631910
  misc_feature 1..408: note = Hyper
  source 1..408: mol_type = genomic DNA

SEQ ID NO: 106981 - DNA, 30 bp, Homo sapiens; identical to SEQ ID NO: 72164
  misc_feature 1..30: note = chr11:124639029-124639059
  misc_feature 1..30: note = Hypo
  source 1..30: mol_type = genomic DNA

SEQ ID NO: 106982 - DNA, 46 bp, Homo sapiens; identical to SEQ ID NO: 34126
  misc_feature 1..46: note = chr11:124709117-124709163
  misc_feature 1..46: note = Hyper
  source 1..46: mol_type = genomic DNA

SEQ ID NO: 106983 - DNA, 374 bp, Homo sapiens; identical to SEQ ID NO: 72166
  misc_feature 1..374: note = chr11:124709482-124709856
  misc_feature 1..374: note = Hyper
  source 1..374: mol_type = genomic DNA

SEQ ID NO: 106984 - DNA, 156 bp, Homo sapiens; identical to SEQ ID NO: 34128
  misc_feature 1..156: note = chr11:124712781-124712937
  misc_feature 1..156: note = Hyper
  source 1..156: mol_type = genomic DNA

SEQ ID NO: 106985 - DNA, 336 bp, Homo sapiens; identical to SEQ ID NO: 34129
  misc_feature 1..336: note = chr11:124713057-124713393
  misc_feature 1..336: note = Hyper
  source 1..336: mol_type = genomic DNA

SEQ ID NO: 106986 - DNA, 30 bp, Homo sapiens; identical to SEQ ID NO: 72169
  misc_feature 1..30: note = chr11:124733379-124733409
  misc_feature 1..30: note = Hyper
  source 1..30: mol_type = genomic DNA

SEQ ID NO: 106987 - DNA, 1454 bp, Homo sapiens
  misc_feature 1..1454: note = chr11:124735003-124736457
  misc_feature 1..1454: note = Hyper
  source 1..1454: mol_type = genomic DNA
cagaagggcagagtccgacagagcctcgtccctcatcttgggtgctttgagacagggaaaatctctcgccgcgtccagaacggaacgctgggcttggggtgcggggcggggactccaactcgcgcgctacgctactcgtgtctcctgctcggatagtgactgtagaggtaagggtgggagggtggagggaggcggattaatcccttaattacgccgtgatcggcgtggcacctgctttccgcctgcccagctcccaggggactccggcactagggggtggagagaaggacgagggaaggaggagggcacgaagaggcaccgaccgtacccaggcgcaccggcaggagagcggcaccgtggctgccgcagcgcgcagaggctgtggaggggcttacggctcccagcccacgggtctcagacccaggggctgggcccccagcccccagtcccgatcccagctgggtcgagccatgctgcgctacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccaccccggcagagctgtggcgggcgggcggagctggcggcgaggtcgttaccgctaattacggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 106988 - DNA, 579 bp, Homo sapiens; identical to SEQ ID NO: 72172
  misc_feature 1..579: note = chr11:124738445-124739024
  misc_feature 1..579: note = Hyper
  source 1..579: mol_type = genomic DNA

SEQ ID NO: 106989 - DNA, 247 bp, Homo sapiens; identical to SEQ ID NO: 72173
  misc_feature 1..247: note = chr11:124739234-124739481
  misc_feature 1..247: note = Hyper
  source 1..247: mol_type = genomic DNA

SEQ ID NO: 106990 - DNA, 151 bp, Homo sapiens; identical to SEQ ID NO: 72174
  misc_feature 1..151: note = chr11:124743216-124743367
  misc_feature 1..151: note = Hypo
  source 1..151: mol_type = genomic DNA

SEQ ID NO: 106991 - DNA, 145 bp, Homo sapiens
  misc_feature 1..145: note = chr11:124790908-124791053
  misc_feature 1..145: note = Hyper
  source 1..145: mol_type = genomic DNA
acaccagcgcccccccgggacctcccctcgtccccagcgcgccgcgcccgggcttcccagccccagctttcccccgggccactggccgcagaccgcgggcgcctctcaggggatcccgaggcggctcaggcgctgatctccaccg

SEQ ID NO: 106992 - DNA, 39 bp, Homo sapiens; identical to SEQ ID NO: 72176
  misc_feature 1..39: note = chr11:124791254-124791293
  misc_feature 1..39: note = Hyper
  source 1..39: mol_type = genomic DNA

SEQ ID NO: 106993 - DNA, 315 bp, Homo sapiens; identical to SEQ ID NO: 72177
  misc_feature 1..315: note = chr11:124933396-124933711
  misc_feature 1..315: note = Hyper
  source 1..315: mol_type = genomic DNA

SEQ ID NO: 106994 - DNA, 140 bp, Homo sapiens; identical to SEQ ID NO: 72179
  misc_feature 1..140: note = chr11:125034165-125034305
  misc_feature 1..140: note = Hyper
  source 1..140: mol_type = genomic DNA

SEQ ID NO: 106995 - DNA, 354 bp, Homo sapiens; identical to SEQ ID NO: 72180
  misc_feature 1..354: note = chr11:125034624-125034978
  misc_feature 1..354: note = Hyper
  source 1..354: mol_type = genomic DNA

SEQ ID NO: 106996 - DNA, 1330 bp, Homo sapiens
  misc_feature 1..1330: note = chr11:125035358-125036688
  misc_feature 1..1330: note = Hyper
  source 1..1330: mol_type = genomic DNA
ggagatgctttccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaaagtttgcatttctttcgggttaggagacgggctttcctggctcccgatccccaggaagaaacgagcgaaatgggccgtcctttcccggggctcttcacgggggagccgggggtttccgcgcggtggggagactcgggttgggaattgaggggtaggggcttgtggatcggcctgaattagggctgggttttaggaccagtctagagttcggtttataggatccagactgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaagcggacagatcgaagagaccttctgggcgaagcggcagggcagcctcgcggggctgggagtggatctgaggtcccgacccaggcggctcggagtgctccaggagccacctgggtctgcgggcgcagcgcggcggggcgggagcggtggcccgcaggggccgcggcctgcgatgaaggccggggggcagcgctagcagcgaggtgccacagtgggccgaggagtctgggctgtggcccagggtaggaccggctcaaactccagtgccctgattggagccgcttcctgtgcttacccgcgccggactgagaagcccacaaacccggcctttggtgcgcccgggggaggaggaag

SEQ ID NO: 106997 - DNA, 52 bp, Homo sapiens; identical to SEQ ID NO: 72183
  misc_feature 1..52: note = chr11:125133192-125133244
  misc_feature 1..52: note = Hyper
  source 1..52: mol_type = genomic DNA

SEQ ID NO: 106998 - DNA, 182 bp, Homo sapiens; identical to SEQ ID NO: 72185
  misc_feature 1..182: note = chr11:125220500-125220682
  misc_feature 1..182: note = Hypo
  source 1..182: mol_type = genomic DNA

SEQ ID NO: 106999 - DNA, 30 bp, Homo sapiens; identical to SEQ ID NO: 72186
  misc_feature 1..30: note = chr11:125221866-125221896
  misc_feature 1..30: note = Hypo
  source 1..30: mol_type = genomic DNA

SEQ ID NO: 107000 - DNA, 182 bp, Homo sapiens; identical to SEQ ID NO: 72187
  misc_feature 1..182: note = chr11:125259900-125260082
  misc_feature 1..182: note = Hypo
  source 1..182: mol_type = genomic DNA

SEQ ID NO: 107001 - DNA, 16 bp, Homo sapiens
  misc_feature 1..16: note = chr11:125271700-125271716
  misc_feature 1..16: note = Hypo
  source 1..16: mol_type = genomic DNA
gcgggcacatgcattc

SEQ ID NO: 107002 - DNA, 42 bp, Homo sapiens; identical to SEQ ID NO: 72190
  misc_feature 1..42: note = chr11:125304472-125304514
  misc_feature 1..42: note = Hypo
  source 1..42: mol_type = genomic DNA

SEQ ID NO: 107003 - DNA, 1267 bp, Homo sapiens; identical to SEQ ID NO: 72191
  misc_feature 1..1267: note = chr11:125365065-125366332
  misc_feature 1..1267: note = Hyper
  source 1..1267: mol_type = genomic DNA

SEQ ID NO: 107004 - DNA, 158 bp, Homo sapiens; identical to SEQ ID NO: 72196
  misc_feature 1..158: note = chr11:125755569-125755727
  misc_feature 1..158: note = Hypo
  source 1..158: mol_type = genomic DNA

SEQ ID NO: 107005 - DNA, 36 bp, Homo sapiens; identical to SEQ ID NO: 72197
  misc_feature 1..36: note = chr11:125757373-125757409
  misc_feature 1..36: note = Hyper
  source 1..36: mol_type = genomic DNA

SEQ ID NO: 107006 - DNA, 31 bp, Homo sapiens; identical to SEQ ID NO: 72198
  misc_feature 1..31: note = chr11:125759609-125759640
  misc_feature 1..31: note = Hypo
  source 1..31: mol_type = genomic DNA

SEQ ID NO: 107007 - DNA, 860 bp, Homo sapiens
  misc_feature 1..860: note = chr11:125773662-125774522
  misc_feature 1..860: note = Hyper
  source 1..860: mol_type = genomic DNA
ggaatttggttctttcgtccaaattgagcggtcattaaatcattagtaccagggatccagggatctataccggattatgcaaacgcatgtaggacgtagaggttataccgaaaggtaatgtttttaacaagagaccacatttcagaataaaagctttaaaaagcctatgtggaacatcacaggtatctagggcaggaacagcagttagagcttgaacagttctgcttcctttccgcaactgtggcattcgaggtcattcgtcatatcaaattcatcagattttgtctccactttgctaaccaattcgctaacctttctgacatcttgtgatgtggaggcggaaatttccagggaaaccgacacggggcgtaaagcgcggcggggagtccggggggctcccgcctggagggctgtgtgagcggcgggccgcggggcggcgcggggggcgctctccactctgcggaagctgccccctctgccctccggtccgcgccctttcgccccgctctctgccctccgccccgctctctgccctccgccccgctctctgccccccgccccgctctctgccctccgccccttccgcgcgccacccagccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggaggcgacgcaggggcggcggagagcgagcggctgaacagccacgtaaccgccaccgagccggggggccacagccgcgggggtggagctcc

SEQ ID NO: 107008 - DNA, 184 bp, Homo sapiens; identical to SEQ ID NO: 72204
  misc_feature 1..184: note = chr11:126083469-126083653
  misc_feature 1..184: note = Hypo
  source 1..184: mol_type = genomic DNA

SEQ ID NO: 107009 - DNA, 94 bp, Homo sapiens; identical to SEQ ID NO: 72205
  misc_feature 1..94: note = chr11:126083885-126083979
  misc_feature 1..94: note = Hypo
  source 1..94: mol_type = genomic DNA

SEQ ID NO: 107010 - DNA, 215 bp, Homo sapiens; identical to SEQ ID NO: 72206
  misc_feature 1..215: note = chr11:126085129-126085344
  misc_feature 1..215: note = Hypo
  source 1..215: mol_type = genomic DNA

SEQ ID NO: 107011 - DNA, 28 bp, Homo sapiens
  misc_feature 1..28: note = chr11:126154206-126154234
  misc_feature 1..28: note = Hypo
  source 1..28: mol_type = genomic DNA
gcgtgaaccactgcgcccagcccttcat

SEQ ID NO: 107012 - DNA, 30 bp, Homo sapiens; identical to SEQ ID NO: 72208
  misc_feature 1..30: note = chr11:126225281-126225311
  misc_feature 1..30: note = Hyper
  source 1..30: mol_type = genomic DNA

SEQ ID NO: 107013 - DNA, 109 bp, Homo sapiens; identical to SEQ ID NO: 72209
  misc_feature 1..109: note = chr11:126226052-126226161
  misc_feature 1..109: note = Hyper
  source 1..109: mol_type = genomic DNA

SEQ ID NO: 107014 - DNA, 231 bp, Homo sapiens; identical to SEQ ID NO: 43282
  misc_feature 1..231: note = chr11:126273042-126273273
  misc_feature 1..231: note = Hypo
  source 1..231: mol_type = genomic DNA

SEQ ID NO: 107015 - DNA, 30 bp, Homo sapiens; identical to SEQ ID NO: 72212
  misc_feature 1..30: note = chr11:126320587-126320617
  misc_feature 1..30: note = Hypo
  source 1..30: mol_type = genomic DNA

SEQ ID NO: 107016 - DNA, 30 bp, Homo sapiens; identical to SEQ ID NO: 72213
  misc_feature 1..30: note = chr11:126713464-126713494
  misc_feature 1..30: note = Hypo
  source 1..30: mol_type = genomic DNA

SEQ ID NO: 107017 - DNA, 30 bp, Homo sapiens; identical to SEQ ID NO: 72214
  misc_feature 1..30: note = chr11:126719627-126719657
  misc_feature 1..30: note = Hypo
  source 1..30: mol_type = genomic DNA

SEQ ID NO: 107018 - DNA, 30 bp, Homo sapiens; identical to SEQ ID NO: 72215
  misc_feature 1..30: note = chr11:126786457-126786487
  misc_feature 1..30: note = Hypo
  source 1..30: mol_type = genomic DNA

SEQ ID NO: 107019 - DNA, 577 bp, Homo sapiens
  misc_feature 1..577: note = chr11:126870174-126870751
  misc_feature 1..577: note = Hyper
  source 1..577: mol_type = genomic DNA
ccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagccggcggggtaacttggctgtggttagtttctcttccttggcggctctcggtgctcagcctccgccggtcctctcgggttcgcgcctaccatctgtccgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaagga

SEQ ID NO: 107020 - DNA, 30 bp, Homo sapiens; identical to SEQ ID NO: 72219
  misc_feature 1..30: note = chr11:126870952-126870982
  misc_feature 1..30: note = Hyper
  source 1..30: mol_type = genomic DNA

SEQ ID NO: 107021 - DNA, 764 bp, Homo sapiens; identical to SEQ ID NO: 34149
  misc_feature 1..764: note = chr11:126873058-126873822
  misc_feature 1..764: note = Hyper
  source 1..764: mol_type = genomic DNA

SEQ ID NO: 107022 - DNA, 30 bp, Homo sapiens; identical to SEQ ID NO: 72223
  misc_feature 1..30: note = chr11:127009561-127009591
  misc_feature 1..30: note = Hypo
  source 1..30: mol_type = genomic DNA

SEQ ID NO: 107023 - DNA, 30 bp, Homo sapiens; identical to SEQ ID NO: 72224
  misc_feature 1..30: note = chr11:127013703-127013733
  misc_feature 1..30: note = Hypo
  source 1..30: mol_type = genomic DNA

SEQ ID NO: 107024 - DNA, 23 bp, Homo sapiens
  misc_feature 1..23: note = chr11:128110182-128110205
  misc_feature 1..23: note = Hypo
  source 1..23: mol_type = genomic DNA
tacaaaaaaattagccgggcctg

SEQ ID NO: 107025 - DNA, 173 bp, Homo sapiens; identical to SEQ ID NO: 72235
  misc_feature 1..173: note = chr11:128419104-128419277
  misc_feature 1..173: note = Hyper
  source 1..173: mol_type = genomic DNA

SEQ ID NO: 107026 - DNA, 124 bp, Homo sapiens; identical to SEQ ID NO: 72236
  misc_feature 1..124: note = chr11:128556976-128557100
  misc_feature 1..124: note = Hyper
  source 1..124: mol_type = genomic DNA

SEQ ID NO: 107027 - DNA, 1055 bp, Homo sapiens
  misc_feature 1..1055: note = chr11:128562763-128563818
  misc_feature 1..1055: note = Hyper
  source 1..1055: mol_type = genomic DNA
aactggggcgcgcggcggcccaggagggaggcggggaggtctccgggttgggccggggaacgccggcctccaggctgggtagggaggacggtccagagcgcgggcctccgggtctcaccccgggaaaagtctgggtctgctctgcgctgttgcgtgctgcgctcctgggacctgctgactgtcctagagggaacgtcccgcggtagtgtcagttccctggggaccaggaagggcgactcttgcctgggagtcagtgcttgggccgtcgggtccgggtaagcgctgggggtttggctcgagaagatgcggataggtggcctagggcgccgcggatctccgccctctgcgggcaccgggagcccagggtcgaggcgcgccgccccgaggggccccttctcctaacaatgcgcccggaatggagtccgcgccctgacagcgcgggtcagcccgaaaccgcccagaatccgcttcgatgagtgggtgagccgctctgggagtctgccgcgtctcggcagcggagggcctgagtggaaaaattcttattggatgcactttttaatggttggtttgcctcggttttcgtccgagtcttccccggcagtaggcgctgggttacccgcagccctagccaactctccctccataccccccctaccccacccccaaaaagtttgtctccggctggaaaaagcattaatgaacgtatctgtgggaagaaacggaaagtgaatgagtcaggagggccaccttcggccaaccgcctcaggaaaagcaaagaagccaaaggtctttggctttggattttgggggaaggtgatggggggaggttcagacttcgggaatcagggcgcggacgctgggcgtggaccccgtcattgttcccggctagctcttatctcccaggagcaagtatcctgtgtgcgcagcgcatgaatgtgtctgggcatctccgcgtatatttatatagtgtgtgatgcgaaaagcaggaccagcaggggaggaagagggggtgtggggggggagggaagacgagggagagcagaggggagagaaga

SEQ ID NO: 107028 - DNA, 1655 bp, Homo sapiens
  misc_feature 1..1655: note = chr11:128563878-128565533
  misc_feature 1..1655: note = Hyper
  source 1..1655: mol_type = genomic DNA
gagagagagataggacttcctccccgattcgcaaagtgaagtcacttcccaaaattagctgaaaaaaaagtttcatccggttaactgtctctttcgctccgctacaacaacaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggtaagcggcggggcaacggacgcgggcggcggggaccggccggggaggcgaagcggcgggcgggtaggtgcggggcccgcgtcccggaagacgtggcctctctcccttccctccgcgccccggcttcgcgccggctcctccggcgctcgggtggcgagtcctactcgcgggccagccggccaggcgcccgcattgagggcgaccctcccccgaaatcccagcccccaaagtggagccccggcccccctcccacctcgctgcccgccggggctgcaggaggggacggcgggaaaccgggggaccccagggtacggaacggagtcaagggcgagagacctcggggtccaccactcccaccgacacccggggctcccgtggccccagcgctaggcactgggcttcctctccgcagaggcggaacacggcgggggcgggggctgcagtcgcccgggctcgggtccctgcctggtgggccctggggtgggtaagtggcctcgttgcacgagggtaggggtgcaagtgagtgtgtcgggggatctatctgagcgggctcctccagatggaagcccctgtttacatgtcagcgctttcccttcctctcggcactcagtcgcccggctctaggcgctggagagccgccggctccgcgggactcctgggccggcctcgccgcctctccggcggggaaccttccccagcccccgtccgcacagatccctagcgccccgagcccccgcccttcgcgcctaggcgtgcgccggctccaggaccagggctcctggagctgtcgcctccgaaagggtcctgcgtccttcggagccgcctccgttgcaggggccggctgtgagcccgcgccccgcgcccgcccggccattcccaccccagccgccgccgccaagcctgggtctaggttgcaaagtgcaacccaggcggaaaggtgagggtttgggttcgcgtctcacttcagaaaagttgactgctgtctctgaaagggttcgccaagtagggccaggagcagagaggagggacaccccctaacgtgacgggccttagaggacctaggggaatgaatgggaccaggggttagcttcgaggctgccgcgcaacaccaagcgggagtctgtctggaaaaactattaggctggcgaggtggggactggcagagcccgccattccccagaacccgaaagaatcgactccctgctcagggctcagcaagagaaggctaagatgttgggctcagagaattcaagagatttttatcttctgggtggggtcgtggtttttattttctaagttttttttatgaaagtttgaaatatgctgacttaggtaaaagacaccaaccgaaggaacttgcaa

SEQ ID NO: 107029 - DNA, 98 bp, Homo sapiens; identical to SEQ ID NO: 72243
  misc_feature 1..98: note = chr11:128634531-128634629
  misc_feature 1..98: note = Hypo
  source 1..98: mol_type = genomic DNA

SEQ ID NO: 107030 - DNA, 34 bp, Homo sapiens; identical to SEQ ID NO: 72244
  misc_feature 1..34: note = chr11:128634871-128634905
  misc_feature 1..34: note = Hypo
  source 1..34: mol_type = genomic DNA

SEQ ID NO: 107031 - DNA, 30 bp, Homo sapiens; identical to SEQ ID NO: 72245
  misc_feature 1..30: note = chr11:128635204-128635234
  misc_feature 1..30: note = Hypo
  source 1..30: mol_type = genomic DNA

SEQ ID NO: 107032 - DNA, 182 bp, Homo sapiens; identical to SEQ ID NO: 72246
  misc_feature 1..182: note = chr11:128647566-128647748
  misc_feature 1..182: note = Hypo
  source 1..182: mol_type = genomic DNA

SEQ ID NO: 107033 - DNA, 180 bp, Homo sapiens; identical to SEQ ID NO: 72247
  misc_feature 1..180: note = chr11:128657932-128658112
  misc_feature 1..180: note = Hypo
  source 1..180: mol_type = genomic DNA

SEQ ID NO: 107034 - DNA, 37 bp, Homo sapiens; identical to SEQ ID NO: 72248
  misc_feature 1..37: note = chr11:128665419-128665456
  misc_feature 1..37: note = Hypo
  source 1..37: mol_type = genomic DNA

SEQ ID NO: 107035 - DNA, 104 bp, Homo sapiens
  misc_feature 1..104: note = chr11:129242303-129242407
  misc_feature 1..104: note = Hyper
  source 1..104: mol_type = genomic DNA
tctagactccaagatcgggcatctctccctctccactgcacaggggacttgtgcccgcagaccccttctgagatttcttgcctctgtagcgcgaaatagaaaag

SEQ ID NO: 107036 - DNA, 991 bp, Homo sapiens
  misc_feature 1..991: note = chr11:129242652-129243643
  misc_feature 1..991: note = Hyper
  source 1..991: mol_type = genomic DNA
ccgcgaccaggaacacgcgaacgcgagtccagacccgggtttggaaaaagggaagaaggagaggaggagaagggaagttaaaaagagagagagaaaacaaggatgaacgatggggagaagggagggcagaagagagaaaacagaagcgggaaattcgacagaggaggagaggcccaaagggcggggagcaatgcggggaagggagaagtgggagggaagaagaggagaggagtcagtggcggtggaaggaaggggaagaaccagagagaagaaaagaggttaaggaaaagaagagcaatgcaaagtcggggccccgaatagtgccgcattctgtgggcacacgccgggcagatagaaagtatagacgcgacgcgctcggcccctcgtcgggcgtcgggtcctggtgctgtcgctcaggtgctggtccccagctccaagcccgcctcgtagtcggcgctgcgggtgagatcgcccgcaagcactcagtttactggcggctgcctaccagcggctcactttcctcggggcgcctaaagctccccgcccggcattgccccgggagcgaacgctgagcccctgggacccagccccgactcggcgcagcggtttccctctcggcttgcgcccgggagaaccccctccgtcgtggcgtcggacggcgatgccagggctgagcggtgagctgtcccgggtcccgcgctttgaccgcggaccagcctcagggtcccgccgcggaagcagggggcgcgcctggggccagcctgtagaccccagagtccggcggcaggacccccggcgccacccggacacctggcagcagttctcgcctgccctgcagccgcctctgcatggagaaagagaatgaaagaaaacaattctagatggagaggaggggaggggaggccagtttgcaaatacttcgggaatgaagttcctcaaagacgcgttgcgggccttgtctaatgctaggctgtgacttggcctcttaaca

SEQ ID NO: 107037 - DNA, 720 bp, Homo sapiens
  misc_feature 1..720: note = chr11:129243943-129244663
  misc_feature 1..720: note = Hyper
  source 1..720: mol_type = genomic DNA
ctaacagcctaatgattagtcctctgggcgtgtccctccctcctagtttaatcaccggcccaggcgccctcatttacttgcttccgcggccaccagggccccctgggcaagcagctccgcagagagcccgccggcactcgcggacgcttctaggctgggagcggggaggaaatgtcaccggccccaaactcggccctagggaaggccatccgcgtctatacttctcagtgtccctgtcgtgcgttttccttccaaccccatgcacactcattccaacataaagtcgtggaaacgggcgtgcactgggctgttcccgccgaacaccgggcgcgactcaggctgccggaggcttcccgggcgcggaggctcggcggggtcccctttacgcagcaattccaatgaacaactaaagtccgtacagattttgattggaacagaccctaagactaagagcctggaaagaaaaaggcaaatcacccaataaacgcctgtcttcgcgactctctaacccggtcgtatcgcgagggatccggatattgaaagcccctttgccggaagactcgggcgctgggagaagcccgcatgggacaggctgccccagtgcccgccggctccctagaatcgtgcagctctgaccctttccaacgaggaaaaaatgtttttataaacaatgttttaaaaaaaaccgcacacttttttaaaaagtcagaatctcgctct

SEQ ID NO: 107038 - DNA, 127 bp, Homo sapiens; identical to SEQ ID NO: 72253
  misc_feature 1..127: note = chr11:129245832-129245959
  misc_feature 1..127: note = Hyper
  source 1..127: mol_type = genomic DNA

SEQ ID NO: 107039 - DNA, 206 bp, Homo sapiens; identical to SEQ ID NO: 34162
  misc_feature 1..206: note = chr11:129565510-129565716
  misc_feature 1..206: note = Hyper
  source 1..206: mol_type = genomic DNA

SEQ ID NO: 107040 - DNA, 32 bp, Homo sapiens; identical to SEQ ID NO: 72255
  misc_feature 1..32: note = chr11:129685906-129685938
  misc_feature 1..32: note = Hyper
  source 1..32: mol_type = genomic DNA

SEQ ID NO: 107041 - DNA, 30 bp, Homo sapiens; identical to SEQ ID NO: 72256
  misc_feature 1..30: note = chr11:129732116-129732146
  misc_feature 1..30: note = Hypo
  source 1..30: mol_type = genomic DNA

SEQ ID NO: 107042 - DNA, 66 bp, Homo sapiens; identical to SEQ ID NO: 43284
  misc_feature 1..66: note = chr11:129866993-129867059
  misc_feature 1..66: note = Hypo
  source 1..66: mol_type = genomic DNA

SEQ ID NO: 107043 - DNA, 40 bp, Homo sapiens; identical to SEQ ID NO: 72258
  misc_feature 1..40: note = chr11:129907763-129907803
  misc_feature 1..40: note = Hypo
  source 1..40: mol_type = genomic DNA

SEQ ID NO: 107044 - DNA, 207 bp, Homo sapiens; identical to SEQ ID NO: 72259
  misc_feature 1..207: note = chr11:129993552-129993759
  misc_feature 1..207: note = Hypo
  source 1..207: mol_type = genomic DNA

SEQ ID NO: 107045 - DNA, 120 bp, Homo sapiens; identical to SEQ ID NO: 72260
  misc_feature 1..120: note = chr11:130017420-130017540
  misc_feature 1..120: note = Hypo
  source 1..120: mol_type = genomic DNA

SEQ ID NO: 107046 - DNA, 55 bp, Homo sapiens; identical to SEQ ID NO: 72261
  misc_feature 1..55: note = chr11:130058066-130058121
  misc_feature 1..55: note = Hypo
  source 1..55: mol_type = genomic DNA

SEQ ID NO: 107047 - DNA, 120 bp, Homo sapiens; identical to SEQ ID NO: 72262
  misc_feature 1..120: note = chr11:130059618-130059738
  misc_feature 1..120: note = Hypo
  source 1..120: mol_type = genomic DNA

SEQ ID NO: 107048 - DNA, 149 bp, Homo sapiens; identical to SEQ ID NO: 72263
  misc_feature 1..149: note = chr11:130060258-130060407
  misc_feature 1..149: note = Hypo
  source 1..149: mol_type = genomic DNA

SEQ ID NO: 107049 - DNA, 60 bp, Homo sapiens; identical to SEQ ID NO: 72264
  misc_feature 1..60: note = chr11:130079328-130079388
  misc_feature 1..60: note = Hypo
  source 1..60: mol_type = genomic DNA

SEQ ID NO: 107050 - DNA, 51 bp, Homo sapiens; identical to SEQ ID NO: 72265
  misc_feature 1..51: note = chr11:130089830-130089881
  misc_feature 1..51: note = Hypo
  source 1..51: mol_type = genomic DNA

SEQ ID NO: 107051 - DNA, 30 bp, Homo sapiens; identical to SEQ ID NO: 43287
  misc_feature 1..30: note = chr11:130090184-130090214
  misc_feature 1..30: note = Hypo
  source 1..30: mol_type = genomic DNA

SEQ ID NO: 107052 - DNA, 24 bp, Homo sapiens
  misc_feature 1..24: note = chr11:130242942-130242966
  misc_feature 1..24: note = Hypo
  source 1..24: mol_type = genomic DNA
tacaaaggacagatgcgtgaatta

SEQ ID NO: 107053 - DNA, 39 bp, Homo sapiens; identical to SEQ ID NO: 72268
  misc_feature 1..39: note = chr11:130285847-130285886
  misc_feature 1..39: note = Hypo
  source 1..39: mol_type = genomic DNA

SEQ ID NO: 107054 - DNA, 30 bp, Homo sapiens; identical to SEQ ID NO: 72269
  misc_feature 1..30: note = chr11:130286135-130286165
  misc_feature 1..30: note = Hypo
  source 1..30: mol_type = genomic DNA

SEQ ID NO: 107055 - DNA, 1034 bp, Homo sapiens
  misc_feature 1..1034: note = chr11:130297386-130298420
  misc_feature 1..1034: note = Hyper
  source 1..1034: mol_type = genomic DNA
gggagattttagagacgctgggaggcgtctggggggcctccgggcacggcggctggaggaggctctcagtcctacctgcaggtcggccccgtagaaggcagccatggacgcatcggccaccagcagcgtctccacgaagcgcgcctcagacacaaaccgcttggtcctactcgtggcccccaggggcggtggcggctcgctagcgccttctgcctcctcttcttggctctcctcctcgctgtcctcctggtggtctcctctctcctgcctctgaccctctcccgtctccacctcccactcgggtcctcgcgggagggggcgggctccggcgggaccccagcgctgcaggcggtgcggctgagccagggagccccccgcgccctgcggctggatggtgaactcctcgccgtccagcaggaaggagccgctcagcccgcggcacaggctgaccgccgccagcgactcgggctccccattcacggtgccggagaagaagcagccgcgcagcccccgctcgcccccggtcgcccggccggagcccccgaggcgctcgatcttgaactcgggcgctaggaagctgtcgtcgggcgccaggcgcagcacgaagcccttgccgaaggcggacaggtggagcgcgagctcgcccgcgctgccgggcaaccgcgtgggcaccaccagctccgaggcctgccccccggctgcgggccgggccggggcgccgcgggccagcggcagcagcagcagcagcagcagcaggagcggaggccaccggggggcggcgggggcggggagcatgggggctgcggcggtggctgcgcgcaggagagggaagaagcccgccaggcgcgggcaggtgctggcggcccgagcgcggcccggccgctctctccaggaaaagcggaatcaatcgggtgcaaggccgactcggcccgcggggcccggcggcgggagcgctcccccggcggcccctctggctggcgcagcccgctcctcccgcgccgccgcccccgagccgagcgcgagcagctggcccc

SEQ ID NO: 107056 - DNA, 932 bp, Homo sapiens; identical to SEQ ID NO: 72273
  misc_feature 1..932: note = chr11:130318226-130319158
  misc_feature 1..932: note = Hyper
  source 1..932: mol_type = genomic DNA

SEQ ID NO: 107057 - DNA, 116 bp, Homo sapiens; identical to SEQ ID NO: 72274
  misc_feature 1..116: note = chr11:130319517-130319633
  misc_feature 1..116: note = Hyper
  source 1..116: mol_type = genomic DNA

SEQ ID NO: 107058 - DNA, 192 bp, Homo sapiens; identical to SEQ ID NO: 72279
  misc_feature 1..192: note = chr11:130515653-130515845
  misc_feature 1..192: note = Hypo
  source 1..192: mol_type = genomic DNA

SEQ ID NO: 107059 - DNA, 30 bp, Homo sapiens; identical to SEQ ID NO: 15616
  misc_feature 1..30: note = chr11:130717573-130717603
  misc_feature 1..30: note = Hypo
  source 1..30: mol_type = genomic DNA

SEQ ID NO: 107060 - DNA, 226 bp, Homo sapiens; identical to SEQ ID NO: 43290
  misc_feature 1..226: note = chr11:130785458-130785684
  misc_feature 1..226: note = Hypo
  source 1..226: mol_type = genomic DNA

SEQ ID NO: 107061 - DNA, 48 bp, Homo sapiens; identical to SEQ ID NO: 72282
  misc_feature 1..48: note = chr11:131068439-131068487
  misc_feature 1..48: note = Hypo
  source 1..48: mol_type = genomic DNA

SEQ ID NO: 107062 - DNA, 30 bp, Homo sapiens; identical to SEQ ID NO: 72283
  misc_feature 1..30: note = chr11:131422789-131422819
  misc_feature 1..30: note = Hypo
  source 1..30: mol_type = genomic DNA

SEQ ID NO: 107063 - DNA, 112 bp, Homo sapiens; identical to SEQ ID NO: 43291
  misc_feature 1..112: note = chr11:131522754-131522866
  misc_feature 1..112: note = Hypo
  source 1..112: mol_type = genomic DNA

SEQ ID NO: 107064 - DNA, 30 bp, Homo sapiens; identical to SEQ ID NO: 72285
  misc_feature 1..30: note = chr11:131542213-131542243
  misc_feature 1..30: note = Hypo
  source 1..30: mol_type = genomic DNA

SEQ ID NO: 107065 - DNA, 64 bp, Homo sapiens; identical to SEQ ID NO: 72286
  misc_feature 1..64: note = chr11:131558038-131558102
  misc_feature 1..64: note = Hyper
  source 1..64: mol_type = genomic DNA

SEQ ID NO: 107066 - DNA, 39 bp, Homo sapiens; identical to SEQ ID NO: 72287
  misc_feature 1..39: note = chr11:131564961-131565000
  misc_feature 1..39: note = Hyper
  source 1..39: mol_type = genomic DNA

SEQ ID NO: 107067 - DNA, 169 bp, Homo sapiens; identical to SEQ ID NO: 43292
  misc_feature 1..169: note = chr11:131631013-131631182
  misc_feature 1..169: note = Hypo
  source 1..169: mol_type = genomic DNA

SEQ ID NO: 107068 - DNA, 88 bp, Homo sapiens; identical to SEQ ID NO: 72289
  misc_feature 1..88: note = chr11:131766898-131766986
  misc_feature 1..88: note = Hypo
  source 1..88: mol_type = genomic DNA

SEQ ID NO: 107069 - DNA, 1075 bp, Homo sapiens
  misc_feature 1..1075: note = chr11:131780260-131781335
  misc_feature 1..1075: note = Hyper
  source 1..1075: mol_type = genomic DNA
ttcctaatttggaagcgcgtaaatggttaaactcctggcctgggctgggctggtgcacagcctgggcccggcgcggcgggggttaaggtgggcgcccgcgccccgcgccccgcgccctcccgccgggatgagagcgcagtccgcgccgccagcccgcccgctcgctccgaggcggcaccgggagaaagtggcggtcagggatggagctgctgccatgacaaccccggcggtcggggcccgcgcgcgtcggggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgcc

SEQ ID NO: 107070 - DNA, 30 bp, Homo sapiens
  misc_feature 1..30: note = chr11:131781572-131781602
  misc_feature 1..30: note = Hyper
  source 1..30: mol_type = genomic DNA
tggtttgtatggggtcggggtaaggggcag

SEQ ID NO: 107071 - DNA, 153 bp, Homo sapiens; identical to SEQ ID NO: 72294
  misc_feature 1..153: note = chr11:131799626-131799779
  misc_feature 1..153: note = Hypo
  source 1..153: mol_type = genomic DNA

SEQ ID NO: 107072 - DNA, 30 bp, Homo sapiens; identical to SEQ ID NO: 72295
  misc_feature 1..30: note = chr11:131996346-131996376
  misc_feature 1..30: note = Hyper
  source 1..30: mol_type = genomic DNA

SEQ ID NO: 107073 - DNA, 30 bp, Homo sapiens; identical to SEQ ID NO: 72296
  misc_feature 1..30: note = chr11:132031455-132031485
  misc_feature 1..30: note = Hypo
  source 1..30: mol_type = genomic DNA

SEQ ID NO: 107074 - DNA, 32 bp, Homo sapiens; identical to SEQ ID NO: 72297
  misc_feature 1..32: note = chr11:132311339-132311371
  misc_feature 1..32: note = Hypo
  source 1..32: mol_type = genomic DNA

SEQ ID NO: 107075 - DNA, 48 bp, Homo sapiens; identical to SEQ ID NO: 43295
  misc_feature 1..48: note = chr11:132484374-132484422
  misc_feature 1..48: note = Hypo
  source 1..48: mol_type = genomic DNA

SEQ ID NO: 107076 - DNA, 30 bp, Homo sapiens; identical to SEQ ID NO: 43296
  misc_feature 1..30: note = chr11:132792371-132792401
  misc_feature 1..30: note = Hypo
  source 1..30: mol_type = genomic DNA

SEQ ID NO: 107077 - DNA, 630 bp, Homo sapiens
  misc_feature 1..630: note = chr11:132813619-132814249
  misc_feature 1..630: note = Hyper
  source 1..630: mol_type = genomic DNA
ccggtcggcgactcgcggccagccgggggagcgccgcccggcgcaggctccgggcgcacggggagctgggcggacggcggcccccgcctcctccggggacgcggcacgagacgcggggacgcgcggacgccacgctcagcggccgcccccggcctccgcgccgccttcctcccgggagcagccccgacgcgcgcgggcccggaccgccggggttgtcatggcagcagctccatccctgaccgccactttctcccggtgccgcctcggagcgagcgggctggcgggcggcgcggactgcgcgctcatcccgacgggcgggcgcccaccttaacctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaaaccccgccctggagagctgaactaccctgcccacgccagatggggcac

SEQ ID NO: 107078 - DNA, 141 bp, Homo sapiens; identical to SEQ ID NO: 72302
  misc_feature 1..141: note = chr11:132864068-132864209
  misc_feature 1..141: note = Hyper
  source 1..141: mol_type = genomic DNA

SEQ ID NO: 107079 - DNA, 30 bp, Homo sapiens; identical to SEQ ID NO: 72303
  misc_feature 1..30: note = chr11:132933115-132933145
  misc_feature 1..30: note = Hypo
  source 1..30: mol_type = genomic DNA

SEQ ID NO: 107080 - DNA, 564 bp, Homo sapiens
  misc_feature 1..564: note = chr11:132934044-132934608
  misc_feature 1..564: note = Hyper
  source 1..564: mol_type = genomic DNA
gagtgaggggtggagcggagcccagccgagggagggaaggagaggaacgccggcccactagccgaccccagcgcaacccagcgcggttcccagacgctgccgggtaactgatgccgccggcacagcttctgttctcacttgtggagctttgtctcccctcgctgggcagcccctggtaccgcaacccgcctggccgccttcccggctgaggcccccgggcagagctcctccgcagggagcattcccgtggacaaacacccctttccctggtagctgtggcaacagttgatctgtggcagcggaccaggaggagggtcaaatgggagaagggacggccagctggtcctaccagagactgtcgctggcgtcctcaggggccgctgcagggccaccttgtgtgcttgccctttccccacggtagactgccccgggagggggactgtgctgcctgaattcttgtccgggtgggactggcctcggtgaaggatccgggaatgggacttccgggccgggccggaggggaagtgtcaggaagagctcaggctttagcgagcctggagggaa

SEQ ID NO: 107081 - DNA, 497 bp, Homo sapiens; identical to SEQ ID NO: 72306
  misc_feature 1..497: note = chr11:132952506-132953003
  misc_feature 1..497: note = Hyper
  source 1..497: mol_type = genomic DNA

SEQ ID NO: 107082 - DNA, 257 bp, Homo sapiens
  misc_feature 1..257: note = chr11:132953063-132953320
  misc_feature 1..257: note = Hyper
  source 1..257: mol_type = genomic DNA
gccgagcgggccgcacagtcactggggcgccgctcgctttgctgcctttcccgcgggtgcactgagcggcgggagcgggagccgcgggctttgcctgagccgggcgcgcgctgtggtctcactcccagacccgacccctctgagctgcccctctccgaggccccgcgaccgcatgcgtgtgtgctcccactgccccagcctgagtcccggatactggtgcccctgtctcgggtcgctggctgcggagagggctggcc

SEQ ID NO: 107083 - DNA, 194 bp, Homo sapiens; identical to SEQ ID NO: 72309
  misc_feature 1..194: note = chr11:133231266-133231460
  misc_feature 1..194: note = Hypo
  source 1..194: mol_type = genomic DNA

SEQ ID NO: 107084 - DNA, 104 bp, Homo sapiens; identical to SEQ ID NO: 15619
  misc_feature 1..104: note = chr11:133231728-133231832
  misc_feature 1..104: note = Hypo
  source 1..104: mol_type = genomic DNA

SEQ ID NO: 107085 - DNA, 101 bp, Homo sapiens; identical to SEQ ID NO: 72311
  misc_feature 1..101: note = chr11:133309666-133309767
  misc_feature 1..101: note = Hypo
  source 1..101: mol_type = genomic DNA

SEQ ID NO: 107086 - DNA, 30 bp, Homo sapiens; identical to SEQ ID NO: 72312
  misc_feature 1..30: note = chr11:133374504-133374534
  misc_feature 1..30: note = Hypo
  source 1..30: mol_type = genomic DNA

SEQ ID NO: 107087 - DNA, 192 bp, Homo sapiens; identical to SEQ ID NO: 43298
  misc_feature 1..192: note = chr11:133386010-133386202
  misc_feature 1..192: note = Hypo
  source 1..192: mol_type = genomic DNA

SEQ ID NO: 107088 - DNA, 303 bp, Homo sapiens; identical to SEQ ID NO: 72314
  misc_feature 1..303: note = chr11:133401987-133402290
  misc_feature 1..303: note = Hyper
  source 1..303: mol_type = genomic DNA

SEQ ID NO: 107089 - DNA, 37 bp, Homo sapiens; identical to SEQ ID NO: 72315
  misc_feature 1..37: note = chr11:133519102-133519139
  misc_feature 1..37: note = Hypo
  source 1..37: mol_type = genomic DNA

SEQ ID NO: 107090 - DNA, 33 bp, Homo sapiens; identical to SEQ ID NO: 72316
  misc_feature 1..33: note = chr11:133559539-133559572
  misc_feature 1..33: note = Hypo
  source 1..33: mol_type = genomic DNA

SEQ ID NO: 107091 - DNA, 30 bp, Homo sapiens; identical to SEQ ID NO: 72317
  misc_feature 1..30: note = chr11:133703684-133703714
  misc_feature 1..30: note = Hypo
  source 1..30: mol_type = genomic DNA

SEQ ID NO: 107092 - DNA, 30 bp, Homo sapiens; identical to SEQ ID NO: 72318
  misc_feature 1..30: note = chr11:133773053-133773083
  misc_feature 1..30: note = Hypo
  source 1..30: mol_type = genomic DNA

SEQ ID NO: 107093 - DNA, 62 bp, Homo sapiens; identical to SEQ ID NO: 72319
  misc_feature 1..62: note = chr11:133777783-133777845
  misc_feature 1..62: note = Hypo
  source 1..62: mol_type = genomic DNA

SEQ ID NO: 107094 - DNA, 90 bp, Homo sapiens; identical to SEQ ID NO: 72320
  misc_feature 1..90: note = chr11:133790279-133790369
  misc_feature 1..90: note = Hypo
  source 1..90: mol_type = genomic DNA

SEQ ID NO: 107095 - DNA, 30 bp, Homo sapiens; identical to SEQ ID NO: 43299
  misc_feature 1..30: note = chr11:133805206-133805236
  misc_feature 1..30: note = Hypo
  source 1..30: mol_type = genomic DNA

SEQ ID NO: 107096 - DNA, 2251 bp, Homo sapiens
  misc_feature 1..2251: note = chr11:133825189-133827440
  misc_feature 1..2251: note = Hyper
  source 1..2251: mol_type = genomic DNA
gaagagttttaaaaccgtccggaccaacatgtcagttaacaaaatcacccttcgcttcgccctctgctcgttctgttttcagacaccaccacccccctcagaagcagaggcgacatattcattccattccggaaagtttcctgaagcacgcccccctgcacagacgagtgacgaggggaccccgtgagaggcgcctccagcccacccggcgccccatgccgctgggagagggttctctgtcggcgagtcctgcctgctgactcccacccacagcgggttctctcccgccgccatctcctccggcttggtgaacttgcccgcagccgggtcgtgtctgcgcgctgacagccctgagctcacagtcctggcaccctccaggctccgctcccacttccatacaagggccgagagccgggggtgccacccagaggcttgtaggtcgctctgcccatctccaaagcaaaagcccgcgcgctcacgcacgcatcacccaactcggtggctccccccttgcgtctcccccagctcagacccaggaaagcggaaagagaaaatcccccctccgctcggattcacagcgtggggacccccccttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctctgggaggcggccgccgggcaggaggcgacgggctaggcgcgccggtgtgcaccgtggggcccgtggtgggcgaagtcgacccaggttccactgcgtcctttccccgagtgcccggcagcccgtgggctctggccccttcccgcccgcccctccagcccacggcccccaggccctccccggcaatgctcccgggccgcctggcccgcgtcggagcccaagcctcacccgcgggaaggcgcgccggggagctggggaaccggggggccaaggagccgggaaaccgaggggccgggcgcgaggggccgagggcgccgggaggggcaggggagggacgccgcacttcaactcaccttcagccgcaagccctcgggtgccgatcacacttgctatgaaagtggccacataccaaatcatagtactaccgcgccagcccggagcctcatcctatcgcaaagtgctcccgcgcccgcacgcgcctcgcgcccgagcgcccgcctcgcgcccgcctcgcgccgcctacgccccgcgccggtgctcctgcagcccgggtggccagctctccatccctcctaggctccgctcggctcggcgcgcgcctccccggccccggcgcagcggcacctgcactactcgcccgggcggagcgcagccaggtccacggtgaagcctagccgggccgggcctccggaaccgcccccgccgcccgcctattgggcgccgcccgcaagccgggggtccgattggctcagccttccgcccgtcgcggcgcgaaggaggcgagcccatttcaaggtgcgttgaagtgtggcgagcacagagccgcagaatcatgcgcattgccggggagaaggtggtatagcgtctctgcccgcttctctctcggctcacactgcgtggcaagtttctggtgagggaaatggtagcttctaacgggaccctggcgggtctcaattaccccggacaggtctgagggaagtggagcccccgcccactcatggaacccaacatccggtttccatccggcaaaaagcagttcccgagaggaccatgctgattctatgatggggaaacccaggagccggcggcccgggagagccggggaacgtccttcgccggagatcttttcaaagaggtcacgcgccgcctccccaccccgtctccctccgcacccagacacgtccccagagcagcgcaccaccccctcc

SEQ ID NO: 107097 - DNA, 173 bp, Homo sapiens; identical to SEQ ID NO: 72326
  misc_feature 1..173: note = chr11:133845226-133845399
  misc_feature 1..173: note = Hypo
  source 1..173: mol_type = genomic DNA

SEQ ID NO: 107098 - DNA, 408 bp, Homo sapiens; identical to SEQ ID NO: 72327
  misc_feature 1..408: note = chr11:133906570-133906978
  misc_feature 1..408: note = Hyper
  source 1..408: mol_type = genomic DNA

SEQ ID NO: 107099 - DNA, 30 bp, Homo sapiens; identical to SEQ ID NO: 72328
  misc_feature 1..30: note = chr11:133912264-133912294
  misc_feature 1..30: note = Hypo
  source 1..30: mol_type = genomic DNA

SEQ ID NO: 107100 - DNA, 665 bp, Homo sapiens
  misc_feature 1..665: note = chr11:133938772-133939437
  misc_feature 1..665: note = Hyper
  source 1..665: mol_type = genomic DNA
agagaacccatgtgccggtccagagcatcgctgcatccgtaagcagctagacctcagcttcctctgtcaccatggtgccggctcggctgggcccggcggtcgccatggtaactggggcgggtcgcagggtcctggcaggctgggcgcatgcgcgcggggactacaagccgcgccgcgctgccgctggcccctcagcaaccctcgacatggcgctgaggcggccaccgcgactccggctctgcgctcggctgcctgacttcttcctgctgctgcttttcaggggtgagtttgcgcgtttccgctgttgggagactagggtctgggggcgacggaagcagagcgggccgaagctgctggagccggtccgggcgaggatagcggtcctggctccgagggctcccggggtcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctg

SEQ ID NO: 107101 - DNA, 50 bp, Homo sapiens; identical to SEQ ID NO: 34187
  misc_feature 1..50: note = chr11:133994694-133994744
  misc_feature 1..50: note = Hyper
  source 1..50: mol_type = genomic DNA

SEQ ID NO: 107102 - DNA, 61 bp, Homo sapiens; identical to SEQ ID NO: 72333
  misc_feature 1..61: note = chr11:133995063-133995124
  misc_feature 1..61: note = Hyper
  source 1..61: mol_type = genomic DNA

SEQ ID NO: 107103 - DNA, 219 bp, Homo sapiens; identical to SEQ ID NO: 43300
  misc_feature 1..219: note = chr11:134011075-134011294
  misc_feature 1..219: note = Hypo
  source 1..219: mol_type = genomic DNA

SEQ ID NO: 107104 - DNA, 130 bp, Homo sapiens; identical to SEQ ID NO: 72335
  misc_feature 1..130: note = chr11:134011733-134011863
  misc_feature 1..130: note = Hypo
  source 1..130: mol_type = genomic DNA

SEQ ID NO: 107105 - DNA, 1622 bp, Homo sapiens
  misc_feature 1..1622: note = chr11:134145474-134147096
  misc_feature 1..1622: note = Hyper
  source 1..1622: mol_type = genomic DNA
ctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctcttgcgctcagttctccggagctgccggtttaacctcgcaagtcttcccggaacccgtgccctcctcctgggcagcgttaccaccacgagcgcctacctgagaggacgcctgttctcatccagcctccaccctgcagccgagcaatctccgtaaaacgaacacctggcttagtttctgctggaaaccgttgaatagtccccactgtcttctggaagggtctgggcagctcggcgtggcgtccacggccccaccaggcctctgcctcctgcaggtcccgctacttcgtcaccaaagcgcccgccgcgctcgcatctgctgtgaggctgtgctcgggccgctcccgccgagggaacggccctcccaaggctctgcgccccaattctcgctcgtttgccaagaggtagccgtgtcggggagctagagttctccggggactctctcctgcccctcgtggccctctgtggaaccctcgttttaggatctgcacgccgtttccagtcgcgcgcgcggcacggagaccgcccgctgtgccccgcgctgcgctctctccgcccctctcccgcgcaggcctccctgtgccagccggctgtcgacccaggttaggaagcccgaggtcggggcgttaccccaagggccctcccgcttcccctccgagggcagagaggcgtccgcgcccggacgcactgcgggaacacctggagcgccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcaggtgacggatcgccgctgccgtcccgggctgcccaccaccccggcgcgtgcccgggagcctccaccctccccgggttctgtggccggccacgcgccccaggcacgcgccgcgccgggccgcgccaccaagcccgctgtccccagctttcctcggcagatcccctggctacccccaccctgcggaggggccgttcaccagatgccagaaaatcagggtggggcacgcaggccaggggctccagcggctgggcaccgtgtccttcccgaacctggtgctggaagtgcgcccgcctccgcctctcccaggcacccaccggcactgcccagccctgtctggagggtctaggactgaacgtctgtccccggccttcatcctggctgcagaggactggccgggtgatgccgcgctgtcctggccctgggcccgcctggaagacccg

SEQ ID NO: 107106 - DNA, 118 bp, Homo sapiens; identical to SEQ ID NO: 72339
  misc_feature 1..118: note = chr11:134201431-134201549
  misc_feature 1..118: note = Hyper
  source 1..118: mol_type = genomic DNA

SEQ ID NO: 107107 - DNA, 364 bp, Homo sapiens; identical to SEQ ID NO: 72340
  misc_feature 1..364: note = chr11:134201790-134202154
  misc_feature 1..364: note = Hyper
  source 1..364: mol_type = genomic DNA

SEQ ID NO: 107108 - DNA, 38 bp, Homo sapiens; identical to SEQ ID NO: 72341
  misc_feature 1..38: note = chr11:134274891-134274929
  misc_feature 1..38: note = Hypo
  source 1..38: mol_type = genomic DNA

SEQ ID NO: 107109 - DNA, 208 bp, Homo sapiens; identical to SEQ ID NO: 72342
  misc_feature 1..208: note = chr11:134281335-134281543
  misc_feature 1..208: note = Hyper
  source 1..208: mol_type = genomic DNA

SEQ ID NO: 107110 - DNA, 207 bp, Homo sapiens
  misc_feature 1..207: note = chr11:134281603-134281810
  misc_feature 1..207: note = Hyper
  source 1..207: mol_type = genomic DNA
gcgcgcgcccgggaggacatggcgtgggcaccgatggggacgcagaaaggggctctgtgcgcggcggggcgcccgcgggggcgcggggagcactgacctgcggcgacgagtccggagcgtctccggtgcggtccatcgcgggcaacggcccctacgccccggccccggcgcccctagaccgctgccctgggccgcgtgcggctccct

SEQ ID NO: 107111 - DNA, 30 bp, Homo sapiens; identical to SEQ ID NO: 72345
  misc_feature 1..30: note = chr11:134282306-134282336
  misc_feature 1..30: note = Hyper
  source 1..30: mol_type = genomic DNA

SEQ ID NO: 107112 - DNA, 82 bp, Homo sapiens; identical to SEQ ID NO: 72346
  misc_feature 1..82: note = chr11:134282850-134282932
  misc_feature 1..82: note = Hyper
  source 1..82: mol_type = genomic DNA

SEQ ID NO: 107113 - DNA, 69 bp, Homo sapiens; identical to SEQ ID NO: 72347
  misc_feature 1..69: note = chr11:134395375-134395444
  misc_feature 1..69: note = Hypo
  source 1..69: mol_type = genomic DNA

SEQ ID NO: 107114 - DNA, 202 bp, Homo sapiens; identical to SEQ ID NO: 72348
  misc_feature 1..202: note = chr11:134458477-134458679
  misc_feature 1..202: note = Hypo
  source 1..202: mol_type = genomic DNA

SEQ ID NO: 107115 - DNA, 32 bp, Homo sapiens; identical to SEQ ID NO: 72349
  misc_feature 1..32: note = chr11:134526234-134526266
  misc_feature 1..32: note = Hypo
  source 1..32: mol_type = genomic DNA

SEQ ID NO: 107116 - DNA, 117 bp, Homo sapiens; identical to SEQ ID NO: 72350
  misc_feature 1..117: note = chr11:134534227-134534344
  misc_feature 1..117: note = Hypo
  source 1..117: mol_type = genomic DNA

SEQ ID NO: 107117 - DNA, 77 bp, Homo sapiens; identical to SEQ ID NO: 72351
  misc_feature 1..77: note = chr11:134607452-134607529
  misc_feature 1..77: note = Hypo
  source 1..77: mol_type = genomic DNA

SEQ ID NO: 107118 - DNA, 200 bp, Homo sapiens; identical to SEQ ID NO: 72352
  misc_feature 1..200: note = chr11:134608540-134608740
  misc_feature 1..200: note = Hypo
  source 1..200: mol_type = genomic DNA

SEQ ID NO: 107119 - DNA, 30 bp, Homo sapiens; identical to SEQ ID NO: 72353
  misc_feature 1..30: note = chr11:134670064-134670094
  misc_feature 1..30: note = Hypo
  source 1..30: mol_type = genomic DNA

SEQ ID NO: 107120 - DNA, 98 bp, Homo sapiens; identical to SEQ ID NO: 72354
  misc_feature 1..98: note = chr11:134909746-134909844
  misc_feature 1..98: note = Hypo
  source 1..98: mol_type = genomic DNA

SEQ ID NO: 107121 - DNA, 366 bp, Homo sapiens; identical to SEQ ID NO: 74522
  misc_feature 1..366: note = chr12:298173-298539
  misc_feature 1..366: note = Hyper
  source 1..366: mol_type = genomic DNA

SEQ ID NO: 107122 - DNA, 139 bp, Homo sapiens; identical to SEQ ID NO: 74530
  misc_feature 1..139: note = chr12:299633-299772
  misc_feature 1..139: note = Hypo
  source 1..139: mol_type = genomic DNA

SEQ ID NO: 107123 - DNA, 90 bp, Homo sapiens; identical to SEQ ID NO: 74532
  misc_feature 1..90: note = chr12:300471-300561
  misc_feature 1..90: note = Hypo
  source 1..90: mol_type = genomic DNA

SEQ ID NO: 107124 - DNA, 30 bp, Homo sapiens; identical to SEQ ID NO: 74560
  misc_feature 1..30: note = chr12:330158-330188
  misc_feature 1..30: note = Hypo
  source 1..30: mol_type = genomic DNA

SEQ ID NO: 107125 - DNA, 243 bp, Homo sapiens; identical to SEQ ID NO: 74971
  misc_feature 1..243: note = chr12:569970-570213
  misc_feature 1..243: note = Hyper
  source 1..243: mol_type = genomic DNA

SEQ ID NO: 107126 - DNA, 71 bp, Homo sapiens; identical to SEQ ID NO: 75110
  misc_feature 1..71: note = chr12:665830-665901
  misc_feature 1..71: note = Hypo
  source 1..71: mol_type = genomic DNA

SEQ ID NO: 107127 - DNA, 35 bp, Homo sapiens; identical to SEQ ID NO: 43307
  misc_feature 1..35: note = chr12:709027-709062
  misc_feature 1..35: note = Hypo
  source 1..35: mol_type = genomic DNA

SEQ ID NO: 107128 - DNA, 95 bp, Homo sapiens; identical to SEQ ID NO: 75171
  misc_feature 1..95: note = chr12:752339-752434
  misc_feature 1..95: note = Hyper
  source 1..95: mol_type = genomic DNA

SEQ ID NO: 107129 - DNA, 30 bp, Homo sapiens; identical to SEQ ID NO: 75298
  misc_feature 1..30: note = chr12:926703-926733
  misc_feature 1..30: note = Hypo
  source 1..30: mol_type = genomic DNA

SEQ ID NO: 107130 - DNA, 31 bp, Homo sapiens; identical to SEQ ID NO: 73680
  misc_feature 1..31: note = chr12:1057793-1057824
  misc_feature 1..31: note = Hypo
  source 1..31: mol_type = genomic DNA

SEQ ID NO: 107131 - DNA, 82 bp, Homo sapiens; identical to SEQ ID NO: 73681
  misc_feature 1..82: note = chr12:1059279-1059361
  misc_feature 1..82: note = Hyper
  source 1..82: mol_type = genomic DNA

SEQ ID NO: 107132 - DNA, 50 bp, Homo sapiens; identical to SEQ ID NO: 73697
  misc_feature 1..50: note = chr12:1073029-1073079
  misc_feature 1..50: note = Hypo
  source 1..50: mol_type = genomic DNA

SEQ ID NO: 107133 - DNA, 86 bp, Homo sapiens; identical to SEQ ID NO: 73705
  misc_feature 1..86: note = chr12:1079112-1079198
  misc_feature 1..86: note = Hypo
  source 1..86: mol_type = genomic DNA

SEQ ID NO: 107134 - DNA, 637 bp, Homo sapiens; identical to SEQ ID NO: 74399
  misc_feature 1..637: note = chr12:1639018-1639655
  misc_feature 1..637: note = Hyper
  source 1..637: mol_type = genomic DNA

SEQ ID NO: 107135 - DNA, 83 bp, Homo sapiens; identical to SEQ ID NO: 74400
  misc_feature 1..83: note = chr12:1639894-1639977
  misc_feature 1..83: note = Hyper
  source 1..83: mol_type = genomic DNA

SEQ ID NO: 107136 - DNA, 155 bp, Homo sapiens; identical to SEQ ID NO: 74401
  misc_feature 1..155: note = chr12:1640321-1640476
  misc_feature 1..155: note = Hyper
  source 1..155: mol_type = genomic DNA

SEQ ID NO: 107137 - DNA, 38 bp, Homo sapiens; identical to SEQ ID NO: 74403
  misc_feature 1..38: note = chr12:1650724-1650762
  misc_feature 1..38: note = Hypo
  source 1..38: mol_type = genomic DNA

SEQ ID NO: 107138 - DNA, 76 bp, Homo sapiens; identical to SEQ ID NO: 43309
  misc_feature 1..76: note = chr12:1651130-1651206
  misc_feature 1..76: note = Hypo
  source 1..76: mol_type = genomic DNA

SEQ ID NO: 107139 - DNA, 160 bp, Homo sapiens; identical to SEQ ID NO: 74408
  misc_feature 1..160: note = chr12:1716717-1716877
  misc_feature 1..160: note = Hypo
  source 1..160: mol_type = genomic DNA

SEQ ID NO: 107140 - DNA, 41 bp, Homo sapiens; identical to SEQ ID NO: 74409
  misc_feature 1..41: note = chr12:1738826-1738867
  misc_feature 1..41: note = Hyper
  source 1..41: mol_type = genomic DNA

SEQ ID NO: 107141 - DNA, 186 bp, Homo sapiens; identical to SEQ ID NO: 74410
  misc_feature 1..186: note = chr12:1739589-1739775
  misc_feature 1..186: note = Hyper
  source 1..186: mol_type = genomic DNA

SEQ ID NO: 107142 - DNA, 66 bp, Homo sapiens; identical to SEQ ID NO: 74411
  misc_feature 1..66: note = chr12:1762161-1762227
  misc_feature 1..66: note = Hyper
  source 1..66: mol_type = genomic DNA

SEQ ID NO: 107143 - DNA, 56 bp, Homo sapiens; identical to SEQ ID NO: 74413
  misc_feature 1..56: note = chr12:1905770-1905826
  misc_feature 1..56: note = Hyper
  source 1..56: mol_type = genomic DNA

SEQ ID NO: 107144 - DNA, 292 bp, Homo sapiens; identical to SEQ ID NO: 74414
  misc_feature 1..292: note = chr12:1906030-1906322
  misc_feature 1..292: note = Hyper
  source 1..292: mol_type = genomic DNA

SEQ ID NO: 107145 - DNA, 30 bp, Homo sapiens; identical to SEQ ID NO: 74415
  misc_feature 1..30: note = chr12:1911756-1911786
  misc_feature 1..30: note = Hypo
  source 1..30: mol_type = genomic DNA

SEQ ID NO: 107146 - DNA, 122 bp, Homo sapiens; identical to SEQ ID NO: 74416
  misc_feature 1..122: note = chr12:1914195-1914317
  misc_feature 1..122: note = Hypo
  source 1..122: mol_type = genomic DNA

SEQ ID NO: 107147 - DNA, 71 bp, Homo sapiens; identical to SEQ ID NO: 74419
  misc_feature 1..71: note = chr12:1937150-1937221
  misc_feature 1..71: note = Hypo
  source 1..71: mol_type = genomic DNA

SEQ ID NO: 107148 - DNA, 42 bp, Homo sapiens; identical to SEQ ID NO: 43311
  misc_feature 1..42: note = chr12:1948142-1948184
  misc_feature 1..42: note = Hypo
  source 1..42: mol_type = genomic DNA

SEQ ID NO: 107149 - DNA, 270 bp, Homo sapiens; identical to SEQ ID NO: 74421
  misc_feature 1..270: note = chr12:1948392-1948662
  misc_feature 1..270: note = Hypo
  source 1..270: mol_type = genomic DNA

SEQ ID NO: 107150 - DNA, 118 bp, Homo sapiens; identical to SEQ ID NO: 74422
  misc_feature 1..118: note = chr12:1951151-1951269
  misc_feature 1..118: note = Hypo
  source 1..118: mol_type = genomic DNA

SEQ ID NO: 107151 - DNA, 80 bp, Homo sapiens; identical to SEQ ID NO: 74423
  misc_feature 1..80: note = chr12:1957154-1957234
  misc_feature 1..80: note = Hypo
  source 1..80: mol_type = genomic DNA

SEQ ID NO: 107152 - DNA, 30 bp, Homo sapiens; identical to SEQ ID NO: 74426
  misc_feature 1..30: note = chr12:1987670-1987700
  misc_feature 1..30: note = Hypo
  source 1..30: mol_type = genomic DNA

SEQ ID NO: 107153 - DNA, 77 bp, Homo sapiens; identical to SEQ ID NO: 74427
  misc_feature 1..77: note = chr12:1990410-1990487
  misc_feature 1..77: note = Hypo
  source 1..77: mol_type = genomic DNA

SEQ ID NO: 107154 - DNA, 113 bp, Homo sapiens; identical to SEQ ID NO: 74428
  misc_feature 1..113: note = chr12:2017761-2017874
  misc_feature 1..113: note = Hypo
  source 1..113: mol_type = genomic DNA

SEQ ID NO: 107155 - DNA, 58 bp, Homo sapiens; identical to SEQ ID NO: 74429
  misc_feature 1..58: note = chr12:2018087-2018145
  misc_feature 1..58: note = Hypo
  source 1..58: mol_type = genomic DNA

SEQ ID NO: 107156 - DNA, 30 bp, Homo sapiens; identical to SEQ ID NO: 74431
  misc_feature 1..30: note = chr12:2022315-2022345
  misc_feature 1..30: note = Hypo
  source 1..30: mol_type = genomic DNA

SEQ ID NO: 107157 - DNA, 162 bp, Homo sapiens; identical to SEQ ID NO: 74432
  misc_feature 1..162: note = chr12:2028903-2029065
  misc_feature 1..162: note = Hypo
  source 1..162: mol_type = genomic DNA

SEQ ID NO: 107158 - DNA, 30 bp, Homo sapiens; identical to SEQ ID NO: 74433
  misc_feature 1..30: note = chr12:2029674-2029704
  misc_feature 1..30: note = Hypo
  source 1..30: mol_type = genomic DNA

SEQ ID NO: 107159 - DNA, 30 bp, Homo sapiens; identical to SEQ ID NO: 74434
  misc_feature 1..30: note = chr12:2036436-2036466
  misc_feature 1..30: note = Hypo
  source 1..30: mol_type = genomic DNA

SEQ ID NO: 107160 - DNA, 49 bp, Homo sapiens; identical to SEQ ID NO: 74435
  misc_feature 1..49: note = chr12:2038007-2038056
  misc_feature 1..49: note = Hypo
  source 1..49: mol_type = genomic DNA

SEQ ID NO: 107161 - DNA, 151 bp, Homo sapiens; identical to SEQ ID NO: 74436
  misc_feature 1..151: note = chr12:2040511-2040662
  misc_feature 1..151: note = Hypo
  source 1..151: mol_type = genomic DNA

SEQ ID NO: 107162 - DNA, 30 bp, Homo sapiens; identical to SEQ ID NO: 43316
  misc_feature 1..30: note = chr12:2046347-2046377
  misc_feature 1..30: note = Hypo
  source 1..30: mol_type = genomic DNA

SEQ ID NO: 107163 - DNA, 81 bp, Homo sapiens; identical to SEQ ID NO: 74443
  misc_feature 1..81: note = chr12:2088757-2088838
  misc_feature 1..81: note = Hypo
  source 1..81: mol_type = genomic DNA

SEQ ID NO: 107164 - DNA, 99 bp, Homo sapiens; identical to SEQ ID NO: 74444
  misc_feature 1..99: note = chr12:2138539-2138638
  misc_feature 1..99: note = Hypo
  source 1..99: mol_type = genomic DNA

SEQ ID NO: 107165 - DNA, 150 bp, Homo sapiens; identical to SEQ ID NO: 74445
  misc_feature 1..150: note = chr12:2144292-2144442
  misc_feature 1..150: note = Hyper
  source 1..150: mol_type = genomic DNA

SEQ ID NO: 107166 - DNA, 2050 bp, Homo sapiens
  misc_feature 1..2050: note = chr12:2161460-2163510
  misc_feature 1..2050: note = Hyper
  source 1..2050: mol_type = genomic DNA
cctcgctgcccctcccgcttcccctcccctcctctatctgtcacttctacaaccgctctgattataattgatcaaacagaatcacggaatcacggctcatcttgccgttttgttcagtggcccgatccgaaacgagactctggtagtcgggcaaattgtattcctcctccttggaattccgctcacagaggccttcccggcgtggccggcccagcagggacgcgccgccgcagcggaggagagaacgcgggcggggggctgcaggccggcgcggggggcgcgacgccgccggcggggcgcgagggggtgtgtccgcgccgcggccaccgcggccaccgcggctggcgcccgggtgcgccgcgcgccccggcctccccgggggctcctcacgccgcccctcgcccgccggcggccggggcccgctccctttgacgtcatgcgggcggagggctcgctcgggcggcgctgccgcgggcgccgggagggggcccgacttcgggctccagtccgccgccgtgcgccccgcgccgtgcgcccggctccctgcgcgccgccgcagccacatctggaagcgttcagcgcgtctgcctccggcgcgccgggcgggcgggcgggcggcgcgggcaggggcgggcgcgggcgcggcggggctgggccggggggagtgagcgcggcgctctcgcgcgcccggtgtctccctctcgctgcctctgcagaaacagctcctgccagagcggcgctcggcgcggcgcggcgggcccggagcggcggcggcggctcttcctgcctccgcgcccaggagttgccggctccctttgacagcagagagccgggcaggggcctcaggaggactcgctgggagtgggcagaggcgcctcggcccctgccggcccaggcgggccccgcgcgccccccgcccctcctctccgcctcttctcgccctgcctctcccgatttattttttcaaatggtgtagccgccggaggtgcggtgctcagttcttggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggtaaggctggaccccgccgcctcgccggggctccctgccttttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccagaggcccggggtccctcgcccggctcggggcgcggctgggagcgcgcgcgcgcgcaccctgcgccggcagagcccggcgcccacggccgcccctggggcgccctcgcgctgcccggcgtccactctcgtccaggcgcccctgccctgggcggcgcgctccaggtggcgggtgggggcggcggtgcagatgtgaagcccagcgcgcccctctggttccccctctgtaggtccccttcttcctctctccctccctcctccgccgctcacctacacccacccacctctccactgctgttgaccccgagcgcgcccacgccgcgtgtgttctcattcgcacccacatgtgg

SEQ ID NO: 107167 - DNA, 40 bp, Homo sapiens; identical to SEQ ID NO: 43318
  misc_feature 1..40: note = chr12:2245461-2245501
  misc_feature 1..40: note = Hypo
  source 1..40: mol_type = genomic DNA

SEQ ID NO: 107168 - DNA, 57 bp, Homo sapiens; identical to SEQ ID NO: 74468
  misc_feature 1..57: note = chr12:2300563-2300620
  misc_feature 1..57: note = Hypo
  source 1..57: mol_type = genomic DNA

SEQ ID NO: 107169 - DNA, 30 bp, Homo sapiens; identical to SEQ ID NO: 74469
  misc_feature 1..30: note = chr12:2403723-2403753
  misc_feature 1..30: note = Hypo
  source 1..30: mol_type = genomic DNA

SEQ ID NO: 107170 - DNA, 30 bp, Homo sapiens; identical to SEQ ID NO: 74470
  misc_feature 1..30: note = chr12:2412108-2412138
  misc_feature 1..30: note = Hypo
  source 1..30: mol_type = genomic DNA

SEQ ID NO: 107171 - DNA, 177 bp, Homo sapiens; identical to SEQ ID NO: 74476
  misc_feature 1..177: note = chr12:2482588-2482765
  misc_feature 1..177: note = Hypo
  source 1..177: mol_type = genomic DNA

SEQ ID NO: 107172 - DNA, 194 bp, Homo sapiens; identical to SEQ ID NO: 5128
  misc_feature 1..194: note = chr12:2566053-2566247
  misc_feature 1..194: note = Hypo
  source 1..194: mol_type = genomic DNA

SEQ ID NO: 107173 - DNA, 30 bp, Homo sapiens; identical to SEQ ID NO: 15624
  misc_feature 1..30: note = chr12:2590465-2590495
  misc_feature 1..30: note = Hypo
  source 1..30: mol_type = genomic DNA

SEQ ID NO: 107174 - DNA, 44 bp, Homo sapiens; identical to SEQ ID NO: 74503
  misc_feature 1..44: note = chr12:2778028-2778072
  misc_feature 1..44: note = Hypo
  source 1..44: mol_type = genomic DNA

SEQ ID NO: 107175 - DNA, 123 bp, Homo sapiens; identical to SEQ ID NO: 74504
  misc_feature 1..123: note = chr12:2783720-2783843
  misc_feature 1..123: note = Hypo
  source 1..123: mol_type = genomic DNA

SEQ ID NO: 107176 - DNA, 52 bp, Homo sapiens; identical to SEQ ID NO: 74505
  misc_feature 1..52: note = chr12:2788862-2788914
  misc_feature 1..52: note = Hypo
  source 1..52: mol_type = genomic DNA

SEQ ID NO: 107177 - DNA, 43 bp, Homo sapiens; identical to SEQ ID NO: 74506
  misc_feature 1..43: note = chr12:2797716-2797759
  misc_feature 1..43: note = Hypo
  source 1..43: mol_type = genomic DNA

SEQ ID NO: 107178 - DNA, 63 bp, Homo sapiens; identical to SEQ ID NO: 34202
  misc_feature 1..63: note = chr12:2800100-2800163
  misc_feature 1..63: note = Hyper
  source 1..63: mol_type = genomic DNA

SEQ ID NO: 107179 - DNA, 948 bp, Homo sapiens
  misc_feature 1..948: note = chr12:2861643-2862591
  misc_feature 1..948: note = Hyper
  source 1..948: mol_type = genomic DNA
cacgccacatcaccccggtcctttagactcctgcgcattctatttccccgtttccttctcacacccactttcttccctggctcccaccacagcagtgcccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaaggccagtaccgggaacgacgatggcgggcacaagggtgggcttgcagcagctgctgctggtgctcccacaggctgcggttctccgcgctcagctcatccagccgccgctcctgctcgtcgatgcgctggcgctggatgtggacgaggctctgctggttctgcacgatggatggcccagagcccttgaggtacagcacggcgcgcaccgggttttccagcaggctctcgatgccacccaccgccgcctgcgccctgcctgcccctgggctggcgcctgggagcgcgagggcgcgggaacccagcagcccagcggtcctctcccacgggcccagcctccctcccgccgccagcgccgcgtcaccgccaccccgattgtcacacactcaccacggggagaggccgcggcccagagcaccccttcctgtctcttggtgtccagaggaggctctgcctcccgctgggcagagaggagagggaggaggccagcgagagggagcctgtgtcggggcgtgggagggaagca

SEQ ID NO: 107180 - DNA, 105 bp, Homo sapiens; identical to SEQ ID NO: 74514
  misc_feature 1..105: note = chr12:2903684-2903789
  misc_feature 1..105: note = Hyper
  source 1..105: mol_type = genomic DNA

SEQ ID NO: 107181 - DNA, 145 bp, Homo sapiens; identical to SEQ ID NO: 74516
  misc_feature 1..145: note = chr12:2920998-2921143
  misc_feature 1..145: note = Hypo
  source 1..145: mol_type = genomic DNA

SEQ ID NO: 107182 - DNA, 548 bp, Homo sapiens; identical to SEQ ID NO: 74521
  misc_feature 1..548: note = chr12:2964264-2964812
  misc_feature 1..548: note = Hypo
  source 1..548: mol_type = genomic DNA

SEQ ID NO: 107183 - DNA, 31 bp, Homo sapiens; identical to SEQ ID NO: 74531
  misc_feature 1..31: note = chr12:2999407-2999438
  misc_feature 1..31: note = Hypo
  source 1..31: mol_type = genomic DNA

SEQ ID NO: 107184 - DNA, 105 bp, Homo sapiens; identical to SEQ ID NO: 74551
  misc_feature 1..105: note = chr12:3198028-3198133
  misc_feature 1..105: note = Hypo
  source 1..105: mol_type = genomic DNA

SEQ ID NO: 107185 - DNA, 38 bp, Homo sapiens; identical to SEQ ID NO: 74568
  misc_feature 1..38: note = chr12:3340974-3341012
  misc_feature 1..38: note = Hypo
  source 1..38: mol_type = genomic DNA

SEQ ID NO: 107186 - DNA, 33 bp, Homo sapiens; identical to SEQ ID NO: 74575
  misc_feature 1..33: note = chr12:3414273-3414306
  misc_feature 1..33: note = Hypo
  source 1..33: mol_type = genomic DNA

SEQ ID NO: 107187 - DNA, 195 bp, Homo sapiens; identical to SEQ ID NO: 74576
  misc_feature 1..195: note = chr12:3419740-3419935
  misc_feature 1..195: note = Hypo
  source 1..195: mol_type = genomic DNA

SEQ ID NO: 107188 - DNA, 34 bp, Homo sapiens; identical to SEQ ID NO: 74577
  misc_feature 1..34: note = chr12:3421073-3421107
  misc_feature 1..34: note = Hypo
  source 1..34: mol_type = genomic DNA

SEQ ID NO: 107189 - DNA, 785 bp, Homo sapiens; identical to SEQ ID NO: 74595
  misc_feature 1..785: note = chr12:3474882-3475667
  misc_feature 1..785: note = Hyper
  source 1..785: mol_type = genomic DNA

SEQ ID NO: 107190 - DNA, 106 bp, Homo sapiens; identical to SEQ ID NO: 74596
  misc_feature 1..106: note = chr12:3562914-3563020
  misc_feature 1..106: note = Hypo
  source 1..106: mol_type = genomic DNA

SEQ ID NO: 107191 - DNA, 561 bp, Homo sapiens
  misc_feature 1..561: note = chr12:3599973-3600534
  misc_feature 1..561: note = Hyper
  source 1..561: mol_type = genomic DNA
caaatcgtaattcgccgaggaaggatccaggaactggcagaggagcgggagagctggggtgggccggggtggggagggtgcgagttaactgtggcccggtctcgcccggacctcgccctaggtgggagcacgcgcaccgggtctgagaacctgcaagagcctcgcccggcgccggctttctctgggccccccgcgcgggcctggcctccacgtaagttgtgtgcagcgccagggagtggaggcggccgagaccctcggagactaggggagggggcgggcccgggggcgctgggggccctcggtctgcgcccagccgccgccggctccagcgaacctcctaccccgcccccactcacccggctcagcccctaggagagacgcgcaggaagcgtgttgcttcgcccagcggatcggcagaagttgagaggagttggcggctgcctccggccggccggactttgcgagcagcctggagaggatccgcgaccgccgccgccgccgccgcggaggcttcggggctgcttccctcgagcttagcccgcagcgcgggtggagaggggc

SEQ ID NO: 107192 - DNA, 214 bp, Homo sapiens
  misc_feature 1..214: note = chr12:3600768-3600982
  misc_feature 1..214: note = Hyper
  source 1..214: mol_type = genomic DNA
tcaccaaacccttgccggctcttatgggcatgaaacactcctcccgctgcctgctcctgaggaggaaaatggcggagaacgcggccgagagcaccgaggtaaggaggcgagcgagcaggggctctcggagaccccgccgcccacccggaccaccgcgccgccgccgccgctcagcgccgagtgccaaactttccccagtttcatcccgctcgct

SEQ ID NO: 107193 - DNA, 214 bp, Homo sapiens; identical to SEQ ID NO: 34211
  misc_feature 1..214: note = chr12:3601042-3601256
  misc_feature 1..214: note = Hyper
  source 1..214: mol_type = genomic DNA

SEQ ID NO: 107194 - DNA, 147 bp, Homo sapiens; identical to SEQ ID NO: 74602
  misc_feature 1..147: note = chr12:3601478-3601625
  misc_feature 1..147: note = Hyper
  source 1..147: mol_type = genomic DNA

SEQ ID NO: 107195 - DNA, 940 bp, Homo sapiens
  misc_feature 1..940: note = chr12:3602021-3602961
  misc_feature 1..940: note = Hyper
  source 1..940: mol_type = genomic DNA
gtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtcaatttcaaaacaaacacgctccgggacttgaacgcagcggggcattcagtagcgaatgctgtctccttgagttagggcaaagcctgcgtgcccgccgtcccctcaccacttcctcttccccagcccccacctgagagcagacattcggaatgatgtgtagtgcgaggcggctagcctcccagcagaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcgcggggtctgggtgcagacccctgccaggttccgcagtgtgcagcggcggctgctgcgctctcccagcctcggcgagggttaaaggcgtccggagcaggcagagcgccgcgcgccagtctatttttacttgcttcccccgccgctccgcgctcccccttctcagcagttgcacatgccagctctgctgaaggcatcaatgaaaacagcagtaggggcggccgggctcctgcgaacaacaacaaaa

SEQ ID NO: 107196 - DNA, 37 bp, Homo sapiens; identical to SEQ ID NO: 74605
  misc_feature 1..37: note = chr12:3640833-3640870
  misc_feature 1..37: note = Hypo
  source 1..37: mol_type = genomic DNA

SEQ ID NO: 107197 - DNA, 113 bp, Homo sapiens; identical to SEQ ID NO: 74606
  misc_feature 1..113: note = chr12:3724027-3724140
  misc_feature 1..113: note = Hypo
  source 1..113: mol_type = genomic DNA

SEQ ID NO: 107198 - DNA, 205 bp, Homo sapiens; identical to SEQ ID NO: 74630
  misc_feature 1..205: note = chr12:4018922-4019127
  misc_feature 1..205: note = Hypo
  source 1..205: mol_type = genomic DNA

SEQ ID NO: 107199 - DNA, 18 bp, Homo sapiens
  misc_feature 1..18: note = chr12:4051745-4051763
  misc_feature 1..18: note = Hypo
  source 1..18: mol_type = genomic DNA
aaccgtgtctccaaaaaa

SEQ ID NO: 107200 - DNA, 349 bp, Homo sapiens; identical to SEQ ID NO: 74640
  misc_feature 1..349: note = chr12:4140405-4140754
  misc_feature 1..349: note = Hyper
  source 1..349: mol_type = genomic DNA

SEQ ID NO: 107201 - DNA, 46 bp, Homo sapiens; identical to SEQ ID NO: 74641
  misc_feature 1..46: note = chr12:4154674-4154720
  misc_feature 1..46: note = Hypo
  source 1..46: mol_type = genomic DNA

SEQ ID NO: 107202 - DNA, 196 bp, Homo sapiens; identical to SEQ ID NO: 43325
  misc_feature 1..196: note = chr12:4194712-4194908
  misc_feature 1..196: note = Hypo
  source 1..196: mol_type = genomic DNA

SEQ ID NO: 107203 - DNA, 30 bp, Homo sapiens; identical to SEQ ID NO: 74650
  misc_feature 1..30: note = chr12:4206588-4206618
  misc_feature 1..30: note = Hypo
  source 1..30: mol_type = genomic DNA

SEQ ID NO: 107204 - DNA, 165 bp, Homo sapiens; identical to SEQ ID NO: 74651
  misc_feature 1..165: note = chr12:4212424-4212589
  misc_feature 1..165: note = Hypo
  source 1..165: mol_type = genomic DNA

SEQ ID NO: 107205 - DNA, 148 bp, Homo sapiens; identical to SEQ ID NO: 74652
  misc_feature 1..148: note = chr12:4214009-4214157
  misc_feature 1..148: note = Hypo
  source 1..148: mol_type = genomic DNA

SEQ ID NO: 107206 - DNA, 125 bp, Homo sapiens; identical to SEQ ID NO: 74653
  misc_feature 1..125: note = chr12:4217500-4217625
  misc_feature 1..125: note = Hypo
  source 1..125: mol_type = genomic DNA

SEQ ID NO: 107207 - DNA, 84 bp, Homo sapiens; identical to SEQ ID NO: 43327
  misc_feature 1..84: note = chr12:4268526-4268610
  misc_feature 1..84: note = Hypo
  source 1..84: mol_type = genomic DNA

SEQ ID NO: 107208 - DNA, 17 bp, Homo sapiens
  misc_feature 1..17: note = chr12:4272614-4272631
  misc_feature 1..17: note = Hypo
  source 1..17: mol_type = genomic DNA
agcgagactctgtctca

SEQ ID NO: 107209 - DNA, 633 bp, Homo sapiens
  misc_feature 1..633: note = chr12:4273871-4274504
  misc_feature 1..633: note = Hyper
  source 1..633: mol_type = genomic DNA
gcggcacccgggcctcgcctccttccagcggagccgcgcgccctgcgtcctggcctccccgccccgagtccccttccctggagcctgggggaccgacagtcgcgggccacgcacgcggtcccagcctcgccgtccgccccggggagagctggaaggtgggcccggatctcccacatcactatgagctcattccagccccggccaagcaaagcctggccctactcgctccacatgcatttcagtctcctctcgcctttcatgcgcggaggagccgggagggagaggatgtgacctcatctgcgcggcatctgagcccaggggtgccccagctcttccacccaggccgctccccgagcccagctccccgcgcccctctctctatccaggagagacgcattggacagccaggagggctcgacgtggaaggaaaggaagctgcaattctgggacaggggcagacgggagaggaagtgaacgtggctaaacgctcactttatgtaaaacgtcccccagactagaatctcgtccacagagctgcacacatacactcgcacgggcccggcttgtactcaggcaggcacactcgccccccgccgtccccaccgcatcccccatacccgtcctaactcactc

SEQ ID NO: 107210 - DNA, 87 bp, Homo sapiens; identical to SEQ ID NO: 74664
  misc_feature 1..87: note = chr12:4280838-4280925
  misc_feature 1..87: note = Hypo
  source 1..87: mol_type = genomic DNA

SEQ ID NO: 107211 - DNA, 30 bp, Homo sapiens; identical to SEQ ID NO: 74665
  misc_feature 1..30: note = chr12:4286260-4286290
  misc_feature 1..30: note = Hypo
  source 1..30: mol_type = genomic DNA

SEQ ID NO: 107212 - DNA, 101 bp, Homo sapiens; identical to SEQ ID NO: 74669
  misc_feature 1..101: note = chr12:4301350-4301451
  misc_feature 1..101: note = Hypo
  source 1..101: mol_type = genomic DNA

SEQ ID NO: 107213 - DNA, 30 bp, Homo sapiens; identical to SEQ ID NO: 74670
  misc_feature 1..30: note = chr12:4307938-4307968
  misc_feature 1..30: note = Hypo
  source 1..30: mol_type = genomic DNA

SEQ ID NO: 107214 - DNA, 34 bp, Homo sapiens; identical to SEQ ID NO: 74671
  misc_feature 1..34: note = chr12:4309680-4309714
  misc_feature 1..34: note = Hypo
  source 1..34: mol_type = genomic DNA

SEQ ID NO: 107215 - DNA, 30 bp, Homo sapiens; identical to SEQ ID NO: 74672
  misc_feature 1..30: note = chr12:4315483-4315513
  misc_feature 1..30: note = Hypo
  source 1..30: mol_type = genomic DNA

SEQ ID NO: 107216 - DNA, 36 bp, Homo sapiens; identical to SEQ ID NO: 74673
  misc_feature 1..36: note = chr12:4322949-4322985
  misc_feature 1..36: note = Hypo
  source 1..36: mol_type = genomic DNA

SEQ ID NO: 107217 - DNA, 30 bp, Homo sapiens; identical to SEQ ID NO: 74674
  misc_feature 1..30: note = chr12:4334601-4334631
  misc_feature 1..30: note = Hypo
  source 1..30: mol_type = genomic DNA

SEQ ID NO: 107218 - DNA, 30 bp, Homo sapiens; identical to SEQ ID NO: 43330
  misc_feature 1..30: note = chr12:4356247-4356277
  misc_feature 1..30: note = Hypo
  source 1..30: mol_type = genomic DNA

SEQ ID NO: 107219 - DNA, 30 bp, Homo sapiens; identical to SEQ ID NO: 74676
  misc_feature 1..30: note = chr12:4358486-4358516
  misc_feature 1..30: note = Hypo
  source 1..30: mol_type = genomic DNA

SEQ ID NO: 107220 - DNA, 30 bp, Homo sapiens; identical to SEQ ID NO: 74677
  misc_feature 1..30: note = chr12:4362436-4362466
  misc_feature 1..30: note = Hypo
  source 1..30: mol_type = genomic DNA

SEQ ID NO: 107221 - DNA, 190 bp, Homo sapiens; identical to SEQ ID NO: 74678
  misc_feature 1..190: note = chr12:4373080-4373270
  misc_feature 1..190: note = Hypo
  source 1..190: mol_type = genomic DNA

SEQ ID NO: 107222 - DNA, 664 bp, Homo sapiens; identical to SEQ ID NO: 74679
  misc_feature 1..664: note = chr12:4377894-4378558
  misc_feature 1..664: note = Hyper
  source 1..664: mol_type = genomic DNA

SEQ ID NO: 107223 - DNA, 1118 bp, Homo sapiens; identical to SEQ ID NO: 34218
  misc_feature 1..1118: note = chr12:4378802-4379920
  misc_feature 1..1118: note = Hyper
  source 1..1118: mol_type = genomic DNA

SEQ ID NO: 107224 - DNA, 30 bp, Homo sapiens; identical to SEQ ID NO: 34219
  misc_feature 1..30: note = chr12:4380166-4380196
  misc_feature 1..30: note = Hyper
  source 1..30: mol_type = genomic DNA

SEQ ID NO: 107225 - DNA, 553 bp, Homo sapiens; identical to SEQ ID NO: 74682
  misc_feature 1..553: note = chr12:4380480-4381033
  misc_feature 1..553: note = Hyper
  source 1..553: mol_type = genomic DNA

SEQ ID NO: 107226 - DNA, 1006 bp, Homo sapiens
  misc_feature 1..1006: note = chr12:4381433-4382439
  misc_feature 1..1006: note = Hyper
  source 1..1006: mol_type = genomic DNA
tcgctcccctcctccgccttgcagggaacctagtgtacggctcacccagcccgcgccccaccccgccttgctggctctccgcgcccctgcccgggccccctctctcggtgagggaggcactcagtcggcctcggtgtgcccagagagctcgagccacgccatgcccgctgcacgtgccagcttggccagcacatcagggcgctggtctctccccttcctcctggagtgaaatacaccaaagggcgcggtgggggtggggggtgacgggaggaaggaggtgaagaaacgccaccagatcgtatctcctgtaaagacagccttgactcaagcatgcgttagagcacgtgtcagggccgaccgtgctggcggcgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctatttt

SEQ ID NO: 107227 - DNA, 34 bp, Homo sapiens
  misc_feature 1..34: note = chr12:4382965-4382999
  misc_feature 1..34: note = Hyper
  source 1..34: mol_type = genomic DNA
tttaaggggaggaccggtgcgagtgaggcagccc

SEQ ID NO: 107228 - DNA, 851 bp, Homo sapiens; identical to SEQ ID NO: 74684
  misc_feature 1..851: note = chr12:4383208-4384059
  misc_feature 1..851: note = Hyper
  source 1..851: mol_type = genomic DNA

SEQ ID NO: 107229 - DNA, 220 bp, Homo sapiens; identical to SEQ ID NO: 74685
  misc_feature 1..220: note = chr12:4384313-4384533
  misc_feature 1..220: note = Hyper
  source 1..220: mol_type = genomic DNA

SEQ ID NO: 107230 - DNA, 30 bp, Homo sapiens; identical to SEQ ID NO: 74686
  misc_feature 1..30: note = chr12:4390499-4390529
  misc_feature 1..30: note = Hypo
  source 1..30: mol_type = genomic DNA

SEQ ID NO: 107231 - DNA, 229 bp, Homo sapiens; identical to SEQ ID NO: 74687
  misc_feature 1..229: note = chr12:4391671-4391900
  misc_feature 1..229: note = Hypo
  source 1..229: mol_type = genomic DNA

SEQ ID NO: 107232 - DNA, 55 bp, Homo sapiens; identical to SEQ ID NO: 74688
  misc_feature 1..55: note = chr12:4392892-4392947
  misc_feature 1..55: note = Hypo
  source 1..55: mol_type = genomic DNA

SEQ ID NO: 107233 - DNA, 55 bp, Homo sapiens; identical to SEQ ID NO: 74694
  misc_feature 1..55: note = chr12:4397850-4397905
  misc_feature 1..55: note = Hypo
  source 1..55: mol_type = genomic DNA

SEQ ID NO: 107234 - DNA, 30 bp, Homo sapiens; identical to SEQ ID NO: 74695
  misc_feature 1..30: note = chr12:4399394-4399424
  misc_feature 1..30: note = Hypo
  source 1..30: mol_type = genomic DNA

SEQ ID NO: 107235 - DNA, 159 bp, Homo sapiens; identical to SEQ ID NO: 74696
  misc_feature 1..159: note = chr12:4405568-4405727
  misc_feature 1..159: note = Hypo
  source 1..159: mol_type = genomic DNA

SEQ ID NO: 107236 - DNA, 30 bp, Homo sapiens; identical to SEQ ID NO: 43332
  misc_feature 1..30: note = chr12:4411192-4411222
  misc_feature 1..30: note = Hypo
  source 1..30: mol_type = genomic DNA

SEQ ID NO: 107237 - DNA, 136 bp, Homo sapiens; identical to SEQ ID NO: 74705
  misc_feature 1..136: note = chr12:4554801-4554937
  misc_feature 1..136: note = Hypo
  source 1..136: mol_type = genomic DNA

SEQ ID NO: 107238 - DNA, 30 bp, Homo sapiens; identical to SEQ ID NO: 43334
  misc_feature 1..30: note = chr12:4734872-4734902
  misc_feature 1..30: note = Hypo
  source 1..30: mol_type = genomic DNA

SEQ ID NO: 107239 - DNA, 138 bp, Homo sapiens; identical to SEQ ID NO: 74720
  misc_feature 1..138: note = chr12:4829055-4829193
  misc_feature 1..138: note = Hypo
  source 1..138: mol_type = genomic DNA

SEQ ID NO: 107240 - DNA, 30 bp, Homo sapiens; identical to SEQ ID NO: 43336
  misc_feature 1..30: note = chr12:4959461-4959491
  misc_feature 1..30: note = Hypo
  source 1..30: mol_type = genomic DNA

SEQ ID NO: 107241 - DNA, 30 bp, Homo sapiens; identical to SEQ ID NO: 74766
  misc_feature 1..30: note = chr12:4970362-4970392
  misc_feature 1..30: note = Hypo
  source 1..30: mol_type = genomic DNA

SEQ ID NO: 107242 - DNA, 2482 bp, Homo sapiens
  misc_feature 1..2482: note = chr12:5017990-5020472
  misc_feature 1..2482: note = Hyper
  source 1..2482: mol_type = genomic DNA
gtaggcgggaggcaacggtggtgagaagggtggtcccaaggccgcgggaggagccaatcagcggcgactctgggctcttgcagcctccttagagactccgcagccctggaggtaccaagctgcctgctgccttttctcgcgctgcaggcgcggagatgcagcgcctctgggggcgcagctccagccgcactcgcagggcaaggcacacgcccccggctcctgctgccatgcgcctctgcgggggaccctttccaaataaattgcaagctttgaaagtggccctgtggaggcactaggctggggaaaaaggctgcgggaggagggacatagggtgggaggtgagtaggcgacttgcttctcagattattcccaattagcaccaagttggcagacaaccccacaaacccacgaagccttcggtcccccacaagtcacattccctgtatttcagaataatcggatcgtaagaaaacttcaagtcccatcgtaggttaaagagggacaggctcttagtaccgccgccgcccagtaaaactacatggaacaaacccagggatcctcatctgcacagctctgcccaaagtctgcagctctgcgagtccagccggcgggggaagctgggtgggccccgcagagagcaagggccttcttgggggaggagcgggatggggcgcagagcagtgcgatcgaagagggttactgtgggactgcacaaaagcaaacccgtcggaggagttttgccagaaacaccaccgcctgcattgcgtcggacctgaccatttccaatgtgaaattcccggggaaggtcgcgagccgctaggggccgttcgtgggcggggcggcgggccacaggggaagtagagttagcggtcggcttttctggtaggagaggaaaaagctgtgctggcaagggtgggaactgaatgacaaccccgctctcttccaaaccaccccctcatattttccatccacctcctcgctcctgccctcccccgccctccccaacccacgcccgggtgggccaatcgctgctcggtattccaggcgctttctcaggtttctgctgatcttgcagcgcccagaaatggaccgagcggacccgccgccgcacgcaccctgctccactccaagctcctaagggctcctggcgcgccgcgtagccttggcgaggtccgcgctggggtgcggagagcgaagggaactggagagccatgtagatccaggctctcgcccgcccgcctccttcgggatcgaatcaagggctcccatagtgttaggagggggcgagagtgctgtttatcgtcatttgcctcggagcttcgagagagggtggtattttgcttttccgccccgcatcctccggaactccctgcaccggagagaggacggcgtctccaggttgctggcaaccggtgagaatgggggtagggaaggaacattttcgccgtagctgctccgtaaagcgattgtccaactgagaggggcgtcggacgagtggaccagggcggcgagtttgcccggcgcgtctcggatgctgctgcggcggccgccgcggctcccgccagggcactgcaaagacgacctgccgcattcccactcgggctctccgctgactcagcaccgcccctgcgccaagccagccggccaggtagggggttccccagctcggggatgcagaagcgggggttggggggaccgggtgggggaggccgggggtgcggggatgctgtccgggaccctgagcttcccccggcgtctctcggcgcttttccgatctctagtttaacgaagttgtaaacagatcggctgttgggcattggggaaagtgggatggaagagccccaaacttggatttccgggtgtctgcgtgtcgtctgtccgtgtgtgtgtgatagccctagcaaacgtccagtgctttctcaagctagaggtctgtgttcttcggtgtctgtaggtccgtcccatctgaatgcttctgattttctacccccgtatcactttctatttctctgcagcgtgcatcgatcgccctggtgggagcttagaaggcggcaggcgaagaggggtaggaggggggagagccgaggagaagcagagagggtggcaggcgtggggatctgccgagccggcactgcaccgggtcctaggaaggctctcggaggggaggggaggccagggcgacccccgaagcaatggcccagtccgctagaacggcactgcgttaaggcacctgggatcaggaagaaatatctaaacaacaacaacagaaaaccaacaaacccccaaacccaaacccaaccctctgcaaaaagctgcacccggcccgcaggcgagggggattccaaactgagtgaaaggcagggtggaggggaaggcagcgagaggcaaagtcgcagatctcccgacctgctcgtgttgaagcacctccccctgggcgtgagggagacgcgcgctccggtgggggggccgcttgggtcccccc

SEQ ID NO: 107243 - DNA, 30 bp, Homo sapiens; identical to SEQ ID NO: 74785
  misc_feature 1..30: note = chr12:5020739-5020769
  misc_feature 1..30: note = Hyper
  source 1..30: mol_type = genomic DNA

SEQ ID NO: 107244 - DNA, 30 bp, Homo sapiens; identical to SEQ ID NO: 74800
  misc_feature 1..30: note = chr12:5141776-5141806
  misc_feature 1..30: note = Hypo
  source 1..30: mol_type = genomic DNA

SEQ ID NO: 107245 - DNA, 810 bp, Homo sapiens
  misc_feature 1..810: note = chr12:5152915-5153725
  misc_feature 1..810: note = Hyper
  source 1..810: mol_type = genomic DNA
taggggccccagctgcgccctccggggagacacccgctgccacgagacccgggaggggaagcgggaggagggggagaggaggggaaggcgggggaggcgccgagggtggaggccaagcgcggcgcagccagagaggggcggctgaaggttgcatctgctggaaggaggcttttcggctgcttggtaacgggctgccagaagagagagaggcagagagcagggcagcggcttcttgacgtcagggccaagcgaggggatcgcgccagcaaccccagctctccccagagaggggccggccgaccgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccc

SEQ ID NO: 107246 - DNA, 37 bp, Homo sapiens; identical to SEQ ID NO: 74833
  misc_feature 1..37: note = chr12:5252286-5252323
  misc_feature 1..37: note = Hypo
  source 1..37: mol_type = genomic DNA

SEQ ID NO: 107247 - DNA, 156 bp, Homo sapiens; identical to SEQ ID NO: 74849
  misc_feature 1..156: note = chr12:5315378-5315534
  misc_feature 1..156: note = Hypo
  source 1..156: mol_type = genomic DNA

SEQ ID NO: 107248 - DNA, 146 bp, Homo sapiens; identical to SEQ ID NO: 74851
  misc_feature 1..146: note = chr12:5323880-5324026
  misc_feature 1..146: note = Hypo
  source 1..146: mol_type = genomic DNA

SEQ ID NO: 107249 - DNA, 141 bp, Homo sapiens; identical to SEQ ID NO: 43339
  misc_feature 1..141: note = chr12:5335908-5336049
  misc_feature 1..141: note = Hypo
  source 1..141: mol_type = genomic DNA

SEQ ID NO: 107250 - DNA, 87 bp, Homo sapiens; identical to SEQ ID NO: 74865
  misc_feature 1..87: note = chr12:5370466-5370553
  misc_feature 1..87: note = Hypo
  source 1..87: mol_type = genomic DNA

SEQ ID NO: 107251 - DNA, 30 bp, Homo sapiens; identical to SEQ ID NO: 43340
  misc_feature 1..30: note = chr12:5384595-5384625
  misc_feature 1..30: note = Hypo
  source 1..30: mol_type = genomic DNA

SEQ ID NO: 107252 - DNA, 761 bp, Homo sapiens; identical to SEQ ID NO: 74960
  misc_feature 1..761: note = chr12:5540932-5541693
  misc_feature 1..761: note = Hyper
  source 1..761: mol_type = genomic DNA

SEQ ID NO: 107253 - DNA, 959 bp, Homo sapiens; identical to SEQ ID NO: 74962
  misc_feature 1..959: note = chr12:5542015-5542974
  misc_feature 1..959: note = Hyper
  source 1..959: mol_type = genomic DNA

SEQ ID NO: 107254 - DNA, 44 bp, Homo sapiens; identical to SEQ ID NO: 74963
  misc_feature 1..44: note = chr12:5561220-5561264
  misc_feature 1..44: note = Hypo
  source 1..44: mol_type = genomic DNA

SEQ ID NO: 107255 - DNA, 131 bp, Homo sapiens; identical to SEQ ID NO: 74975
  misc_feature 1..131: note = chr12:5713307-5713438
  misc_feature 1..131: note = Hypo
  source 1..131: mol_type = genomic DNA

SEQ ID NO: 107256 - DNA, 21 bp, Homo sapiens
  misc_feature 1..21: note = chr12:5720406-5720427
  misc_feature 1..21: note = Hypo
  source 1..21: mol_type = genomic DNA
ttacagcggtgagccaccaca

SEQ ID NO: 107257 - DNA, 191 bp, Homo sapiens; identical to SEQ ID NO: 74995
  misc_feature 1..191: note = chr12:5770987-5771178
  misc_feature 1..191: note = Hypo
  source 1..191: mol_type = genomic DNA

SEQ ID NO: 107258 - DNA, 30 bp, Homo sapiens; identical to SEQ ID NO: 75021
  misc_feature 1..30: note = chr12:5840200-5840230
  misc_feature 1..30: note = Hypo
  source 1..30: mol_type = genomic DNA

SEQ ID NO: 107259 - DNA, 68 bp, Homo sapiens; identical to SEQ ID NO: 75028
  misc_feature 1..68: note = chr12:6180311-6180379
  misc_feature 1..68: note = Hypo
  source 1..68: mol_type = genomic DNA

SEQ ID NO: 107260 - DNA, 48 bp, Homo sapiens; identical to SEQ ID NO: 75044
  misc_feature 1..48: note = chr12:6310255-6310303
  misc_feature 1..48: note = Hyper
  source 1..48: mol_type = genomic DNA

SEQ ID NO: 107261 - DNA, 155 bp, Homo sapiens; identical to SEQ ID NO: 75045
  misc_feature 1..155: note = chr12:6316943-6317098
  misc_feature 1..155: note = Hypo
  source 1..155: mol_type = genomic DNA

SEQ ID NO: 107262 - DNA, 30 bp, Homo sapiens; identical to SEQ ID NO: 75057
  misc_feature 1..30: note = chr12:6420362-6420392
  misc_feature 1..30: note = Hypo
  source 1..30: mol_type = genomic DNA

SEQ ID NO: 107263 - DNA, 116 bp, Homo sapiens; identical to SEQ ID NO: 34234
  misc_feature 1..116: note = chr12:6444922-6445038
  misc_feature 1..116: note = Hyper
  source 1..116: mol_type = genomic DNA

SEQ ID NO: 107264 - DNA, 30 bp, Homo sapiens; identical to SEQ ID NO: 75059
  misc_feature 1..30: note = chr12:6449974-6450004
  misc_feature 1..30: note = Hyper
  source 1..30: mol_type = genomic DNA

SEQ ID NO: 107265 - DNA, 30 bp, Homo sapiens; identical to SEQ ID NO: 75060
  misc_feature 1..30: note = chr12:6450274-6450304
  misc_feature 1..30: note = Hyper
  source 1..30: mol_type = genomic DNA

SEQ ID NO: 107266 - DNA, 30 bp, Homo sapiens; identical to SEQ ID NO: 34235
  misc_feature 1..30: note = chr12:6450544-6450574
  misc_feature 1..30: note = Hyper
  source 1..30: mol_type = genomic DNA

SEQ ID NO: 107267 - DNA, 152 bp, Homo sapiens; identical to SEQ ID NO: 75062
  misc_feature 1..152: note = chr12:6472461-6472613
  misc_feature 1..152: note = Hyper
  source 1..152: mol_type = genomic DNA

SEQ ID NO: 107268 - DNA, 46 bp, Homo sapiens; identical to SEQ ID NO: 34237
  misc_feature 1..46: note = chr12:6472854-6472900
  misc_feature 1..46: note = Hyper
  source 1..46: mol_type = genomic DNA

SEQ ID NO: 107269 - DNA, 44 bp, Homo sapiens; identical to SEQ ID NO: 75064
  misc_feature 1..44: note = chr12:6473627-6473671
  misc_feature 1..44: note = Hypo
  source 1..44: mol_type = genomic DNA

SEQ ID NO: 107270 - DNA, 462 bp, Homo sapiens; identical to SEQ ID NO: 75070
  misc_feature 1..462: note = chr12:6483568-6484030
  misc_feature 1..462: note = Hypo
  source 1..462: mol_type = genomic DNA

SEQ ID NO: 107271 - DNA, 63 bp, Homo sapiens; identical to SEQ ID NO: 75071
  misc_feature 1..63: note = chr12:6493353-6493416
  misc_feature 1..63: note = Hyper
  source 1..63: mol_type = genomic DNA

SEQ ID NO: 107272 - DNA, 78 bp, Homo sapiens; identical to SEQ ID NO: 75072
  misc_feature 1..78: note = chr12:6495108-6495186
  misc_feature 1..78: note = Hypo
  source 1..78: mol_type = genomic DNA

SEQ ID NO: 107273 - DNA, 111 bp, Homo sapiens; identical to SEQ ID NO: 75099
  misc_feature 1..111: note = chr12:6623485-6623596
  misc_feature 1..111: note = Hypo
  source 1..111: mol_type = genomic DNA

SEQ ID NO: 107274 - DNA, 1338 bp, Homo sapiens
  misc_feature 1..1338: note = chr12:6664165-6665503
  misc_feature 1..1338: note = Hyper
  source 1..1338: mol_type = genomic DNA
atggcagagacaagccggaaaagtaggaatccccccgtgttccgctcccagcgtccttcttcctgtcacgagcagggcttctgcattctctgcggattctagtctccctgcatccaattgcttccaagctcctcattacacagcacaaactttactctcattcttttcacccctgattcttcggaacccacaccaactcgcggcccgttgtgagtggtatgacacagagagacctgtccccctttcccaatccctacctccgcttgtactcgtcccgctcccgcttcactttggccagcacgttgtagagagcgcggatctcgggcgtgatggtgtcgatctggacgcccaccccatccgggtgcacccacgacaagccaggcccttgcaccagagtgggctccagtcccggcccgagccggcgggcgtgcgagaacgaccagatggtgccgggcatgaagcgggccgacgaggaataggtggtggaggtggaggtggaggacgacgagaggctggccgcggagggcgcgagggggccggccggggagcgcgcgggcgagcccagcacgcgcgccgaagggctgcagacagcggccggccgggcgcccagctgcagccccaggggccggatggggctgacgaagccggtctgcactgcctggtcgcgacgacccaggccccgccggccctgcttaccctcctccagcgcttgctgcagttgcttctccaacagccggttccggcgctccagctcatgcaccttggccaggaagcagcggaaccggaggttcagggtcttgagcacgttgatgttggagcccaggtcattgcggagggccatggcggcaggcggggccgggcccggcccgggcggcgagtaggcagcagggccggccggcgagagaggcgccgggggcaagtctcctcccccggcgaagtggtcgcctcccagtgagtcccccagtggcccggccaggccctgctgctcctgctgcaggaggaagaggttggggccgaataacggattcatggctgcgccttctgctgggagatgcagaccggtgcaggagcagggatggaaggcgagccagaagagccaatgcggcgccggcgggacagagccgaccaatcaggcggctcggcagcggggcagaggtcagggggcgggccgaggggaagccaatgacaggctccaattggaggccggaccctggacctttccgggtctgaggccgagccctgtgatgaggggagccaccgcctggactccagccggggtggcgtaaagcccaggacctccagtaccccatgggttctggtggcaagcccatctcccct

SEQ ID NO: 107275 - DNA, 178 bp, Homo sapiens; identical to SEQ ID NO: 75114
  misc_feature 1..178: note = chr12:6803722-6803900
  misc_feature 1..178: note = Hypo
  source 1..178: mol_type = genomic DNA

SEQ ID NO: 107276 - DNA, 70 bp, Homo sapiens; identical to SEQ ID NO: 75115
  misc_feature 1..70: note = chr12:6804640-6804710
  misc_feature 1..70: note = Hypo
  source 1..70: mol_type = genomic DNA

SEQ ID NO: 107277 - DNA, 493 bp, Homo sapiens; identical to SEQ ID NO: 75116
  misc_feature 1..493: note = chr12:6809199-6809692
  misc_feature 1..493: note = Hyper
  source 1..493: mol_type = genomic DNA

SEQ ID NO: 107278 - DNA, 76 bp, Homo sapiens; identical to SEQ ID NO: 75117
  misc_feature 1..76: note = chr12:6809993-6810069
  misc_feature 1..76: note = Hyper
  source 1..76: mol_type = genomic DNA

SEQ ID NO: 107279 - DNA, 30 bp, Homo sapiens; identical to SEQ ID NO: 75118
  misc_feature 1..30: note = chr12:6812993-6813023
  misc_feature 1..30: note = Hyper
  source 1..30: mol_type = genomic DNA

SEQ ID NO: 107280 - DNA, 91 bp, Homo sapiens; identical to SEQ ID NO: 75119
  misc_feature 1..91: note = chr12:6861239-6861330
  misc_feature 1..91: note = Hypo
  source 1..91: mol_type = genomic DNA

SEQ ID NO: 107281 - DNA, 90 bp, Homo sapiens; identical to SEQ ID NO: 75158
  misc_feature 1..90: note = chr12:7249312-7249402
  misc_feature 1..90: note = Hypo
  source 1..90: mol_type = genomic DNA

SEQ ID NO: 107282 - DNA, 16 bp, Homo sapiens
  misc_feature 1..16: note = chr12:7462672-7462688
  misc_feature 1..16: note = Hypo
  source 1..16: mol_type = genomic DNA
gcgcctggcaggagac

SEQ ID NO: 107283 - DNA, 201 bp, Homo sapiens; identical to SEQ ID NO: 75173
  misc_feature 1..201: note = chr12:7559133-7559334
  misc_feature 1..201: note = Hypo
  source 1..201: mol_type = genomic DNA

SEQ ID NO: 107284 - DNA, 81 bp, Homo sapiens; identical to SEQ ID NO: 43352
  misc_feature 1..81: note = chr12:7767211-7767292
  misc_feature 1..81: note = Hypo
  source 1..81: mol_type = genomic DNA

SEQ ID NO: 107285 - DNA, 24 bp, Homo sapiens
  misc_feature 1..24: note = chr12:7840950-7840974
  misc_feature 1..24: note = Hypo
  source 1..24: mol_type = genomic DNA
ctaactagggctaggcgcagtggc

SEQ ID NO: 107286 - DNA, 21 bp, Homo sapiens
  misc_feature 1..21: note = chr12:7844734-7844755
  misc_feature 1..21: note = Hypo
  source 1..21: mol_type = genomic DNA
gtcaatagactgggccgggac

SEQ ID NO: 107287 - DNA, 30 bp, Homo sapiens; identical to SEQ ID NO: 75190
  misc_feature 1..30: note = chr12:7854770-7854800
  misc_feature 1..30: note = Hypo
  source 1..30: mol_type = genomic DNA

SEQ ID NO: 107288 - DNA, 105 bp, Homo sapiens; identical to SEQ ID NO: 75191
  misc_feature 1..105: note = chr12:7864790-7864895
  misc_feature 1..105: note = Hypo
  source 1..105: mol_type = genomic DNA

SEQ ID NO: 107289 - DNA, 17 bp, Homo sapiens
  misc_feature 1..17: note = chr12:7896250-7896267
  misc_feature 1..17: note = Hypo
  source 1..17: mol_type = genomic DNA
cccggccttaattcttt

SEQ ID NO: 107290 - DNA, 120 bp, Homo sapiens; identical to SEQ ID NO: 75193
  misc_feature 1..120: note = chr12:7919057-7919177
  misc_feature 1..120: note = Hypo
  source 1..120: mol_type = genomic DNA

SEQ ID NO: 107291 - DNA, 205 bp, Homo sapiens; identical to SEQ ID NO: 75195
  misc_feature 1..205: note = chr12:7921501-7921706
  misc_feature 1..205: note = Hypo
  source 1..205: mol_type = genomic DNA

SEQ ID NO: 107292 - DNA, 43 bp, Homo sapiens; identical to SEQ ID NO: 43355
  misc_feature 1..43: note = chr12:7960433-7960476
  misc_feature 1..43: note = Hypo
  source 1..43: mol_type = genomic DNA

SEQ ID NO: 107293 - DNA, 94 bp, Homo sapiens; identical to SEQ ID NO: 75202
  misc_feature 1..94: note = chr12:7963239-7963333
  misc_feature 1..94: note = Hypo
  source 1..94: mol_type = genomic DNA

SEQ ID NO: 107294 - DNA, 80 bp, Homo sapiens; identical to SEQ ID NO: 75203
  misc_feature 1..80: note = chr12:7963796-7963876
  misc_feature 1..80: note = Hypo
  source 1..80: mol_type = genomic DNA

SEQ ID NO: 107295 - DNA, 18 bp, Homo sapiens
  misc_feature 1..18: note = chr12:7973388-7973406
  misc_feature 1..18: note = Hypo
  source 1..18: mol_type = genomic DNA
aattaaacaacagtccgg

SEQ ID NO: 107296 - DNA, 30 bp, Homo sapiens; identical to SEQ ID NO: 43358
  misc_feature 1..30: note = chr12:7980007-7980037
  misc_feature 1..30: note = Hypo
  source 1..30: mol_type = genomic DNA

SEQ ID NO: 107297 - DNA, 85 bp, Homo sapiens; identical to SEQ ID NO: 75206
  misc_feature 1..85: note = chr12:7981128-7981213
  misc_feature 1..85: note = Hypo
  source 1..85: mol_type = genomic DNA

SEQ ID NO: 107298 - DNA, 30 bp, Homo sapiens; identical to SEQ ID NO: 75207
  misc_feature 1..30: note = chr12:7984193-7984223
  misc_feature 1..30: note = Hypo
  source 1..30: mol_type = genomic DNA

SEQ ID NO: 107299 - DNA, 30 bp, Homo sapiens; identical to SEQ ID NO: 43359
  misc_feature 1..30: note = chr12:7986413-7986443
  misc_feature 1..30: note = Hypo
  source 1..30: mol_type = genomic DNA

SEQ ID NO: 107300 - DNA, 30 bp, Homo sapiens; identical to SEQ ID NO: 75210
  misc_feature 1..30: note = chr12:7998024-7998054
  misc_feature 1..30: note = Hypo
  source 1..30: mol_type = genomic DNA

SEQ ID NO: 107301 - DNA, 38 bp, Homo sapiens; identical to SEQ ID NO: 75211
  misc_feature 1..38: note = chr12:8001679-8001717
  misc_feature 1..38: note = Hypo
  source 1..38: mol_type = genomic DNA

SEQ ID NO: 107302 - DNA, 38 bp, Homo sapiens; identical to SEQ ID NO: 75212
  misc_feature 1..38: note = chr12:8009448-8009486
  misc_feature 1..38: note = Hypo
  source 1..38: mol_type = genomic DNA

SEQ ID NO: 107303 - DNA, 275 bp, Homo sapiens; identical to SEQ ID NO: 75213
  misc_feature 1..275: note = chr12:8023505-8023780
  misc_feature 1..275: note = Hypo
  source 1..275: mol_type = genomic DNA

SEQ ID NO: 107304 - DNA, 30 bp, Homo sapiens; identical to SEQ ID NO: 75215
  misc_feature 1..30: note = chr12:8050118-8050148
  misc_feature 1..30: note = Hypo
  source 1..30: mol_type = genomic DNA

SEQ ID NO: 107305 - DNA, 30 bp, Homo sapiens; identical to SEQ ID NO: 75216
  misc_feature 1..30: note = chr12:8063011-8063041
  misc_feature 1..30: note = Hypo
  source 1..30: mol_type = genomic DNA

SEQ ID NO: 107306 - DNA, 20 bp, Homo sapiens
  misc_feature 1..20: note = chr12:8074494-8074514
  misc_feature 1..20: note = Hypo
  source 1..20: mol_type = genomic DNA
tctgtgtttctgggccgagt

SEQ ID NO: 107307 - DNA, 226 bp, Homo sapiens; identical to SEQ ID NO: 75218
  misc_feature 1..226: note = chr12:8088725-8088951
  misc_feature 1..226: note = Hyper
  source 1..226: mol_type = genomic DNA

SEQ ID NO: 107308 - DNA, 96 bp, Homo sapiens; identical to SEQ ID NO: 43361
  misc_feature 1..96: note = chr12:8117682-8117778
  misc_feature 1..96: note = Hypo
  source 1..96: mol_type = genomic DNA

SEQ ID NO: 107309 - DNA, 18 bp, Homo sapiens
  misc_feature 1..18: note = chr12:8122686-8122704
  misc_feature 1..18: note = Hypo
  source 1..18: mol_type = genomic DNA
gcccgaactacaattctt

SEQ ID NO: 107310 - DNA, 375 bp, Homo sapiens; identical to SEQ ID NO: 75223
  misc_feature 1..375: note = chr12:8123153-8123528
  misc_feature 1..375: note = Hyper
  source 1..375: mol_type = genomic DNA

SEQ ID NO: 107311 - DNA, 22 bp, Homo sapiens
  misc_feature 1..22: note = chr12:8127118-8127140
  misc_feature 1..22: note = Hypo
  source 1..22: mol_type = genomic DNA
ccgtgcccggccaaggtcataa

SEQ ID NO: 107312 - DNA, 24 bp, Homo sapiens
  misc_feature 1..24: note = chr12:8148633-8148657
  misc_feature 1..24: note = Hypo
  source 1..24: mol_type = genomic DNA
tataataaatgggctcggctgggt

SEQ ID NO: 107313 - DNA, 90 bp, Homo sapiens; identical to SEQ ID NO: 75231
  misc_feature 1..90: note = chr12:8165031-8165121
  misc_feature 1..90: note = Hypo
  source 1..90: mol_type = genomic DNA

SEQ ID NO: 107314 - DNA, 145 bp, Homo sapiens; identical to SEQ ID NO: 75232
  misc_feature 1..145: note = chr12:8168130-8168275
  misc_feature 1..145: note = Hypo
  source 1..145: mol_type = genomic DNA

SEQ ID NO: 107315 - DNA, 205 bp, Homo sapiens; identical to SEQ ID NO: 75233
  misc_feature 1..205: note = chr12:8170311-8170516
  misc_feature 1..205: note = Hypo
  source 1..205: mol_type = genomic DNA

SEQ ID NO: 107316 - DNA, 592 bp, Homo sapiens; identical to SEQ ID NO: 34242
  misc_feature 1..592: note = chr12:8171294-8171886
  misc_feature 1..592: note = Hyper
  source 1..592: mol_type = genomic DNA

SEQ ID NO: 107317 - DNA, 30 bp, Homo sapiens; identical to SEQ ID NO: 75236
  misc_feature 1..30: note = chr12:8214437-8214467
  misc_feature 1..30: note = Hypo
  source 1..30: mol_type = genomic DNA

SEQ ID NO: 107318 - DNA, 30 bp, Homo sapiens; identical to SEQ ID NO: 75240
  misc_feature 1..30: note = chr12:8298283-8298313
  misc_feature 1..30: note = Hypo
  source 1..30: mol_type = genomic DNA

SEQ ID NO: 107319 - DNA, 162 bp, Homo sapiens; identical to SEQ ID NO: 75241
  misc_feature 1..162: note = chr12:8322370-8322532
  misc_feature 1..162: note = Hypo
  source 1..162: mol_type = genomic DNA

SEQ ID NO: 107320 - DNA, 125 bp, Homo sapiens; identical to SEQ ID NO: 75242
  misc_feature 1..125: note = chr12:8386013-8386138
  misc_feature 1..125: note = Hypo
  source 1..125: mol_type = genomic DNA

SEQ ID NO: 107321 - DNA, 30 bp, Homo sapiens; identical to SEQ ID NO: 75243
  misc_feature 1..30: note = chr12:8388556-8388586
  misc_feature 1..30: note = Hypo
  source 1..30: mol_type = genomic DNA

SEQ ID NO: 107322 - DNA, 81 bp, Homo sapiens; identical to SEQ ID NO: 75257
  misc_feature 1..81: note = chr12:8599745-8599826
  misc_feature 1..81: note = Hypo
  source 1..81: mol_type = genomic DNA

SEQ ID NO: 107323 - DNA, 30 bp, Homo sapiens; identical to SEQ ID NO: 75258
  misc_feature 1..30: note = chr12:8702283-8702313
  misc_feature 1..30: note = Hypo
  source 1..30: mol_type = genomic DNA

SEQ ID NO: 107324 - DNA, 143 bp, Homo sapiens; identical to SEQ ID NO: 75259
  misc_feature 1..143: note = chr12:8746970-8747113
  misc_feature 1..143: note = Hypo
  source 1..143: mol_type = genomic DNA

SEQ ID NO: 107325 - DNA, 30 bp, Homo sapiens; identical to SEQ ID NO: 43368
  misc_feature 1..30: note = chr12:8748716-8748746
  misc_feature 1..30: note = Hypo
  source 1..30: mol_type = genomic DNA

SEQ ID NO: 107326 - DNA, 175 bp, Homo sapiens; identical to SEQ ID NO: 75261
  misc_feature 1..175: note = chr12:8749845-8750020
  misc_feature 1..175: note = Hypo
  source 1..175: mol_type = genomic DNA

SEQ ID NO: 107327 - DNA, 149 bp, Homo sapiens; identical to SEQ ID NO: 75262
  misc_feature 1..149: note = chr12:8751025-8751174
  misc_feature 1..149: note = Hypo
  source 1..149: mol_type = genomic DNA

SEQ ID NO: 107328 - DNA, 30 bp, Homo sapiens; identical to SEQ ID NO: 75263
  misc_feature 1..30: note = chr12:8757665-8757695
  misc_feature 1..30: note = Hypo
  source 1..30: mol_type = genomic DNA

SEQ ID NO: 107329 - DNA, 40 bp, Homo sapiens; identical to SEQ ID NO: 75264
  misc_feature 1..40: note = chr12:8757926-8757966
  misc_feature 1..40: note = Hypo
  source 1..40: mol_type = genomic DNA

SEQ ID NO: 107330 - DNA, 198 bp, Homo sapiens; identical to SEQ ID NO: 43370
  misc_feature 1..198: note = chr12:8790007-8790205
  misc_feature 1..198: note = Hypo
  source 1..198: mol_type = genomic DNA

SEQ ID NO: 107331 - DNA, 61 bp, Homo sapiens; identical to SEQ ID NO: 43371
  misc_feature 1..61: note = chr12:8799944-8800005
  misc_feature 1..61: note = Hypo
  source 1..61: mol_type = genomic DNA

SEQ ID NO: 107332 - DNA, 81 bp, Homo sapiens; identical to SEQ ID NO: 15635
  misc_feature 1..81: note = chr12:8808559-8808640
  misc_feature 1..81: note = Hypo
  source 1..81: mol_type = genomic DNA

SEQ ID NO: 107333 - DNA, 29 bp, Homo sapiens
  misc_feature 1..29: note = chr12:8835074-8835103
  misc_feature 1..29: note = Hypo
  source 1..29: mol_type = genomic DNA
ttactgggaaatggccgggtgcggtggct

SEQ ID NO: 107334 - DNA, 214 bp, Homo sapiens; identical to SEQ ID NO: 75269
  misc_feature 1..214: note = chr12:8850501-8850715
  misc_feature 1..214: note = Hyper
  source 1..214: mol_type = genomic DNA

SEQ ID NO: 107335 - DNA, 221 bp, Homo sapiens; identical to SEQ ID NO: 75270
  misc_feature 1..221: note = chr12:8851054-8851275
  misc_feature 1..221: note = Hyper
  source 1..221: mol_type = genomic DNA

SEQ ID NO: 107336 - DNA, 25 bp, Homo sapiens
  misc_feature 1..25: note = chr12:8869424-8869449
  misc_feature 1..25: note = Hypo
  source 1..25: mol_type = genomic DNA
caggctcaagcgatcttcccacctc

SEQ ID NO: 107337 - DNA, 24 bp, Homo sapiens
  misc_feature 1..24: note = chr12:8878090-8878114
  misc_feature 1..24: note = Hypo
  source 1..24: mol_type = genomic DNA
ctcacctgacgtcaggatgctcta

SEQ ID NO: 107338 - DNA, 30 bp, Homo sapiens; identical to SEQ ID NO: 75276
  misc_feature 1..30: note = chr12:8905690-8905720
  misc_feature 1..30: note = Hypo
  source 1..30: mol_type = genomic DNA

SEQ ID NO: 107339 - DNA, 80 bp, Homo sapiens; identical to SEQ ID NO: 43374
  misc_feature 1..80: note = chr12:8908240-8908320
  misc_feature 1..80: note = Hypo
  source 1..80: mol_type = genomic DNA

SEQ ID NO: 107340 - DNA, 42 bp, Homo sapiens; identical to SEQ ID NO: 75278
  misc_feature 1..42: note = chr12:8926134-8926176
  misc_feature 1..42: note = Hypo
  source 1..42: mol_type = genomic DNA

SEQ ID NO: 107341 - DNA, 190 bp, Homo sapiens; identical to SEQ ID NO: 75279
  misc_feature 1..190: note = chr12:8975180-8975370
  misc_feature 1..190: note = Hypo
  source 1..190: mol_type = genomic DNA

SEQ ID NO: 107342 - DNA, 173 bp, Homo sapiens; identical to SEQ ID NO: 75281
  misc_feature 1..173: note = chr12:8982315-8982488
  misc_feature 1..173: note = Hypo
  source 1..173: mol_type = genomic DNA

SEQ ID NO: 107343 - DNA, 103 bp, Homo sapiens; identical to SEQ ID NO: 43377
  misc_feature 1..103: note = chr12:8983831-8983934
  misc_feature 1..103: note = Hypo
  source 1..103: mol_type = genomic DNA

SEQ ID NO: 107344 - DNA, 18 bp, Homo sapiens
  misc_feature 1..18: note = chr12:8989364-8989382
  misc_feature 1..18: note = Hypo
  source 1..18: mol_type = genomic DNA
caccgcgcccagccaaga

SEQ ID NO: 107345 - DNA, 102 bp, Homo sapiens; identical to SEQ ID NO: 75285
  misc_feature 1..102: note = chr12:8995503-8995605
  misc_feature 1..102: note = Hypo
  source 1..102: mol_type = genomic DNA

SEQ ID NO: 107346 - DNA, 198 bp, Homo sapiens; identical to SEQ ID NO: 75287
  misc_feature 1..198: note = chr12:9006823-9007021
  misc_feature 1..198: note = Hypo
  source 1..198: mol_type = genomic DNA

SEQ ID NO: 107347 - DNA, 30 bp, Homo sapiens; identical to SEQ ID NO: 75288
  misc_feature 1..30: note = chr12:9008301-9008331
  misc_feature 1..30: note = Hypo
  source 1..30: mol_type = genomic DNA

SEQ ID NO: 107348 - DNA, 149 bp, Homo sapiens; identical to SEQ ID NO: 75289
  misc_feature 1..149: note = chr12:9010027-9010176
  misc_feature 1..149: note = Hypo
  source 1..149: mol_type = genomic DNA

SEQ ID NO: 107349 - DNA, 135 bp, Homo sapiens; identical to SEQ ID NO: 43379
  misc_feature 1..135: note = chr12:9016413-9016548
  misc_feature 1..135: note = Hypo
  source 1..135: mol_type = genomic DNA

SEQ ID NO: 107350 - DNA, 30 bp, Homo sapiens; identical to SEQ ID NO: 75291
  misc_feature 1..30: note = chr12:9020600-9020630
  misc_feature 1..30: note = Hypo
  source 1..30: mol_type = genomic DNA

SEQ ID NO: 107351 - DNA, 86 bp, Homo sapiens; identical to SEQ ID NO: 75293
  misc_feature 1..86: note = chr12:9026553-9026639
  misc_feature 1..86: note = Hypo
  source 1..86: mol_type = genomic DNA

SEQ ID NO: 107352 - DNA, 20 bp, Homo sapiens
  misc_feature 1..20: note = chr12:9187316-9187336
  misc_feature 1..20: note = Hypo
  source 1..20: mol_type = genomic DNA
acaggcgtgaggcaccgtgc

SEQ ID NO: 107353 - DNA, 152 bp, Homo sapiens; identical to SEQ ID NO: 75296
  misc_feature 1..152: note = chr12:9203194-9203346
  misc_feature 1..152: note = Hypo
  source 1..152: mol_type = genomic DNA

SEQ ID NO: 107354 - DNA, 30 bp, Homo sapiens; identical to SEQ ID NO: 75297
  misc_feature 1..30: note = chr12:9251150-9251180
  misc_feature 1..30: note = Hypo
  source 1..30: mol_type = genomic DNA

SEQ ID NO: 107355 - DNA, 34 bp, Homo sapiens; identical to SEQ ID NO: 75317
  misc_feature 1..34: note = chr12:9501895-9501929
  misc_feature 1..34: note = Hypo
  source 1..34: mol_type = genomic DNA

SEQ ID NO: 107356 - DNA, 19 bp, Homo sapiens
  misc_feature 1..19: note = chr12:9916173-9916192
  misc_feature 1..19: note = Hypo
  source 1..19: mol_type = genomic DNA
tttttttttttttttcgag

SEQ ID NO: 107357 - DNA, 30 bp, Homo sapiens; identical to SEQ ID NO: 75345
  misc_feature 1..30: note = chr12:9964565-9964595
  misc_feature 1..30: note = Hypo
  source 1..30: mol_type = genomic DNA

SEQ ID NO: 107358 - DNA, 258 bp, Homo sapiens; identical to SEQ ID NO: 73608
  misc_feature 1..258: note = chr12:10029304-10029562
  misc_feature 1..258: note = Hypo
  source 1..258: mol_type = genomic DNA

SEQ ID NO: 107359 - DNA, 29 bp, Homo sapiens
  misc_feature 1..29: note = chr12:10085916-10085945
  misc_feature 1..29: note = Hypo
  source 1..29: mol_type = genomic DNA
gtaaaactggctgggcgcggtgtctgtca

SEQ ID NO: 107360 - DNA, 28 bp, Homo sapiens
  misc_feature 1..28: note = chr12:10086245-10086273
  misc_feature 1..28: note = Hypo
  source 1..28: mol_type = genomic DNA
gcttttggtgcttcggtgcagagacaga

SEQ ID NO: 107361 - DNA, 100 bp, Homo sapiens; identical to SEQ ID NO: 73617
  misc_feature 1..100: note = chr12:10187643-10187743
  misc_feature 1..100: note = Hypo
  source 1..100: mol_type = genomic DNA

SEQ ID NO: 107362 - DNA, 137 bp, Homo sapiens; identical to SEQ ID NO: 73619
  misc_feature 1..137: note = chr12:10243173-10243310
  misc_feature 1..137: note = Hypo
  source 1..137: mol_type = genomic DNA

SEQ ID NO: 107363 - DNA, 48 bp, Homo sapiens; identical to SEQ ID NO: 73620
  misc_feature 1..48: note = chr12:10264235-10264283
  misc_feature 1..48: note = Hypo
  source 1..48: mol_type = genomic DNA

SEQ ID NO: 107364 - DNA, 30 bp, Homo sapiens; identical to SEQ ID NO: 73621
  misc_feature 1..30: note = chr12:10264869-10264899
  misc_feature 1..30: note = Hypo
  source 1..30: mol_type = genomic DNA

SEQ ID NO: 107365 - DNA, 30 bp, Homo sapiens; identical to SEQ ID NO: 73622
  misc_feature 1..30: note = chr12:10268125-10268155
  misc_feature 1..30: note = Hypo
  source 1..30: mol_type = genomic DNA

SEQ ID NO: 107366 - DNA, 179 bp, Homo sapiens; identical to SEQ ID NO: 73623
  misc_feature 1..179: note = chr12:10306356-10306535
  misc_feature 1..179: note = Hyper
  source 1..179: mol_type = genomic DNA

SEQ ID NO: 107367 - DNA, 41 bp, Homo sapiens; identical to SEQ ID NO: 43385
  misc_feature 1..41: note = chr12:10363278-10363319
  misc_feature 1..41: note = Hypo
  source 1..41: mol_type = genomic DNA

SEQ ID NO: 107368 - DNA, 222 bp, Homo sapiens; identical to SEQ ID NO: 73639
  misc_feature 1..222: note = chr12:10364324-10364546
  misc_feature 1..222: note = Hypo
  source 1..222: mol_type = genomic DNA

SEQ ID NO: 107369 - DNA, 30 bp, Homo sapiens; identical to SEQ ID NO: 73640
  misc_feature 1..30: note = chr12:10366550-10366580
  misc_feature 1..30: note = Hyper
  source 1..30: mol_type = genomic DNA

SEQ ID NO: 107370 - DNA, 35 bp, Homo sapiens; identical to SEQ ID NO: 73684
  misc_feature 1..35: note = chr12:10658417-10658452
  misc_feature 1..35: note = Hypo
  source 1..35: mol_type = genomic DNA

SEQ ID NO: 107371 - DNA, 218 bp, Homo sapiens; identical to SEQ ID NO: 73706
  misc_feature 1..218: note = chr12:10813764-10813982
  misc_feature 1..218: note = Hypo
  source 1..218: mol_type = genomic DNA

SEQ ID NO: 107372 - DNA, 32 bp, Homo sapiens; identical to SEQ ID NO: 43387
  misc_feature 1..32: note = chr12:10823904-10823936
  misc_feature 1..32: note = Hypo
  source 1..32: mol_type = genomic DNA

SEQ ID NO: 107373 - DNA, 17 bp, Homo sapiens
  misc_feature 1..17: note = chr12:10857716-10857733
  misc_feature 1..17: note = Hypo
  source 1..17: mol_type = genomic DNA
ggagtctcactctgtcg

SEQ ID NO: 107374 - DNA, 174 bp, Homo sapiens; identical to SEQ ID NO: 73720
  misc_feature 1..174: note = chr12:10875104-10875278
  misc_feature 1..174: note = Hyper
  source 1..174: mol_type = genomic DNA

SEQ ID NO: 107375 - DNA, 339 bp, Homo sapiens
  misc_feature 1..339: note = chr12:11653449-11653788
  misc_feature 1..339: note = Hyper
  source 1..339: mol_type = genomic DNA
ggagctcagggccatcgtgctgaaccaacagaggctcgtccgcacccagcgccagagcatcgacgagctggagcggcggctgaacgagctgagcgcctagaatcgcagcctgtgggagcatccgcagctgccgcaagcgcagcctccgcccggattccttacctcgtagccgtccccgctgccggccctcctaggcaccgctgccgccgccaccgccggggcccaggaacatcttcaggaccacggacagcgctcatccgcccggccactgcccgcgcccgagctggcatcgtttcagaaccacgaacagctcctggcgcaacccgagccagaccctgg

SEQ ID NO: 107376 - DNA, 41 bp, Homo sapiens; identical to SEQ ID NO: 73905
  misc_feature 1..41: note = chr12:11745619-11745660
  misc_feature 1..41: note = Hypo
  source 1..41: mol_type = genomic DNA

SEQ ID NO: 107377 - DNA, 30 bp, Homo sapiens; identical to SEQ ID NO: 74031
  misc_feature 1..30: note = chr12:12397276-12397306
  misc_feature 1..30: note = Hypo
  source 1..30: mol_type = genomic DNA

SEQ ID NO: 107378 - DNA, 30 bp, Homo sapiens; identical to SEQ ID NO: 74036
  misc_feature 1..30: note = chr12:12419446-12419476
  misc_feature 1..30: note = Hyper
  source 1..30: mol_type = genomic DNA

SEQ ID NO: 107379 - DNA, 45 bp, Homo sapiens; identical to SEQ ID NO: 74067
  misc_feature 1..45: note = chr12:12504479-12504524
  misc_feature 1..45: note = Hypo
  source 1..45: mol_type = genomic DNA

SEQ ID NO: 107380 - DNA, 215 bp, Homo sapiens; identical to SEQ ID NO: 74112
  misc_feature 1..215: note = chr12:12848341-12848556
  misc_feature 1..215: note = Hypo
  source 1..215: mol_type = genomic DNA

SEQ ID NO: 107381 - DNA, 224 bp, Homo sapiens; identical to SEQ ID NO: 74113
  misc_feature 1..224: note = chr12:12869188-12869412
  misc_feature 1..224: note = Hyper
  source 1..224: mol_type = genomic DNA

SEQ ID NO: 107382 - DNA, 93 bp, Homo sapiens; identical to SEQ ID NO: 43389
  misc_feature 1..93: note = chr12:13025675-13025768
  misc_feature 1..93: note = Hypo
  source 1..93: mol_type = genomic DNA

SEQ ID NO: 107383 - DNA, 187 bp, Homo sapiens; identical to SEQ ID NO: 43390
  misc_feature 1..187: note = chr12:13030748-13030935
  misc_feature 1..187: note = Hypo
  source 1..187: mol_type = genomic DNA

SEQ ID NO: 107384 - DNA, 42 bp, Homo sapiens; identical to SEQ ID NO: 74140
  misc_feature 1..42: note = chr12:13035995-13036037
  misc_feature 1..42: note = Hypo
  source 1..42: mol_type = genomic DNA

SEQ ID NO: 107385 - DNA, 30 bp, Homo sapiens; identical to SEQ ID NO: 74151
  misc_feature 1..30: note = chr12:13054219-13054249
  misc_feature 1..30: note = Hypo
  source 1..30: mol_type = genomic DNA

SEQ ID NO: 107386 - DNA, 43 bp, Homo sapiens; identical to SEQ ID NO: 34247
  misc_feature 1..43: note = chr12:13069440-13069483
  misc_feature 1..43: note = Hyper
  source 1..43: mol_type = genomic DNA

SEQ ID NO: 107387 - DNA, 388 bp, Homo sapiens; identical to SEQ ID NO: 74162
  misc_feature 1..388: note = chr12:13079623-13080011
  misc_feature 1..388: note = Hypo
  source 1..388: mol_type = genomic DNA

SEQ ID NO: 107388 - DNA, 269 bp, Homo sapiens; identical to SEQ ID NO: 74212
  misc_feature 1..269: note = chr12:13154515-13154784
  misc_feature 1..269: note = Hyper
  source 1..269: mol_type = genomic DNA

SEQ ID NO: 107389 - DNA, 24 bp, Homo sapiens
  misc_feature 1..24: note = chr12:13199095-13199119
  misc_feature 1..24: note = Hypo
  source 1..24: mol_type = genomic DNA
ataccaccctgaacgcgcccgatc

SEQ ID NO: 107390 - DNA, 24 bp, Homo sapiens
  misc_feature 1..24: note = chr12:13199179-13199203
  misc_feature 1..24: note = Hypo
  source 1..24: mol_type = genomic DNA
gttcacttgcgtttttccttgtct

SEQ ID NO: 107391 - DNA, 94 bp, Homo sapiens; identical to SEQ ID NO: 15639
  misc_feature 1..94: note = chr12:13215216-13215310
  misc_feature 1..94: note = Hypo
  source 1..94: mol_type = genomic DNA

SEQ ID NO: 107392 - DNA, 30 bp, Homo sapiens; identical to SEQ ID NO: 43394
  misc_feature 1..30: note = chr12:13229039-13229069
  misc_feature 1..30: note = Hypo
  source 1..30: mol_type = genomic DNA

SEQ ID NO: 107393 - DNA, 128 bp, Homo sapiens; identical to SEQ ID NO: 74383
  misc_feature 1..128: note = chr12:13431237-13431365
  misc_feature 1..128: note = Hyper
  source 1..128: mol_type = genomic DNA

SEQ ID NO: 107394 - DNA, 32 bp, Homo sapiens; identical to SEQ ID NO: 74384
  misc_feature 1..32: note = chr12:13519032-13519064
  misc_feature 1..32: note = Hypo
  source 1..32: mol_type = genomic DNA

SEQ ID NO: 107395 - DNA, 60 bp, Homo sapiens; identical to SEQ ID NO: 74385
  misc_feature 1..60: note = chr12:13716048-13716108
  misc_feature 1..60: note = Hypo
  source 1..60: mol_type = genomic DNA

SEQ ID NO: 107396 - DNA, 114 bp, Homo sapiens; identical to SEQ ID NO: 74386
  misc_feature 1..114: note = chr12:13716358-13716472
  misc_feature 1..114: note = Hypo
  source 1..114: mol_type = genomic DNA

SEQ ID NO: 107397 - DNA, 2142 bp, Homo sapiens; identical to SEQ ID NO: 74387
  misc_feature 1..2142: note = chr12:14133113-14135255
  misc_feature 1..2142: note = Hyper
  source 1..2142: mol_type = genomic DNA

SEQ ID NO: 107398 - DNA, 41 bp, Homo sapiens; identical to SEQ ID NO: 74388
  misc_feature 1..41: note = chr12:14720466-14720507
  misc_feature 1..41: note = Hyper
  source 1..41: mol_type = genomic DNA

SEQ ID NO: 107399 - DNA, 36 bp, Homo sapiens; identical to SEQ ID NO: 43396
  misc_feature 1..36: note = chr12:14817857-14817893
  misc_feature 1..36: note = Hypo
  source 1..36: mol_type = genomic DNA

SEQ ID NO: 107400 - DNA, 18 bp, Homo sapiens
  misc_feature 1..18: note = chr12:14905519-14905537
  misc_feature 1..18: note = Hypo
  source 1..18: mol_type = genomic DNA
aaaaaaaaagctggccgg

SEQ ID NO: 107401 - DNA, 30 bp, Homo sapiens; identical to SEQ ID NO: 43398
  misc_feature 1..30: note = chr12:14926203-14926233
  misc_feature 1..30: note = Hypo
  source 1..30: mol_type = genomic DNA

SEQ ID NO: 107402 - DNA, 1175 bp, Homo sapiens; identical to SEQ ID NO: 74392
  misc_feature 1..1175: note = chr12:14927036-14928211
  misc_feature 1..1175: note = Hyper
  source 1..1175: mol_type = genomic DNA

SEQ ID NO: 107403 - DNA, 172 bp, Homo sapiens; identical to SEQ ID NO: 74393
  misc_feature 1..172: note = chr12:14929885-14930057
  misc_feature 1..172: note = Hypo
  source 1..172: mol_type = genomic DNA

SEQ ID NO: 107404 - DNA, 30 bp, Homo sapiens; identical to SEQ ID NO: 74394
  misc_feature 1..30: note = chr12:14930753-14930783
  misc_feature 1..30: note = Hypo
  source 1..30: mol_type = genomic DNA

SEQ ID NO: 107405 - DNA, 107 bp, Homo sapiens; identical to SEQ ID NO: 74395
  misc_feature 1..107: note = chr12:15037662-15037769
  misc_feature 1..107: note = Hyper
  source 1..107: mol_type = genomic DNA

SEQ ID NO: 107406 - DNA, 448 bp, Homo sapiens; identical to SEQ ID NO: 74396
  misc_feature 1..448: note = chr12:15374143-15374591
  misc_feature 1..448: note = Hyper
  source 1..448: mol_type = genomic DNA

SEQ ID NO: 107407 - DNA, 73 bp, Homo sapiens; identical to SEQ ID NO: 74397
  misc_feature 1..73: note = chr12:15475263-15475336
  misc_feature 1..73: note = Hyper
  source 1..73: mol_type = genomic DNA

SEQ ID NO: 107408 - DNA, 291 bp, Homo sapiens; identical to SEQ ID NO: 74398
  misc_feature 1..291: note = chr12:15475751-15476042
  misc_feature 1..291: note = Hyper
  source 1..291: mol_type = genomic DNA

SEQ ID NO: 107409 - DNA, 103 bp, Homo sapiens; identical to SEQ ID NO: 74402
  misc_feature 1..103: note = chr12:16500483-16500586
  misc_feature 1..103: note = Hyper
  source 1..103: mol_type = genomic DNA

SEQ ID NO: 107410 - DNA, 175 bp, Homo sapiens; identical to SEQ ID NO: 74405
  misc_feature 1..175: note = chr12:16757916-16758091
  misc_feature 1..175: note = Hyper
  source 1..175: mol_type = genomic DNA

SEQ ID NO: 107411 - DNA, 30 bp, Homo sapiens; identical to SEQ ID NO: 34260
  misc_feature 1..30: note = chr12:16758398-16758428
  misc_feature 1..30: note = Hyper
  source 1..30: mol_type = genomic DNA

SEQ ID NO: 107412 - DNA, 40 bp, Homo sapiens; identical to SEQ ID NO: 74407
  misc_feature 1..40: note = chr12:16758692-16758732
  misc_feature 1..40: note = Hyper
  source 1..40: mol_type = genomic DNA

SEQ ID NO: 107413 - DNA, 82 bp, Homo sapiens; identical to SEQ ID NO: 43400
  misc_feature 1..82: note = chr12:17629461-17629543
  misc_feature 1..82: note = Hypo
  source 1..82: mol_type = genomic DNA

SEQ ID NO: 107414 - DNA, 222 bp, Homo sapiens; identical to SEQ ID NO: 74417
  misc_feature 1..222: note = chr12:19283203-19283425
  misc_feature 1..222: note = Hyper
  source 1..222: mol_type = genomic DNA

SEQ ID NO: 107415 - DNA, 109 bp, Homo sapiens; identical to SEQ ID NO: 74418
  misc_feature 1..109: note = chr12:19283674-19283783
  misc_feature 1..109: note = Hyper
  source 1..109: mol_type = genomic DNA

SEQ ID NO: 107416 - DNA, 35 bp, Homo sapiens; identical to SEQ ID NO: 43401
  misc_feature 1..35: note = chr12:19636251-19636286
  misc_feature 1..35: note = Hypo
  source 1..35: mol_type = genomic DNA

SEQ ID NO: 107417 - DNA, 97 bp, Homo sapiens; identical to SEQ ID NO: 74425
  misc_feature 1..97: note = chr12:19780563-19780660
  misc_feature 1..97: note = Hypo
  source 1..97: mol_type = genomic DNA

SEQ ID NO: 107418 - DNA, 35 bp, Homo sapiens; identical to SEQ ID NO: 74430
  misc_feature 1..35: note = chr12:20198455-20198490
  misc_feature 1..35: note = Hypo
  source 1..35: mol_type = genomic DNA

SEQ ID NO: 107419 - DNA, 697 bp, Homo sapiens; identical to SEQ ID NO: 74438
  misc_feature 1..697: note = chr12:20521144-20521841
  misc_feature 1..697: note = Hyper
  source 1..697: mol_type = genomic DNA

SEQ ID NO: 107420 - DNA, 664 bp, Homo sapiens
  misc_feature 1..664: note = chr12:20522108-20522772
  misc_feature 1..664: note = Hyper
  source 1..664: mol_type = genomic DNA
ggaagagcgtgcgtgcgtgtgtgtgtgtgtgtgtgtgcgcgcgcgcgcgtgggtcggggcgggggcgtcggggggccactgggaattcagtgaagagggcaccctataccatggcagtgcccggcgacgctgcacgagtcagggacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcactt

SEQ ID NO: 107421 - DNA, 44 bp, Homo sapiens; identical to SEQ ID NO: 74441
  misc_feature 1..44: note = chr12:20523073-20523117
  misc_feature 1..44: note = Hyper
  source 1..44: mol_type = genomic DNA

SEQ ID NO: 107422 - DNA, 19 bp, Homo sapiens
  misc_feature 1..19: note = chr12:20685629-20685648
  misc_feature 1..19: note = Hypo
  source 1..19: mol_type = genomic DNA
tttttttttttgagacgga

SEQ ID NO: 107423 - DNA, 656 bp, Homo sapiens; identical to SEQ ID NO: 74448
  misc_feature 1..656: note = chr12:21680364-21681020
  misc_feature 1..656: note = Hyper
  source 1..656: mol_type = genomic DNA

SEQ ID NO: 107424 - DNA, 501 bp, Homo sapiens; identical to SEQ ID NO: 74449
  misc_feature 1..501: note = chr12:21810473-21810974
  misc_feature 1..501: note = Hyper
  source 1..501: mol_type = genomic DNA

SEQ ID NO: 107425 - DNA, 27 bp, Homo sapiens
  misc_feature 1..27: note = chr12:21833068-21833095
  misc_feature 1..27: note = Hypo
  source 1..27: mol_type = genomic DNA
aattcaagtttgggccgaagtttaaag

SEQ ID NO: 107426 - DNA, 30 bp, Homo sapiens; identical to SEQ ID NO: 74451
  misc_feature 1..30: note = chr12:21860015-21860045
  misc_feature 1..30: note = Hypo
  source 1..30: mol_type = genomic DNA

SEQ ID NO: 107427 - DNA, 778 bp, Homo sapiens
  misc_feature 1..778: note = chr12:21927174-21927952
  misc_feature 1..778: note = Hyper
  source 1..778: mol_type = genomic DNA
gaattattttaaatgcgaaagaagtatgagttgcatctaaaaagagttaaaaaggttcctgtggaaatcataatattataaattgaaaacttttttttttttttttttttacaacgaaggaatcaaatatacaaggtgcgggggggaaaaaacccaagacaacagcctgcgggttgcagtagggagtgtgccccgaaaagtccatccatcactgcaagcctctgcggtgttttgcattttaaatcatttacgggaacacggacagcctcccccctccgctcccccggagcagctttgaaacttacagactccgggtagcgggcgcggcggctggacctccttgcacacgccggcgggccgcgggcaggtccctcgctctcccatgctggcgcgcgggaccaggggccgcccaggccggagggacaaattgggggctgcgtgtcctaaggagaagagttaaaataataaaaggtgcaactgaatctaaacgcagggagggctagaggaagggggatgggtgtagatcttcccctccccctgctcagctcaactcccttggccacttcagtggaaggaggagggactgggggggcgggggcgggggggcgatgctccacaaatcagcctcccagttagggctttgacgcacgccagacctcggaagccgacgttgtcgcggagtagggggcgggcggggagggggcgagcgcaagtccccgggaggtagggagcaggccagagggagggacgacccgggggagggcgggacctgcagagc

SEQ ID NO: 107428 - DNA, 34 bp, Homo sapiens; identical to SEQ ID NO: 34269
  misc_feature 1..34: note = chr12:21928417-21928451
  misc_feature 1..34: note = Hyper
  source 1..34: mol_type = genomic DNA

SEQ ID NO: 107429 - DNA, 1532 bp, Homo sapiens
  misc_feature 1..1532: note = chr12:22093664-22095196
  misc_feature 1..1532: note = Hyper
  source 1..1532: mol_type = genomic DNA
gcttcaaacccctgccggtgcacttgagctaccttcaaaacaccgacttcctacactgtcttaagatgtaaatttcaaacccggacgcagaactcctaaaaaaaagtaaagagtaacaaaaattaagcagatagaaaactacttcttgaacatacaagaattgtctacaagaaaggcggtaataataactcctaataataataactcctttcactgtttccagttgatttgagtaggagacggcagttttgaagtaaaactggaaacctgatccccaccccttcacttctcgagccgggcctcgtcccttaattctagaaatagcgatcgcgaaagctaagtgccgagaagtgcgagagagtgcgagggcgtttttggatagcagaaatgttagctcaaaatcgacaacttacagttattcctaaaaatgtttaaatggcattcatgtaaaagacacggattcacttactccgatgacagttttcctcccctaggcgaagcacgcagtgcgccggaacggattatttttagggtggtgggagaccagctgctgcctcctatcgagtttctaaattgcacagactgctctgggccggggcagacaccgcggctgagaagcaggaaactgggcagaagccccgcgcgccgcgcctggggccggagaccttccccatccctgctctgctcagctttgacttggggcgggcgcgacgccgcgattttacaaacccaagtaataggcgtccccttaaacttcattagacactgaaacttggaatatgattccatgattctccggagtcgggttttcaaacgtcaaaacactcaaggtattcttgtttctttgttttgtttttccatgctctgtaagcacccctttattagccacgtaaggaagcggatttggggatttcgctgtttccccctgaacggatccgggaaatgaagggctcattctaggtagaggcacccactgctgggttatgagtgcacgaatgtctcacaggagcaaggctggctcaagtctaattttccgcttttccccggcgacctagaaaacttggtttctctggtggaccagccgccgcgctatcgaagggcgacccttgcccaccgtcccctaaagtgagacgctgattcccatggactgcgtaaacagtcaccctcttctcctgtttccaaccagagacataattaactctcgagataacgtgtttatattaagatcaccccacaaccactcccccgcgaaacacaagccgtgaattttgtccccgacaaccctctttaattaacaccggattttctcaagagccagttttgagtcagcttgagataagcattgttttcaggaactgtcgtattttaataaaggatggtcagccgggcggacttctgcccctgaggctccgcatgccgtcctcaaggggcgccgctgcaggactgcggtctgctggcgctggtccccagatctgaaccctaaacaccggtggcctcgtggcctgtgcgatgcaggccgactccagccctgc

SEQ ID NO: 107430 - DNA, 1463 bp, Homo sapiens
  misc_feature 1..1463: note = chr12:22486799-22488262
  misc_feature 1..1463: note = Hyper
  source 1..1463: mol_type = genomic DNA
aaggacatggaagagcggatgaaagggatgcctctgcgagacggtgcaaggcggtcctcgccggtgaccctgtcctctgcactcggggaggaaaggacgctagaggggaggagccgcgagggcaggagtacctgaacgctctggccgcggtctggttcctcctccacgccgtgccctgttgcagcaccccctgcacgatctctttctcgttgggcagccggtagacggggaagatgtagagccaacagaggaccacgacacagagggcactggctcccatgggcagccgggtccgcgggaacttccacgccagtacagccatggcccctctggacgtttgtcgccgggcccgcccgcaggggctcatcgcagccccggcgtcccaggggcgggggccggggcctcagcacaaagctaggcgaagtggcagcggagggtcccccaccgccagccccccatgcacacacacctttggttctcttacttgcaaacgcacgcacgcttcttcggccccgtcggccccaaaggtcagcgcaaggattttttcaaatgcaacttttccaaggatttctttctaggggaagtggctgggggtgaagtcacgatctatggccatggtcgcttcccctgcagaaggcgggcgctggggtctccgagtgcgcagagagcggcggcggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgc

SEQ ID NO: 107431 - DNA, 383 bp, Homo sapiens
  misc_feature 1..383: note = chr12:22488322-22488705
  misc_feature 1..383: note = Hyper
  source 1..383: mol_type = genomic DNA
gcaagcgagcgcgcgcacgaggaggtgcgtgcactccggggtcctccgcctcgcctcctccctgaaaggaagtgctgcatccagatgtgcaggcagctggtgcccaaacactagacctcaagatgtcacattgccttggaggcgcgcggccttttagattaaaggaccgttggttcttagacgtccttcttgcccttcttgcttgtgataagcgataagcttatcgcaaccccgaccttggaaaagcaccacccgccttgacccaccgagccgagagagtcgctgttagccatttctgctcgccccggcggccgacgcatagctcgggtacctcctagcggtcgcctattctatttgcttaagcatctcgtcaagcataaagt

SEQ ID NO: 107432 - DNA, 215 bp, Homo sapiens; identical to SEQ ID NO: 74464
  misc_feature 1..215: note = chr12:22634363-22634578
  misc_feature 1..215: note = Hypo
  source 1..215: mol_type = genomic DNA

SEQ ID NO: 107433 - DNA, 95 bp, Homo sapiens; identical to SEQ ID NO: 74465
  misc_feature 1..95: note = chr12:22698101-22698196
  misc_feature 1..95: note = Hypo
  source 1..95: mol_type = genomic DNA

SEQ ID NO: 107434 - DNA, 134 bp, Homo sapiens; identical to SEQ ID NO: 74466
  misc_feature 1..134: note = chr12:22852676-22852810
  misc_feature 1..134: note = Hypo
  source 1..134: mol_type = genomic DNA

SEQ ID NO: 107435 - DNA, 27 bp, Homo sapiens
  misc_feature 1..27: note = chr12:22987972-22987999
  misc_feature 1..27: note = Hypo
  source 1..27: mol_type = genomic DNA
agccaccgcgcccggcctcatttttta

SEQ ID NO: 107436 - DNA, 17 bp, Homo sapiens
  misc_feature 1..17: note = chr12:24596179-24596196
  misc_feature 1..17: note = Hypo
  source 1..17: mol_type = genomic DNA
cccggccagtttatgga

SEQ ID NO: 107437 - DNA, 196 bp, Homo sapiens; identical to SEQ ID NO: 74472
  misc_feature 1..196: note = chr12:24632145-24632341
  misc_feature 1..196: note = Hypo
  source 1..196: mol_type = genomic DNA

SEQ ID NO: 107438 - DNA, 1030 bp, Homo sapiens; identical to SEQ ID NO: 74473
  misc_feature 1..1030: note = chr12:24714475-24715505
  misc_feature 1..1030: note = Hyper
  source 1..1030: mol_type = genomic DNA

SEQ ID NO: 107439 - DNA, 660 bp, Homo sapiens
  misc_feature 1..660: note = chr12:24715757-24716417
  misc_feature 1..660: note = Hyper
  source 1..660: mol_type = genomic DNA
ctccttcttgcagctcgccgcccggccgccctctctatccatccgaagggaaggagccccagagttttcttccccgtctgctgcagagtaactagattgtaaataacgcggcgattacccacaccgtgcaggaattttttttttatctgccctccacttaaaggagcgataaaaatgaaatggcaggagtggaaggagccagggagagcgggatatctctagatctcgatggagctcgcatctataaatacgcattcatgtttagtcaagtccctttgtcaacttcttcccggcgcctgagcctcagccgctgctctgcgcccaggacctggcccctcccggccccctagtccagtggtcaggcggtcgggccggcagggagggcgcgcgcggggggctgcggggtccgtggaacctttccgggaggcgagccgcgggctgctgggcgcggaggctggagccgcgagaggttcggctgctgaagcggccactgcctcccagagccaggctccgcgccgcgcgtccccgccgccgccggcactgtgcacccacctactcctcggagattggggtaggggaaaaaagttttgaggcgctctcatctctgcctccggggtggttgaactggtttggttttgtgttaagcgaagccaaaaaaaa

SEQ ID NO: 107440 - DNA, 1071 bp, Homo sapiens
  misc_feature 1..1071: note = chr12:25055472-25056543
  misc_feature 1..1071: note = Hyper
  source 1..1071: mol_type = genomic DNA
ggaggcagaaggctgcggtcaaaatattttggggtggcagagtcacgtaggatgtggctgtgggttctggcagcccagagattcagctcccgcctcctccctcagagcgagtccatagctaccctcacgtcccccgtggcggtcctcgccacgctccggagcgggttacccatgagggtgctagacctgggcagcgggaacctcgaagaggtggagattgcaggctgggactccagatttcgggcagggatgcggggaagggaagacgcctcgctggaggcggaatggagggcaaggcgaaggaggatggtgcaggaaacggcgacaaggcgcccggccaggcccgcgagctaccgagacccgggttccaatcctccccccttccgcaaacgcccgggttcgaggtacctggcgggcaagggccgcagcggagcgaagcgggctggccatggggaggctgcggggacgcggggctgcagagagcggcagtggcacggagcgcgcggctggaagcgaaagcaggcggtgtggccaagccccggcgcacggcccatagggcgctgggtaccacgacctggggccgcgcgccagggccaggcgcagggtacgacgcaacccctccagcatcccttggggaggagcctccaaccgtctcgtcccagtctgtctgcagtcgctaaaaccgaagcggttgtccctgtcaccggggtcgcttgcggaggcccgagaatgcgcgccacgaacgagcgcctttccaagcgcagatatttcgcgagcatccttgtttattaaacaacctctaggtgaatggccgggaagcgcccctcggtcaaggctaaggaaacctcggagaaactacattagggcagcttttccaccgactccaaatccaactgacaaaaagcagtttctgccctcgagagtttgcgggcggggattgacatttgtgcgtctgctcttgtctgccactgaccgctatgtgcaaactgaagggggagaacgtgaatccagcttttagatttccctgcgccacctacccaaaccgaatttgtaactcggggtgttatgggg

SEQ ID NO: 107441 - DNA, 187 bp, Homo sapiens; identical to SEQ ID NO: 43404
  misc_feature 1..187: note = chr12:25059405-25059592
  misc_feature 1..187: note = Hypo
  source 1..187: mol_type = genomic DNA

SEQ ID NO: 107442 - DNA, 97 bp, Homo sapiens; identical to SEQ ID NO: 74480
  misc_feature 1..97: note = chr12:25081512-25081609
  misc_feature 1..97: note = Hypo
  source 1..97: mol_type = genomic DNA

SEQ ID NO: 107443 - DNA, 913 bp, Homo sapiens
  misc_feature 1..913: note = chr12:25101375-25102288
  misc_feature 1..913: note = Hyper
  source 1..913: mol_type = genomic DNA
taacagtgaaaagatcgttctccctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgtagcagactttcacctccgttcccaaaagcgaatgtgaaaaagtccgagaaggcacgtcctgcgagtggaggttaaaccgaaatctgaacagaatgcacggtccccgcaaactacgattgataaagaagatactgagacgtttgcgggggatataagccatggttgtctcgccttcctcccctccctgccaactatgtttcttggagaaatcgccggttcgattcacgcacacatttttgtaaaacacggacaaaaccataagtagttaccttcattgttccgtcggccacgagggaagctcgagctgagcggagggcagatcccaagggtcgtagcccctggccgtgtggaccgggtctgcggctgcagagcgcggtcccggctgcagcaagacctggggcagtgcccgaggcggcggcgagtacacgtggcgggctggattgcagaccggccctctcgcggcggagactcgcgacctagcggattgcatcagcaggaagacactaaggctgctcccccaggccgcccccagatggtggagtctctcccagcccgaagattcggagccagcgcccagacccgagcctcactcactgctcactcccggggtgcagggcagaggtgccagtgttgcaagcaaatgacacggttacccccgaatcagccactgtgggtgcgtatccgagtgtggggatgc

SEQ ID NO: 107444 - DNA, 30 bp, Homo sapiens; identical to SEQ ID NO: 74483
  misc_feature 1..30: note = chr12:25154975-25155005
  misc_feature 1..30: note = Hypo
  source 1..30: mol_type = genomic DNA

SEQ ID NO: 107445 - DNA, 25 bp, Homo sapiens
  misc_feature 1..25: note = chr12:25191255-25191280
  misc_feature 1..25: note = Hypo
  source 1..25: mol_type = genomic DNA
caaaattgcaaatgacgaactataa

SEQ ID NO: 107446 - DNA, 30 bp, Homo sapiens; identical to SEQ ID NO: 43407
  misc_feature 1..30: note = chr12:25195744-25195774
  misc_feature 1..30: note = Hypo
  source 1..30: mol_type = genomic DNA

SEQ ID NO: 107447 - DNA, 120 bp, Homo sapiens; identical to SEQ ID NO: 74486
  misc_feature 1..120: note = chr12:25202526-25202646
  misc_feature 1..120: note = Hypo
  source 1..120: mol_type = genomic DNA

SEQ ID NO: 107448 - DNA, 214 bp, Homo sapiens; identical to SEQ ID NO: 74487
  misc_feature 1..214: note = chr12:25256767-25256981
  misc_feature 1..214: note = Hypo
  source 1..214: mol_type = genomic DNA

SEQ ID NO: 107449 - DNA, 32 bp, Homo sapiens; identical to SEQ ID NO: 74488
  misc_feature 1..32: note = chr12:25262917-25262949
  misc_feature 1..32: note = Hypo
  source 1..32: mol_type = genomic DNA

SEQ ID NO: 107450 - DNA, 23 bp, Homo sapiens
  misc_feature 1..23: note = chr12:25273331-25273354
  misc_feature 1..23: note = Hypo
  source 1..23: mol_type = genomic DNA
ggaagcaagccaccacgaggtta

SEQ ID NO: 107451 - DNA, 40 bp, Homo sapiens; identical to SEQ ID NO: 74490
  misc_feature 1..40: note = chr12:25537400-25537440
  misc_feature 1..40: note = Hypo
  source 1..40: mol_type = genomic DNA

SEQ ID NO: 107452 - DNA, 193 bp, Homo sapiens; identical to SEQ ID NO: 74493
  misc_feature 1..193: note = chr12:25922413-25922606
  misc_feature 1..193: note = Hypo
  source 1..193: mol_type = genomic DNA

SEQ ID NO: 107453 - DNA, 130 bp, Homo sapiens; identical to SEQ ID NO: 74494
  misc_feature 1..130: note = chr12:25956132-25956262
  misc_feature 1..130: note = Hypo
  source 1..130: mol_type = genomic DNA

SEQ ID NO: 107454 - DNA, 30 bp, Homo sapiens; identical to SEQ ID NO: 74495
  misc_feature 1..30: note = chr12:26168478-26168508
  misc_feature 1..30: note = Hypo
  source 1..30: mol_type = genomic DNA

SEQ ID NO: 107455 - DNA, 141 bp, Homo sapiens; identical to SEQ ID NO: 74496
  misc_feature 1..141: note = chr12:26348161-26348302
  misc_feature 1..141: note = Hyper
  source 1..141: mol_type = genomic DNA

SEQ ID NO: 107456 - DNA, 168 bp, Homo sapiens; identical to SEQ ID NO: 74497
  misc_feature 1..168: note = chr12:26555243-26555411
  misc_feature 1..168: note = Hypo
  source 1..168: mol_type = genomic DNA

SEQ ID NO: 107457 - DNA, 37 bp, Homo sapiens; identical to SEQ ID NO: 43411
  misc_feature 1..37: note = chr12:26555819-26555856
  misc_feature 1..37: note = Hypo
  source 1..37: mol_type = genomic DNA

SEQ ID NO: 107458 - DNA, 30 bp, Homo sapiens; identical to SEQ ID NO: 74499
  misc_feature 1..30: note = chr12:26844976-26845006
  misc_feature 1..30: note = Hypo
  source 1..30: mol_type = genomic DNA

SEQ ID NO: 107459 - DNA, 18 bp, Homo sapiens
  misc_feature 1..18: note = chr12:27072768-27072786
  misc_feature 1..18: note = Hypo
  source 1..18: mol_type = genomic DNA
ctggaatttaggggccgg

SEQ ID NO: 107460 - DNA, 232 bp, Homo sapiens; identical to SEQ ID NO: 74501
  misc_feature 1..232: note = chr12:27426203-27426435
  misc_feature 1..232: note = Hypo
  source 1..232: mol_type = genomic DNA

SEQ ID NO: 107461 - DNA, 153 bp, Homo sapiens; identical to SEQ ID NO: 43412
  misc_feature 1..153: note = chr12:27489449-27489602
  misc_feature 1..153: note = Hypo
  source 1..153: mol_type = genomic DNA

SEQ ID NO: 107462 - DNA, 358 bp, Homo sapiens; identical to SEQ ID NO: 74508
  misc_feature 1..358: note = chr12:28122168-28122526
  misc_feature 1..358: note = Hyper
  source 1..358: mol_type = genomic DNA

SEQ ID NO: 107463 - DNA, 140 bp, Homo sapiens; identical to SEQ ID NO: 74509
  misc_feature 1..140: note = chr12:28123065-28123205
  misc_feature 1..140: note = Hyper
  source 1..140: mol_type = genomic DNA

SEQ ID NO: 107464 - DNA, 238 bp, Homo sapiens; identical to SEQ ID NO: 74510
  misc_feature 1..238: note = chr12:28123548-28123786
  misc_feature 1..238: note = Hyper
  source 1..238: mol_type = genomic DNA

SEQ ID NO: 107465 - DNA, 1436 bp, Homo sapiens; identical to SEQ ID NO: 74511
  misc_feature 1..1436: note = chr12:28127648-28129084
  misc_feature 1..1436: note = Hyper
  source 1..1436: mol_type = genomic DNA

SEQ ID NO: 107466 - DNA, 43 bp, Homo sapiens; identical to SEQ ID NO: 74515
  misc_feature 1..43: note = chr12:29123308-29123351
  misc_feature 1..43: note = Hypo
  source 1..43: mol_type = genomic DNA

SEQ ID NO: 107467 - DNA, 30 bp, Homo sapiens; identical to SEQ ID NO: 74517
  misc_feature 1..30: note = chr12:29268148-29268178
  misc_feature 1..30: note = Hypo
  source 1..30: mol_type = genomic DNA

SEQ ID NO: 107468 - DNA, 33 bp, Homo sapiens; identical to SEQ ID NO: 74518
  misc_feature 1..33: note = chr12:29298795-29298828
  misc_feature 1..33: note = Hypo
  source 1..33: mol_type = genomic DNA

SEQ ID NO: 107469 - DNA, 32 bp, Homo sapiens; identical to SEQ ID NO: 74519
  misc_feature 1..32: note = chr12:29302656-29302688
  misc_feature 1..32: note = Hyper
  source 1..32: mol_type = genomic DNA

SEQ ID NO: 107470 - DNA, 120 bp, Homo sapiens; identical to SEQ ID NO: 74520
  misc_feature 1..120: note = chr12:29373965-29374085
  misc_feature 1..120: note = Hypo
  source 1..120: mol_type = genomic DNA

SEQ ID NO: 107471 - DNA, 819 bp, Homo sapiens
  misc_feature 1..819: note = chr12:29935857-29936676
  misc_feature 1..819: note = Hyper
  source 1..819: mol_type = genomic DNA
cctctcctgaacccacgcagccctgtcagctcaaggctcccgcctcgtctcatctgaacgaaacccttaaggggctgatacacttctcatctgcaaagctgcccaacagcctccgagaaattctctacttggaagcatcgccaccaccgccacccctccggaaccctctgggtccgcgctagtcccacttggtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtccgagggacgggcggagggtagaggaggcagcggcggctagcgcgaggtgagggactcacttgaaggtgaggacgcagagcggccggtaggacttgtggctggtgttctcggccatgcccttgccccagaagtcgttggtgaagatgccccagcggagcggggcgccgggccgcacgtcggggttgttcacgatcgcccacacgtcgtcgtgcacgaactcgccctgcagggagcggccgtagcacaggcagcttgccccggccagcagcgccgcggccccggccggcgctagcccgcagccccgccgccgggagggtgtgcggtccccgccgccgcctcgggcagaggtggtc

SEQ ID NO: 107472 - DNA, 662 bp, Homo sapiens
  misc_feature 1..662: note = chr12:29936880-29937542
  misc_feature 1..662: note = Hyper
  source 1..662: mol_type = genomic DNA
tccccccgcctcccccggccatcgccacctcctccgccccactgcgcatgcccgctcgctctctcttccaccgccccccaatcccgggacgcgggccggttcccccgcacagcccggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctccacccgccccgcgctcgcgtccagtcgccggctctgtgctctcctgcccgggctttctctcacccgcccggcgcggcgtcccgcttggcggaggaacccgcggggatagggagcaccttcctcaaagccaggagaaggggtctccctggacaaggacatcctgctcgccctgcccgggtgtgttcagaggcgccaccggctctttaacttt

SEQ ID NO: 107473 - DNA, 30 bp, Homo sapiens; identical to SEQ ID NO: 74533
  misc_feature 1..30: note = chr12:30260329-30260359
  misc_feature 1..30: note = Hypo
  source 1..30: mol_type = genomic DNA

SEQ ID NO: 107474 - DNA, 809 bp, Homo sapiens
  misc_feature 1..809: note = chr12:30322750-30323559
  misc_feature 1..809: note = Hyper
  source 1..809: mol_type = genomic DNA
agtcccacaactccgcgacacgtcccagccaaggcgcggcggggagccttggacaggagtgcacttgaaggtgagggtgcagagtggccggtgggacttgtggctggtgttctcggccatgccctggccccagaagtcgttggtgaagatgccccagcagagcgaggcgctgggccgcacgtcggggttgttcacggtcgcccacgaactcgccctgcagggaacggccttagcacaggcagctcgcgcctgccagcagcgccgcggccccggctatcaacacctcctcctccccactgcgaatgccccgatcgtgctccccaaaacccaatacatccacgcccccaaaaaactgggaacccacgcgggtgccttctgtttaccgcagcgctctcactgcaggcgcttgagtaccagatggcgagagttcgcgcgcaggtggagtggggatcctggcgctaggctacccaggagaggaggggaagggcaacccgcggtcccgcctgtggtgcccggctgtgctcatccccacgccccagaccccaaaaggggctggggaggggcacatctggcggacccctcgcgggggaccaagcgggtttagcaggtgcgccgcctggaacccctacgcccaccttccagggagaaaagtgcctctgcttctcgggaagttcccggcttttcagcacccgggacaacagcagcggcacctggggagaggctctccaccccgccccgcgctcgcttccagtcgccagcttcgtgatcttctgcccggactttctctcacccgccgggcgctgcgtcct

SEQ ID NO: 107475 - DNA, 112 bp, Homo sapiens; identical to SEQ ID NO: 74537
  misc_feature 1..112: note = chr12:30354005-30354117
  misc_feature 1..112: note = Hyper
  source 1..112: mol_type = genomic DNA

SEQ ID NO: 107476 - DNA, 20 bp, Homo sapiens
  misc_feature 1..20: note = chr12:30859424-30859444
  misc_feature 1..20: note = Hypo
  source 1..20: mol_type = genomic DNA
acaagcgtaagccactgtac

SEQ ID NO: 107477 - DNA, 41 bp, Homo sapiens; identical to SEQ ID NO: 43415
  misc_feature 1..41: note = chr12:30947564-30947605
  misc_feature 1..41: note = Hypo
  source 1..41: mol_type = genomic DNA

SEQ ID NO: 107478 - DNA, 45 bp, Homo sapiens; identical to SEQ ID NO: 74540
  misc_feature 1..45: note = chr12:30948625-30948670
  misc_feature 1..45: note = Hyper
  source 1..45: mol_type = genomic DNA

SEQ ID NO: 107479 - DNA, 20 bp, Homo sapiens
  misc_feature 1..20: note = chr12:30959879-30959899
  misc_feature 1..20: note = Hypo
  source 1..20: mol_type = genomic DNA
caccgcgcccagcccagaat

SEQ ID NO: 107480 - DNA, 629 bp, Homo sapiens
  misc_feature 1..629: note = chr12:30975310-30975939
  misc_feature 1..629: note = Hyper
  source 1..629: mol_type = genomic DNA
cacaaaacaaaagagcgctccacagaagctcagcacatcttcatttggtgggcgctggtgccctttccctgtgggcggcgccagctcctttctcggctgcctgcccagctgctgggctggagctccgcgtgctgggtgtaggtcaagtgatcccgtcgcgggcgggcggaggtggccgggcagccgccgctgtgcccgggtctggggtgagctgcactgctgccctgggccccggctcccacgcctgtttcccggagctccgcggctccggctgcttcgccctccctctgtgggctgggctggggtcctcgcgagaagtcctgccccgctcccttctccaaatccacaggccctgtttctctggagacagggaggctcatacaggatatgtgcaaatgcttttattacaagctgagttgaaagacacccgtttgctctcgggtccttttggtgagcgccgcaggaagccgggctcctctctccccagaggcggccgcaggttcgcggcgcagggcctgcagtgccaggagcaggcaggggcctctgccctccccttcgtccctgatctcccgcctcctcctcacccgccgtctctgcgaactcaccctgggctgcggcctttcttccct

SEQ ID NO: 107481 - DNA, 680 bp, Homo sapiens
  misc_feature 1..680: note = chr12:31079258-31079938
  misc_feature 1..680: note = Hyper
  source 1..680: mol_type = genomic DNA
gcagggagacctaagcggggagctgcggagcgcggggagtttgaaagccgctccaccgccctactagtccgtccttttgccccgccccccttagggatccccccggcaaccgcacagctgcctcggactctgacttaattccctccgcgtgctctgaatcgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccccgggagccgccgctctcagtctctctaggcgcagctcccttcgccgcttccggagcccctggcagggtaagtgcagaagcgcgcccgaggagtgggggcgccgcgggagggggctgggggtccaggagaggcgcctccacctccgctgcccgccccgccggcagtcccgagctagactgtcccgagcttcccccgggcgggcagagggaagccggctggggatgaggagtggaggaggcaggaatgcctgggacactcgcggggcatgtgagca

SEQ ID NO: 107482 - DNA, 30 bp, Homo sapiens; identical to SEQ ID NO: 74547
  misc_feature 1..30: note = chr12:31134289-31134319
  misc_feature 1..30: note = Hypo
  source 1..30: mol_type = genomic DNA

SEQ ID NO: 107483 - DNA, 101 bp, Homo sapiens; identical to SEQ ID NO: 74548
  misc_feature 1..101: note = chr12:31230802-31230903
  misc_feature 1..101: note = Hypo
  source 1..101: mol_type = genomic DNA

SEQ ID NO: 107484 - DNA, 174 bp, Homo sapiens; identical to SEQ ID NO: 74549
  misc_feature 1..174: note = chr12:31255181-31255355
  misc_feature 1..174: note = Hypo
  source 1..174: mol_type = genomic DNA

SEQ ID NO: 107485 - DNA, 30 bp, Homo sapiens; identical to SEQ ID NO: 74550
  misc_feature 1..30: note = chr12:31744505-31744535
  misc_feature 1..30: note = Hyper
  source 1..30: mol_type = genomic DNA

SEQ ID NO: 107486 - DNA, 22 bp, Homo sapiens
  misc_feature 1..22: note = chr12:32086687-32086709
  misc_feature 1..22: note = Hypo
  source 1..22: mol_type = genomic DNA
ttttattttgaaattcggggac

SEQ ID NO: 107487 - DNA, 180 bp, Homo sapiens; identical to SEQ ID NO: 74553
  misc_feature 1..180: note = chr12:32087009-32087189
  misc_feature 1..180: note = Hypo
  source 1..180: mol_type = genomic DNA

SEQ ID NO: 107488 - DNA, 77 bp, Homo sapiens; identical to SEQ ID NO: 74554
  misc_feature 1..77: note = chr12:32188978-32189055
  misc_feature 1..77: note = Hypo
  source 1..77: mol_type = genomic DNA

SEQ ID NO: 107489 - DNA, 30 bp, Homo sapiens; identical to SEQ ID NO: 74555
  misc_feature 1..30: note = chr12:32251556-32251586
  misc_feature 1..30: note = Hypo
  source 1..30: mol_type = genomic DNA

SEQ ID NO: 107490 - DNA, 27 bp, Homo sapiens
  misc_feature 1..27: note = chr12:32340317-32340344
  misc_feature 1..27: note = Hypo
  source 1..27: mol_type = genomic DNA
aatctatgggctgggcgcggtggctca

SEQ ID NO: 107491 - DNA, 151 bp, Homo sapiens; identical to SEQ ID NO: 15647
  misc_feature 1..151: note = chr12:32597645-32597796
  misc_feature 1..151: note = Hypo
  source 1..151: mol_type = genomic DNA

SEQ ID NO: 107492 - DNA, 40 bp, Homo sapiens; identical to SEQ ID NO: 43420
  misc_feature 1..40: note = chr12:32831140-32831180
  misc_feature 1..40: note = Hypo
  source 1..40: mol_type = genomic DNA

SEQ ID NO: 107493 - DNA, 240 bp, Homo sapiens; identical to SEQ ID NO: 43421
  misc_feature 1..240: note = chr12:32831300-32831540
  misc_feature 1..240: note = Hypo
  source 1..240: mol_type = genomic DNA

SEQ ID NO: 107494 - DNA, 30 bp, Homo sapiens; identical to SEQ ID NO: 74561
  misc_feature 1..30: note = chr12:33047302-33047332
  misc_feature 1..30: note = Hypo
  source 1..30: mol_type = genomic DNA

SEQ ID NO: 107495 - DNA, 55 bp, Homo sapiens; identical to SEQ ID NO: 74562
  misc_feature 1..55: note = chr12:33048730-33048785
  misc_feature 1..55: note = Hyper
  source 1..55: mol_type = genomic DNA

SEQ ID NO: 107496 - DNA, 64 bp, Homo sapiens; identical to SEQ ID NO: 34302
  misc_feature 1..64: note = chr12:33049326-33049390
  misc_feature 1..64: note = Hyper
  source 1..64: mol_type = genomic DNA

SEQ ID NO: 107497 - DNA, 244 bp, Homo sapiens; identical to SEQ ID NO: 74564
  misc_feature 1..244: note = chr12:33050001-33050245
  misc_feature 1..244: note = Hyper
  source 1..244: mol_type = genomic DNA

SEQ ID NO: 107498 - DNA, 30 bp, Homo sapiens; identical to SEQ ID NO: 74565
  misc_feature 1..30: note = chr12:33139125-33139155
  misc_feature 1..30: note = Hypo
  source 1..30: mol_type = genomic DNA

SEQ ID NO: 107499 - DNA, 345 bp, Homo sapiens; identical to SEQ ID NO: 74566
  misc_feature 1..345: note = chr12:33205376-33205721
  misc_feature 1..345: note = Hypo
  source 1..345: mol_type = genomic DNA

SEQ ID NO: 107500 - DNA, 30 bp, Homo sapiens; identical to SEQ ID NO: 74567
  misc_feature 1..30: note = chr12:33205934-33205964
  misc_feature 1..30: note = Hypo
  source 1..30: mol_type = genomic DNA

SEQ ID NO: 107501 - DNA, 344 bp, Homo sapiens
  misc_feature 1..344: note = chr12:33591748-33592092
  misc_feature 1..344: note = Hyper
  source 1..344: mol_type = genomic DNA
aaattgtcaggtgcccgacaggttgcagccgcgggttacctcggaggccaaggcagccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggaggcgtgggagaacgcggagaggcgcggcgaggctgggagcgggagacggcgccgggaggcgggaagcggaccagagaatgg

SEQ ID NO: 107502 - DNA, 554 bp, Homo sapiens
  misc_feature 1..554: note = chr12:33592578-33593132
  misc_feature 1..554: note = Hyper
  source 1..554: mol_type = genomic DNA
tgcgccgctgagagccggcaactcttaggagccccacgttggccccatggcgggagcggagggcgtaggggaaggagaggcgcgcgaggaggctgcggctgccgcgaggtttgcgccaactctcccgccgcgcgagcgagccgaggcgcgctggaactagagacccggcatggagtgctgaggggaggggggagccgtaaaaaagccaaagcaagccctcgactcgcaagcacgcccccctcctctccccagcgcactggtgtttctggcgggtgcctggcggcgacgcgtccaatcgcagcccggcgcgggcgctaggtgacaggcggcggagcgcgcagacccggctccccgcgtcctctgaagaagggactcgcgagggagggagggagggagggcgggcggcccggcgcccctgccgaggccggggatgctcatcgttgcccagagttggcccgaggagccctctccgttttcccaatacttttccctgcatcagtgcagccatccccgccgcctttgtctctccaacttttccacggatgtattctact

SEQ ID NO: 107503 - DNA, 30 bp, Homo sapiens; identical to SEQ ID NO: 74578
  misc_feature 1..30: note = chr12:34261260-34261290
  misc_feature 1..30: note = Hyper
  source 1..30: mol_type = genomic DNA

SEQ ID NO: 107504 - DNA, 30 bp, Homo sapiens; identical to SEQ ID NO: 74579
  misc_feature 1..30: note = chr12:34358492-34358522
  misc_feature 1..30: note = Hypo
  source 1..30: mol_type = genomic DNA

SEQ ID NO: 107505 - DNA, 43 bp, Homo sapiens; identical to SEQ ID NO: 43423
  misc_feature 1..43: note = chr12:34362659-34362702
  misc_feature 1..43: note = Hypo
  source 1..43: mol_type = genomic DNA

SEQ ID NO: 107506 - DNA, 105 bp, Homo sapiens; identical to SEQ ID NO: 74581
  misc_feature 1..105: note = chr12:34364426-34364531
  misc_feature 1..105: note = Hypo
  source 1..105: mol_type = genomic DNA

SEQ ID NO: 107507 - DNA, 30 bp, Homo sapiens; identical to SEQ ID NO: 74582
  misc_feature 1..30: note = chr12:34463923-34463953
  misc_feature 1..30: note = Hypo
  source 1..30: mol_type = genomic DNA

SEQ ID NO: 107508 - DNA, 90 bp, Homo sapiens; identical to SEQ ID NO: 74583
  misc_feature 1..90: note = chr12:34464013-34464103
  misc_feature 1..90: note = Hypo
  source 1..90: mol_type = genomic DNA

SEQ ID NO: 107509 - DNA, 58 bp, Homo sapiens; identical to SEQ ID NO: 74584
  misc_feature 1..58: note = chr12:34471693-34471751
  misc_feature 1..58: note = Hypo
  source 1..58: mol_type = genomic DNA

SEQ ID NO: 107510 - DNA, 30 bp, Homo sapiens; identical to SEQ ID NO: 74585
  misc_feature 1..30: note = chr12:34472580-34472610
  misc_feature 1..30: note = Hypo
  source 1..30: mol_type = genomic DNA

SEQ ID NO: 107511 - DNA, 115 bp, Homo sapiens; identical to SEQ ID NO: 74586
  misc_feature 1..115: note = chr12:34474495-34474610
  misc_feature 1..115: note = Hypo
  source 1..115: mol_type = genomic DNA

SEQ ID NO: 107512 - DNA, 36 bp, Homo sapiens; identical to SEQ ID NO: 74587
  misc_feature 1..36: note = chr12:34478137-34478173
  misc_feature 1..36: note = Hypo
  source 1..36: mol_type = genomic DNA

SEQ ID NO: 107513 - DNA, 81 bp, Homo sapiens; identical to SEQ ID NO: 43427
  misc_feature 1..81: note = chr12:34494888-34494969
  misc_feature 1..81: note = Hypo
  source 1..81: mol_type = genomic DNA

SEQ ID NO: 107514 - DNA, 30 bp, Homo sapiens; identical to SEQ ID NO: 74589
  misc_feature 1..30: note = chr12:34501815-34501845
  misc_feature 1..30: note = Hypo
  source 1..30: mol_type = genomic DNA

SEQ ID NO: 107515 - DNA, 268 bp, Homo sapiens; identical to SEQ ID NO: 43428
  misc_feature 1..268: note = chr12:34502619-34502887
  misc_feature 1..268: note = Hypo
  source 1..268: mol_type = genomic DNA

SEQ ID NO: 107516 - DNA, 136 bp, Homo sapiens; identical to SEQ ID NO: 74591
  misc_feature 1..136: note = chr12:34519267-34519403
  misc_feature 1..136: note = Hypo
  source 1..136: mol_type = genomic DNA

SEQ ID NO: 107517 - DNA, 113 bp, Homo sapiens; identical to SEQ ID NO: 43430
  misc_feature 1..113: note = chr12:34520137-34520250
  misc_feature 1..113: note = Hypo
  source 1..113: mol_type = genomic DNA

SEQ ID NO: 107518 - DNA, 65 bp, Homo sapiens; identical to SEQ ID NO: 74593
  misc_feature 1..65: note = chr12:34522274-34522339
  misc_feature 1..65: note = Hypo
  source 1..65: mol_type = genomic DNA

SEQ ID NO: 107519 - DNA, 38 bp, Homo sapiens; identical to SEQ ID NO: 74594
  misc_feature 1..38: note = chr12:34527377-34527415
  misc_feature 1..38: note = Hypo
  source 1..38: mol_type = genomic DNA

SEQ ID NO: 107520 - DNA, 40 bp, Homo sapiens; identical to SEQ ID NO: 74607
  misc_feature 1..40: note = chr12:37937804-37937844
  misc_feature 1..40: note = Hypo
  source 1..40: mol_type = genomic DNA

SEQ ID NO: 107521 - DNA, 148 bp, Homo sapiens; identical to SEQ ID NO: 74608
  misc_feature 1..148: note = chr12:38471923-38472071
  misc_feature 1..148: note = Hypo
  source 1..148: mol_type = genomic DNA

SEQ ID NO: 107522 - DNA, 183 bp, Homo sapiens; identical to SEQ ID NO: 74609
  misc_feature 1..183: note = chr12:38543382-38543565
  misc_feature 1..183: note = Hypo
  source 1..183: mol_type = genomic DNA

SEQ ID NO: 107523 - DNA, 30 bp, Homo sapiens; identical to SEQ ID NO: 74610
  misc_feature 1..30: note = chr12:38548005-38548035
  misc_feature 1..30: note = Hypo
  source 1..30: mol_type = genomic DNA

SEQ ID NO: 107524 - DNA, 30 bp, Homo sapiens; identical to SEQ ID NO: 74611
  misc_feature 1..30: note = chr12:38548938-38548968
  misc_feature 1..30: note = Hypo
  source 1..30: mol_type = genomic DNA

SEQ ID NO: 107525 - DNA, 98 bp, Homo sapiens; identical to SEQ ID NO: 74612
  misc_feature 1..98: note = chr12:38549408-38549506
  misc_feature 1..98: note = Hypo
  source 1..98: mol_type = genomic DNA

SEQ ID NO: 107526 - DNA, 60 bp, Homo sapiens; identical to SEQ ID NO: 74613
  misc_feature 1..60: note = chr12:38550213-38550273
  misc_feature 1..60: note = Hypo
  source 1..60: mol_type = genomic DNA

SEQ ID NO: 107527 - DNA, 236 bp, Homo sapiens; identical to SEQ ID NO: 74614
  misc_feature 1..236: note = chr12:38550662-38550898
  misc_feature 1..236: note = Hypo
  source 1..236: mol_type = genomic DNA

SEQ ID NO: 107528 - DNA, 152 bp, Homo sapiens; identical to SEQ ID NO: 74615
  misc_feature 1..152: note = chr12:38551153-38551305
  misc_feature 1..152: note = Hypo
  source 1..152: mol_type = genomic DNA

SEQ ID NO: 107529 - DNA, 92 bp, Homo sapiens; identical to SEQ ID NO: 74616
  misc_feature 1..92: note = chr12:38551365-38551457
  misc_feature 1..92: note = Hypo
  source 1..92: mol_type = genomic DNA

SEQ ID NO: 107530 - DNA, 234 bp, Homo sapiens; identical to SEQ ID NO: 74617
  misc_feature 1..234: note = chr12:38551828-38552062
  misc_feature 1..234: note = Hypo
  source 1..234: mol_type = genomic DNA

SEQ ID NO: 107531 - DNA, 36 bp, Homo sapiens; identical to SEQ ID NO: 43437
  misc_feature 1..36: note = chr12:38553830-38553866
  misc_feature 1..36: note = Hypo
  source 1..36: mol_type = genomic DNA

SEQ ID NO: 107532 - DNA, 54 bp, Homo sapiens; identical to SEQ ID NO: 74619
  misc_feature 1..54: note = chr12:38554204-38554258
  misc_feature 1..54: note = Hypo
  source 1..54: mol_type = genomic DNA

SEQ ID NO: 107533 - DNA, 80 bp, Homo sapiens; identical to SEQ ID NO: 74620
  misc_feature 1..80: note = chr12:38595481-38595561
  misc_feature 1..80: note = Hypo
  source 1..80: mol_type = genomic DNA

SEQ ID NO: 107534 - DNA, 34 bp, Homo sapiens; identical to SEQ ID NO: 74621
  misc_feature 1..34: note = chr12:38836094-38836128
  misc_feature 1..34: note = Hypo
  source 1..34: mol_type = genomic DNA

SEQ ID NO: 107535 - DNA, 17 bp, Homo sapiens
  misc_feature 1..17: note = chr12:39142109-39142126
  misc_feature 1..17: note = Hypo
  source 1..17: mol_type = genomic DNA
aacgcaatactattaat

SEQ ID NO: 107536 - DNA, 131 bp, Homo sapiens; identical to SEQ ID NO: 74623
  misc_feature 1..131: note = chr12:39298556-39298687
  misc_feature 1..131: note = Hyper
  source 1..131: mol_type = genomic DNA

SEQ ID NO: 107537 - DNA, 194 bp, Homo sapiens; identical to SEQ ID NO: 74624
  misc_feature 1..194: note = chr12:39298908-39299102
  misc_feature 1..194: note = Hyper
  source 1..194: mol_type = genomic DNA

SEQ ID NO: 107538 - DNA, 640 bp, Homo sapiens; identical to SEQ ID NO: 74625
  misc_feature 1..640: note = chr12:39299368-39300008
  misc_feature 1..640: note = Hyper
  source 1..640: mol_type = genomic DNA

SEQ ID NO: 107539 - DNA, 75 bp, Homo sapiens; identical to SEQ ID NO: 74626
  misc_feature 1..75: note = chr12:39300330-39300405
  misc_feature 1..75: note = Hyper
  source 1..75: mol_type = genomic DNA

SEQ ID NO: 107540 - DNA, 30 bp, Homo sapiens; identical to SEQ ID NO: 74627
  misc_feature 1..30: note = chr12:39300876-39300906
  misc_feature 1..30: note = Hyper
  source 1..30: mol_type = genomic DNA

SEQ ID NO: 107541 - DNA, 231 bp, Homo sapiens
  misc_feature 1..231: note = chr12:39539241-39539472
  misc_feature 1..231: note = Hyper
  source 1..231: mol_type = genomic DNA
cggctcagggtccggcgctgaggacgcgtgtgcggggtggtccgccgccccggaaggtcgcgaactcgccgcctccagcgccggcgccttaaccccgccggtcccggcgccaaagtcccgacagtggcggacgccggcaccaggggcgatggagagcaggcgacaccgagggtgtccatccggtccacccaacctggtgcaaggctctgggaagcgcgctgacaggatttc

SEQ ID NO: 107542 - DNA, 33 bp, Homo sapiens; identical to SEQ ID NO: 74629
  misc_feature 1..33: note = chr12:39726877-39726910
  misc_feature 1..33: note = Hypo
  source 1..33: mol_type = genomic DNA

SEQ ID NO: 107543 - DNA, 60 bp, Homo sapiens; identical to SEQ ID NO: 74631
  misc_feature 1..60: note = chr12:40501737-40501797
  misc_feature 1..60: note = Hypo
  source 1..60: mol_type = genomic DNA

SEQ ID NO: 107544 - DNA, 35 bp, Homo sapiens; identical to SEQ ID NO: 74633
  misc_feature 1..35: note = chr12:40540758-40540793
  misc_feature 1..35: note = Hypo
  source 1..35: mol_type = genomic DNA

SEQ ID NO: 107545 - DNA, 34 bp, Homo sapiens; identical to SEQ ID NO: 74634
  misc_feature 1..34: note = chr12:40540853-40540887
  misc_feature 1..34: note = Hypo
  source 1..34: mol_type = genomic DNA

SEQ ID NO: 107546 - DNA, 708 bp, Homo sapiens; identical to SEQ ID NO: 74635
  misc_feature 1..708: note = chr12:40618340-40619048
  misc_feature 1..708: note = Hyper
  source 1..708: mol_type = genomic DNA

SEQ ID NO: 107547 - DNA, 32 bp, Homo sapiens; identical to SEQ ID NO: 74636
  misc_feature 1..32: note = chr12:41012036-41012068
  misc_feature 1..32: note = Hypo
  source 1..32: mol_type = genomic DNA

SEQ ID NO: 107548 - DNA, 272 bp, Homo sapiens
  misc_feature 1..272: note = chr12:41086182-41086454
  misc_feature 1..272: note = Hyper
  source 1..272: mol_type = genomic DNA
tttccctgtggtccccgccccactttccctgctgccccaataaccgccctaaaaggccgggcttctgctgtcaagtagccagggtgggctccgccgaggcgaggaggggcgccggtggggagatgcgctcccaggtgtttgcagcggaagtgggaaacctgtagggtatggtccagctgtgccgcaccgaggcgagcaggagcagggaacaggtaggaagctggacttttccttctttgcagataaaataaagaatgcgcatttccatgctg

SEQ ID NO: 107549 - DNA, 393 bp, Homo sapiens; identical to SEQ ID NO: 74639
  misc_feature 1..393: note = chr12:41086713-41087106
  misc_feature 1..393: note = Hyper
  source 1..393: mol_type = genomic DNA

SEQ ID NO: 107550 - DNA, 1073 bp, Homo sapiens
  misc_feature 1..1073: note = chr12:41582304-41583377
  misc_feature 1..1073: note = Hyper
  source 1..1073: mol_type = genomic DNA
ggagtgcaaactgtgcggccaggtgcttgaagagcccctgtgcacgccgtgcgggcacgtcttctgcgccagctgcctgttgccctgggcggtgcggaggcgccggtgcccgctgcagtgccagcccttggcgcccggcgagctgtaccgggtgctgccgctgcgcagcctcatccagaagctgcgagtccagtgcgactaccgcgcccgcggctgcggccactcggtcaggctgcacgagctggaggcgcacgtcgagcactgcgacttcggccctgcccgccggctccgcagccgcgggggctgcgcttcggggctgggcggtggtgaggtgcccgcgcgggggggctgcggtccgacacccagggctggccggggcgggggcgcgcgcggggggccgccgggcggccgctggggccgcgggcggggacccgggcctcgggtcctcgcctggaggcggcgcgagaaggcgctgctggcgcagctctgggcgctgcagggcgaggtgcagctcacggcgcgcaggtaccaggagaagttcacccaatacatggctcacgtccgcaacttcgtcggcgacctcggtggcggccaccgcagggtaagcaaaggggggtgggcaccgcgggcatggtcgattggggtgggaaaaggagcggttctttctgacgcttcaggattcctttggaattgggcatccttcctcactatgcagcaggaaacatccacaccctgatcatactttcctgtcattatcttacgaatggattggcgtcgaagttaaggattgtcccttttctgattatattacgattggaaagagttaaacagattcgattctaactttcccccgggaaagtaggaattgtgaaaactcattttccatccagactctcgttttccatctttcaccctcctgcccaccgtctctgcctattttttgagcacttgtcccgtgcctgaagcaaatccgagaaggaaagacagaaagcgaagactttcccggcccagcctttcctctcccgcggccaccagcatccccgcggccctggcagccgcgcacgcacacctgg

SEQ ID NO: 107551 - DNA, 145 bp, Homo sapiens; identical to SEQ ID NO: 74643
  misc_feature 1..145: note = chr12:41583648-41583793
  misc_feature 1..145: note = Hyper
  source 1..145: mol_type = genomic DNA

SEQ ID NO: 107552 - DNA, 164 bp, Homo sapiens; identical to SEQ ID NO: 74644
  misc_feature 1..164: note = chr12:41584085-41584249
  misc_feature 1..164: note = Hyper
  source 1..164: mol_type = genomic DNA

SEQ ID NO: 107553 - DNA, 30 bp, Homo sapiens; identical to SEQ ID NO: 43440
  misc_feature 1..30: note = chr12:41925162-41925192
  misc_feature 1..30: note = Hypo
  source 1..30: mol_type = genomic DNA

SEQ ID NO: 107554 - DNA, 30 bp, Homo sapiens; identical to SEQ ID NO: 74646
  misc_feature 1..30: note = chr12:41934689-41934719
  misc_feature 1..30: note = Hypo
  source 1..30: mol_type = genomic DNA

SEQ ID NO: 107555 - DNA, 30 bp, Homo sapiens; identical to SEQ ID NO: 74648
  misc_feature 1..30: note = chr12:41957024-41957054
  misc_feature 1..30: note = Hypo
  source 1..30: mol_type = genomic DNA

SEQ ID NO: 107556 - DNA, 30 bp, Homo sapiens; identical to SEQ ID NO: 74649
  misc_feature 1..30: note = chr12:42047159-42047189
  misc_feature 1..30: note = Hypo
  source 1..30: mol_type = genomic DNA

SEQ ID NO: 107557 - DNA, 35 bp, Homo sapiens; identical to SEQ ID NO: 34320
  misc_feature 1..35: note = chr12:42326337-42326372
  misc_feature 1..35: note = Hyper
  source 1..35: mol_type = genomic DNA

SEQ ID NO: 107558 - DNA, 126 bp, Homo sapiens; identical to SEQ ID NO: 74655
  misc_feature 1..126: note = chr12:42326595-42326721
  misc_feature 1..126: note = Hyper
  source 1..126: mol_type = genomic DNA

SEQ ID NO: 107559 - DNA, 23 bp, Homo sapiens
  misc_feature 1..23: note = chr12:42443414-42443437
  misc_feature 1..23: note = Hypo
  source 1..23: mol_type = genomic DNA
ttcctattcggccatcttggctc

SEQ ID NO: 107560 - DNA, 24 bp, Homo sapiens
  misc_feature 1..24: note = chr12:42654216-42654240
  misc_feature 1..24: note = Hypo
  source 1..24: mol_type = genomic DNA
gataatagtacttgccgggaggcg

SEQ ID NO: 107561 - DNA, 83 bp, Homo sapiens; identical to SEQ ID NO: 43442
  misc_feature 1..83: note = chr12:42654300-42654383
  misc_feature 1..83: note = Hypo
  source 1..83: mol_type = genomic DNA

SEQ ID NO: 107562 - DNA, 76 bp, Homo sapiens; identical to SEQ ID NO: 74666
  misc_feature 1..76: note = chr12:42970333-42970409
  misc_feature 1..76: note = Hypo
  source 1..76: mol_type = genomic DNA

SEQ ID NO: 107563 - DNA, 863 bp, Homo sapiens; identical to SEQ ID NO: 74667
  misc_feature 1..863: note = chr12:42983011-42983874
  misc_feature 1..863: note = Hyper
  source 1..863: mol_type = genomic DNA

SEQ ID NO: 107564 - DNA, 42 bp, Homo sapiens; identical to SEQ ID NO: 34323
  misc_feature 1..42: note = chr12:42984438-42984480
  misc_feature 1..42: note = Hyper
  source 1..42: mol_type = genomic DNA

SEQ ID NO: 107565 - DNA, 1631 bp, Homo sapiens
  misc_feature 1..1631: note = chr12:43944788-43946419
  misc_feature 1..1631: note = Hyper
  source 1..1631: mol_type = genomic DNA
ggtccgagggccctgcgtcgctctcccaggccccgcgctccggggttcccaagtgcacctcggtgtagccggcggccagaaaggatgcatcggcggtcaggttcagctggaagagctgcccgtaggcagtgaagcgatagtgggttcggaacggcatgggttccagcgcctcggagctgcgtttctgccggctgaagtggtggctctgagggaacacttctccaaactcattgacccgctcggggatcactacttcgtaggaggtcagtgtcctcaccagggcttctgcaacaacagcgacaggaccagtgagctcccacgcgttcctcattgtccaactctaaacttcttccaccaaacgtccccgctaaaggtcccaggtcccagtacagccaggggcaagacaaatgcacacatgctgatgcgcacgcacacacacacacgtgcactgggacggttagtgctctgctttcccacacccccaacttgccctaccctccccaagcaaagaccctaccactaatggccctaagcaacccacttccttccccagtacctcctaacctccccgcagcccccaactcgttccctccgggtgcaagcgaccccctgccccttgcgcccccgccgtgtggtcctgggagtgcgatgcgtcttaggcgcgcgcgattcctcgaaacccggcgcagtcgcgacctctccggctgactggtccgggagtcccgggagctccagcagggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacatggttccaccctggggaccccgatcggggaggcccaccagagccgccggcagccaagccggcttccctcgcgctccgatccctctcctccctctcgcccgccgctctccgcgcctcagcagcctagggaacagcagcgcgggccctgggccggctggtccagccacaccgcctgtctccgctcgctgagccgctgcttcatcgcactgcagcctcaccccccttcctgcgcccgcgctgccctcagaaactctctgctcaggttcagctcggcgcggggaagcaactcgacctagcaggaatggtgccaatatagccaccccggaccggcgagcgccgcggagagcccgcccctatgggctgttcccggccaatcagcgggaggcgcggcccctgctcgcttttccccgcgcagccccctcccttctccactcagccgcaaggggactgcggtacccttctgctgccccagtgggcgcgcgacttgctgagtagccccaaggcccggctgggcaccaattccggacctatgaaaccgagcgagatgcaagcacccgcgtacgtgaaaggtgcctagggttttgagctcttagatgaaatgacaagcatcagatagaacgtttctgttttttatgttttacggtacttttaggcttctcaaacaaaataaaataagctacaacggaagttcttgtag

SEQ ID NO: 107566 - DNA, 120 bp, Homo sapiens; identical to SEQ ID NO: 74693
  misc_feature 1..120: note = chr12:43957403-43957523
  misc_feature 1..120: note = Hypo
  source 1..120: mol_type = genomic DNA

SEQ ID NO: 107567 - DNA, 30 bp, Homo sapiens; identical to SEQ ID NO: 74698
  misc_feature 1..30: note = chr12:44319436-44319466
  misc_feature 1..30: note = Hypo
  source 1..30: mol_type = genomic DNA

SEQ ID NO: 107568 - DNA, 1164 bp, Homo sapiens
  misc_feature 1..1164: note = chr12:45268922-45270086
  misc_feature 1..1164: note = Hyper
  source 1..1164: mol_type = genomic DNA
caaagttaggacaagcggcaagagcaactcctgccggggttatcggaactgaaatcacagtggggatgcagcacgccgggcataccttgaaagagaaaggctttcgtcccattatgcagccccgggacctgacgcactccggtcgtggactccccaagttctaactctgttaagacgtcaatctgtagggaagggtccacaccaagcccccaaactggtgaggggtatgaggtgggagagagaaaaaggaaaagctccatcaaaatgcaagtctcttcctccagggcagcaaagaaccgcgttttcgcgacaatattgggaactgaagatgagaggcgactgcctcctcctccgccgagagccttacctgagatcagcagccaagctttaaatagcggagcacccagtcccgtttccatgacctcctttaaacccttctctctgcaaagttccccctcagccctccgaccctggactaggggcgtgatccgcctcgcggtctccaaggcaagcacagaaaaaaaaaaaatccatatccaaacccgcccccttactccaagcttcccactccagacctactttgggtccgggaaaagcgaggcttccccagccagcccatgctgccccgaggcgggagccatccctttccccagccccagctctgcggccactcacctgctccgagaccgaagatcaaacagaatgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccggagggggcccggagggaggggtcggactcgccccggcgcggctccgtcggggaattagctcccgagccgaataaaagcagccaaagactcgcacacccggtagaaggggggcggccccaagaaagcccgggctggggcggccccgcacccccccgtcttccccgccgcccgaacctgttgtaaa

SEQ ID NO: 107569 - DNA, 535 bp, Homo sapiens; identical to SEQ ID NO: 74701
  misc_feature 1..535: note = chr12:45270378-45270913
  misc_feature 1..535: note = Hyper
  source 1..535: mol_type = genomic DNA

SEQ ID NO: 107570 - DNA, 986 bp, Homo sapiens
  misc_feature 1..986: note = chr12:45443857-45444843
  misc_feature 1..986: note = Hyper
  source 1..986: mol_type = genomic DNA
ctccccaagttgggccgcgcaaagctctccttgtcaagaacttttctgagagctggtgtcgtgcagcccgggaaacaggaccgggcaggttagaaacgttgaacttggtgaaaccccttgagactgatccaggcaggccgtagaaccctcagagtttcccagttaaggccaaaaagttaagcagccctaccacctgttgaaagaagggaacagcaaagaagctggtggaatgggatgggatggggcaaaaaagaatcacagaaagtggtgtgcctccgcctgggccccctactcccgaagtggcatctccactaaagctcgagatgctccaggaagttcccaaaccggctctccctgggcgcagtgcgcaccgccggcgctcccagatccctggaccacccggcctgggggcgcgggcgcggctggggagggaggggagagctggctcacctggcgctgaaggctggaaggtacagtctcggtcccccggagcccggcccggcagcctcgcactgtccgcagagggactgagcacttgaaaagcccaccgcgttccgtagggcgccccggcggggctaacttgttcggctgcggggcacagctttaggggaactgggctagcaggcaggggccggagctgcgcgcccgcggtggccagggcggtcgccgggtcgtggggcgcgggcggctgcagcctgggcgttggggcgcccccgacccgcagcaaattctcgatcaggaaactcttgcccaggttgccaaagccgggcgcagcggggaggttgaggagcgcggaggaagccacaacgtcccagtacgcaccggcgtgggctgcgaccgcgctggggagcatagtgcggcgccaaccggtctgctgcgcgcccgccttgcgcccgcctgtcgcccgggcgccccgcaccgcacccagagccgcagcttctcgccgccgcctcccgcagggctggagcgcgcggagccaggcaggg

SEQ ID NO: 107571 - DNA, 256 bp, Homo sapiens; identical to SEQ ID NO: 74704
  misc_feature 1..256: note = chr12:45445143-45445399
  misc_feature 1..256: note = Hyper
  source 1..256: mol_type = genomic DNA

SEQ ID NO: 107572 - DNA, 29 bp, Homo sapiens
  misc_feature 1..29: note = chr12:46495833-46495862
  misc_feature 1..29: note = Hypo
  source 1..29: mol_type = genomic DNA
gagaaacacatcagcggaagaacacacaa

SEQ ID NO: 107573 - DNA, 210 bp, Homo sapiens
  misc_feature 1..210: note = chr12:46767273-46767483
  misc_feature 1..210: note = Hyper
  source 1..210: mol_type = genomic DNA
ccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggtcttgctgagccaggcaactagggggacccttcgctgtggaaaaattggtgctgcgggaaaggcaagac

SEQ ID NO: 107574 - DNA, 924 bp, Homo sapiens
  misc_feature 1..924: note = chr12:47224753-47225677
  misc_feature 1..924: note = Hyper
  source 1..924: mol_type = genomic DNA
gcacacccgcgaccacgtatccctgagtttcctaacttagttcaccccttttcctccaagtcagcagcccggtgagcattccagggtcagtcctggtgctcaaagtaagggcaatcttccatctctgcctgctggatcacaaagaggagctgggagattcgccgttttcccccacaaccggcacctgccctggcccagagcgcagcgtccacctgtaccaccgctagatgaagagtacctcaccgcgcgctgcctgggcgcacagctggtgtgccgcgctcgccacctctcctggactcaagggtgctcccggcttacgcttctcggggcttcccgggtccgggttccctctcccccgtctcactttcttccttcattcgctcttctctcaatttttcctccatcagctctaacctgtaatcaattcccgccttctgcccctcctccctaggcttctcttagctcggttgccgcgaccccactatccgtccccgttcgcatttctgcaccgccctgcccttcactccagcgcgcagcaggccgggcaatccgaccgcgcggtaagccgccctcggaaccgctggcgcagttttcagactcgcccaccgcccagagaccaggggcccacatccagctctgctctcgccttctcccttgaaagagactccttgggggctccccaggtcagagtaccccgcccggggaatcatgctggtctctggggcgacccagctatcagagacgacagttctattttaagccttccacccagtgtccccgacctgaggacgcgggcgcgggtccagggactcgggtaacaccttgccagcaggatcccgggcggtcgcggagccagctcccgcgggggaagtcgggcctctcagccaggcaggcggcgcggccacggaacgcagtcccaataca

SEQ ID NO: 107575 - DNA, 132 bp, Homo sapiens; identical to SEQ ID NO: 74714
  misc_feature 1..132: note = chr12:47547800-47547932
  misc_feature 1..132: note = Hypo
  source 1..132: mol_type = genomic DNA

SEQ ID NO: 107576 - DNA, 86 bp, Homo sapiens; identical to SEQ ID NO: 43444
  misc_feature 1..86: note = chr12:47628723-47628809
  misc_feature 1..86: note = Hypo
  source 1..86: mol_type = genomic DNA

SEQ ID NO: 107577 - DNA, 162 bp, Homo sapiens; identical to SEQ ID NO: 74716
  misc_feature 1..162: note = chr12:47629046-47629208
  misc_feature 1..162: note = Hypo
  source 1..162: mol_type = genomic DNA

SEQ ID NO: 107578 - DNA, 54 bp, Homo sapiens; identical to SEQ ID NO: 74717
  misc_feature 1..54: note = chr12:47629490-47629544
  misc_feature 1..54: note = Hypo
  source 1..54: mol_type = genomic DNA

SEQ ID NO: 107579 - DNA, 169 bp, Homo sapiens; identical to SEQ ID NO: 74718
  misc_feature 1..169: note = chr12:47659833-47660002
  misc_feature 1..169: note = Hypo
  source 1..169: mol_type = genomic DNA

SEQ ID NO: 107580 - DNA, 74 bp, Homo sapiens; identical to SEQ ID NO: 74719
  misc_feature 1..74: note = chr12:48206723-48206797
  misc_feature 1..74: note = Hyper
  source 1..74: mol_type = genomic DNA

SEQ ID NO: 107581 - DNA, 46 bp, Homo sapiens; identical to SEQ ID NO: 74721
  misc_feature 1..46: note = chr12:48299419-48299465
  misc_feature 1..46: note = Hyper
  source 1..46: mol_type = genomic DNA

SEQ ID NO: 107582 - DNA, 38 bp, Homo sapiens; identical to SEQ ID NO: 74722
  misc_feature 1..38: note = chr12:48348058-48348096
  misc_feature 1..38: note = Hypo
  source 1..38: mol_type = genomic DNA

SEQ ID NO: 107583 - DNA, 30 bp, Homo sapiens; identical to SEQ ID NO: 74723
  misc_feature 1..30: note = chr12:48375679-48375709
  misc_feature 1..30: note = Hypo
  source 1..30: mol_type = genomic DNA

SEQ ID NO: 107584 - DNA, 266 bp, Homo sapiens; identical to SEQ ID NO: 74724
  misc_feature 1..266: note = chr12:48395916-48396182
  misc_feature 1..266: note = Hyper
  source 1..266: mol_type = genomic DNA

SEQ ID NO: 107585 - DNA, 338 bp, Homo sapiens; identical to SEQ ID NO: 74725
  misc_feature 1..338: note = chr12:48396748-48397086
  misc_feature 1..338: note = Hyper
  source 1..338: mol_type = genomic DNA

SEQ ID NO: 107586 - DNA, 1598 bp, Homo sapiens; identical to SEQ ID NO: 74726
  misc_feature 1..1598: note = chr12:48397146-48398744
  misc_feature 1..1598: note = Hyper
  source 1..1598: mol_type = genomic DNA

SEQ ID NO: 107587 - DNA, 138 bp, Homo sapiens; identical to SEQ ID NO: 74727
  misc_feature 1..138: note = chr12:48398948-48399086
  misc_feature 1..138: note = Hyper
  source 1..138: mol_type = genomic DNA

SEQ ID NO: 107588 - DNA, 30 bp, Homo sapiens; identical to SEQ ID NO: 74728
  misc_feature 1..30: note = chr12:48565607-48565637
  misc_feature 1..30: note = Hypo
  source 1..30: mol_type = genomic DNA

SEQ ID NO: 107589 - DNA, 188 bp, Homo sapiens; identical to SEQ ID NO: 34342
  misc_feature 1..188: note = chr12:48576788-48576976
  misc_feature 1..188: note = Hyper
  source 1..188: mol_type = genomic DNA

SEQ ID NO: 107590 - DNA, 861 bp, Homo sapiens; identical to SEQ ID NO: 74730
  misc_feature 1..861: note = chr12:48577469-48578330
  misc_feature 1..861: note = Hyper
  source 1..861: mol_type = genomic DNA

SEQ ID NO: 107591 - DNA, 100 bp, Homo sapiens; identical to SEQ ID NO: 74731
  misc_feature 1..100: note = chr12:48590813-48590913
  misc_feature 1..100: note = Hypo
  source 1..100: mol_type = genomic DNA

SEQ ID NO: 107592 - DNA, 22 bp, Homo sapiens
  misc_feature 1..22: note = chr12:48615310-48615332
  misc_feature 1..22: note = Hypo
  source 1..22: mol_type = genomic DNA
agtgtaacgttaccacaaattt

SEQ ID NO: 107593 - DNA, 36 bp, Homo sapiens; identical to SEQ ID NO: 74733
  misc_feature 1..36: note = chr12:49074244-49074280
  misc_feature 1..36: note = Hypo
  source 1..36: mol_type = genomic DNA

SEQ ID NO: 107594 - DNA, 18 bp, Homo sapiens
  misc_feature 1..18: note = chr12:49108598-49108616
  misc_feature 1..18: note = Hypo
  source 1..18: mol_type = genomic DNA
tataaggcggccaggcgc

SEQ ID NO: 107595 - DNA, 36 bp, Homo sapiens; identical to SEQ ID NO: 74735
  misc_feature 1..36: note = chr12:49111559-49111595
  misc_feature 1..36: note = Hypo
  source 1..36: mol_type = genomic DNA

SEQ ID NO: 107596 - DNA, 25 bp, Homo sapiens
  misc_feature 1..25: note = chr12:49174695-49174720
  misc_feature 1..25: note = Hypo
  source 1..25: mol_type = genomic DNA
cattctggccaggtgcggtggctca

SEQ ID NO: 107597 - DNA, 49 bp, Homo sapiens; identical to SEQ ID NO: 74737
  misc_feature 1..49: note = chr12:49276337-49276386
  misc_feature 1..49: note = Hyper
  source 1..49: mol_type = genomic DNA

SEQ ID NO: 107598 - DNA, 197 bp, Homo sapiens; identical to SEQ ID NO: 34345
  misc_feature 1..197: note = chr12:49297738-49297935
  misc_feature 1..197: note = Hyper
  source 1..197: mol_type = genomic DNA

SEQ ID NO: 107599 - DNA, 501 bp, Homo sapiens; identical to SEQ ID NO: 74739
  misc_feature 1..501: note = chr12:49363677-49364178
  misc_feature 1..501: note = Hyper
  source 1..501: mol_type = genomic DNA

SEQ ID NO: 107600 - DNA, 164 bp, Homo sapiens; identical to SEQ ID NO: 74740
  misc_feature 1..164: note = chr12:49366374-49366538
  misc_feature 1..164: note = Hyper
  source 1..164: mol_type = genomic DNA

SEQ ID NO: 107601 - DNA, 39 bp, Homo sapiens; identical to SEQ ID NO: 34349
  misc_feature 1..39: note = chr12:49367954-49367993
  misc_feature 1..39: note = Hyper
  source 1..39: mol_type = genomic DNA

SEQ ID NO: 107602 - DNA, 95 bp, Homo sapiens; identical to SEQ ID NO: 74742
  misc_feature 1..95: note = chr12:49372141-49372236
  misc_feature 1..95: note = Hyper
  source 1..95: mol_type = genomic DNA

SEQ ID NO: 107603 - DNA, 122 bp, Homo sapiens; identical to SEQ ID NO: 74743
  misc_feature 1..122: note = chr12:49372537-49372659
  misc_feature 1..122: note = Hyper
  source 1..122: mol_type = genomic DNA

SEQ ID NO: 107604 - DNA, 30 bp, Homo sapiens; identical to SEQ ID NO: 74744
  misc_feature 1..30: note = chr12:49373073-49373103
  misc_feature 1..30: note = Hyper
  source 1..30: mol_type = genomic DNA

SEQ ID NO: 107605 - DNA, 2156 bp, Homo sapiens
  misc_feature 1..2156: note = chr12:49373373-49375529
  misc_feature 1..2156: note = Hyper
  source 1..2156: mol_type = genomic DNA
ggggatcctgcacagcgtgagtggggggctgcagagtgccgtgcgcgagtgcaagtggcagttccggaatcgccgctggaactgtcccactgctccagggccccacctcttcggcaagatcgtcaaccgaggtgggtgcccaggaaggcgacgcttccgggagcaggggaaacgcggggtcacccccagggcatgggcgggcgagttcagagaaggtgtcccaggcgcctggagggtcacacaatcaaccttgccaagtgcctcgtgcccagcgccagctcggggccagacttctaccaggcgttttccagccgtgcaccctggaaacgaagcttaacttttctgagctactgccccagataaagaaagtttcgggtcgcggacgccggctgaccgccgctttcccccagcctctctcaaaagcgcctgggaagctgctctctgcaggcgtgtgtctggcctctcgcccagcaaggcttgcaccgccaaaatgggccgaaagttttgggctgcgaagaagtcttggggatgtatggttcttccgctcccctctcttcggtttgtctctctggggctgctccacttccgctatcgagccaaaatgcgccctagaatctcccagtaaggtgtgattacgcccgtggacgtggctgcgtgcccacgcacctgctttctctactagccctagagaccagctttccagcactgccggccctggctctcaggactcaaagtgcggagtcgggggtgggattccggtcccaagcccttcatgagggtgctggccgcgccccgcgtaccccctcgctgatccccgctcccttctcccacaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacggtgagctttgagaggctccgcaccctaagcggagcggcaggggccaacctcgggctggggaagtgacggtcggtgagataaggcaaggggcaccaggagagggcgtcctgggagagccggaggcttggaacgaagacggagaatagaggagacagtggctgagggcaaaggtatgtctggcccgcggacaggtagaagaggttgcaaatcaagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactctttcttcccctatccccgcagaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgggcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcctcgagccctcccccaaacagactcgctagcactcaagacccggttattcgcccacccgagtacctccagtc

SEQ ID NO: 107606 - DNA, 32 bp, Homo sapiens; identical to SEQ ID NO: 74747
  misc_feature 1..32: note = chr12:49375761-49375793
  misc_feature 1..32: note = Hyper
  source 1..32: mol_type = genomic DNA

SEQ ID NO: 107607 - DNA, 262 bp, Homo sapiens; identical to SEQ ID NO: 74748
  misc_feature 1..262: note = chr12:49388709-49388971
  misc_feature 1..262: note = Hyper
  source 1..262: mol_type = genomic DNA

SEQ ID NO: 107608 - DNA, 1719 bp, Homo sapiens
  misc_feature 1..1719: note = chr12:49390818-49392537
  misc_feature 1..1719: note = Hyper
  source 1..1719: mol_type = genomic DNA
cttctcgcagggccccggcgtagggccctggggtccgcgcccagccccggccggcgcgccgctggaccaccgccacttccgacccctcggctctgccctgggctcccgaagctgctgggcctaaggcttggtgctctgggctacctggctgcgtgggggcgtcccgcaggtttacttcgggggccgggagccccaagatgcggaaagtgcgctcctccagtgtggagtcccccggcctcccgccctcagcttcgcccccgcggcccccgccgggctggtgtaaaaggcgactgctcgacagccgcttttgacaaggggaaggaaagaccgtggccccttcaccctcctccttgccgggcttcgattggctgggggaatcccccaccacgcgtgtcaccccagagggcaaaagctgcacctgctgggttcggggggttggaacatattgggatcgtatcactacgcacgtggcgtcaatgacaaagacgccttccccacgggacaggccctgggaactgcggggcaaggtgtgggcacggcgggtcgccttccaaccctccagggtctccggtcctgccccctctccaagacccagagattctctccatccggtgcctccgggagcccagggtctggggagtgtctggctatggcggggcggctgctttttaggggagggaatccagcatttgggaaaccagatctgttctccttctttcccttccctcgagcccttgaggtggtgcctggatctgggagcgggatgcggggcacagggagccgcagttgcagaccccgcaggagctatctcggtgcctgcgctccctgtagctttggcttggggatggctgtcgctaccactgttcaggtcagcagcagccagccccaggcttttctccacgacccccttgccgggctctggccttgctctggccgctccacagcctggggatccccccaagagaccttgcccctgtcggagaccccaagccccgaggacgtcccggtagatccgaggatccagcctcttctttgtgcgccctccgtctgtcctggctggagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggccccgcccacgccgaccctgggtcgctctgcggctgcgcggatggacggggcgctcgccccacaggcgccaggcgctccggccgcaagggagcagggagccctgccagctgggccacccgaggggcgttgcggggctccgggcggggtcgacccggggggctccgtcgggccccaccagccttgcgcctttttcgctcggtctccttggcctcccgctcctgcgacgccgctttccttttctcttgctcccgagctcggacctcggccaggggccccgcccgccagttggtcgcctcctgcagcaccctggaggcccagggccggcggggcggcggctgtggggatcccgggcgcggcccacacctgggacaatgagcaggaacccaggtgagcagtttgtgggggaagggagccgaggtccggggagctgggagcactggagaccacttgg

SEQ ID NO: 107609 - DNA, 39 bp, Homo sapiens; identical to SEQ ID NO: 74751
  misc_feature 1..39: note = chr12:49392597-49392636
  misc_feature 1..39: note = Hyper
  source 1..39: mol_type = genomic DNA

SEQ ID NO: 107610 - DNA, 71 bp, Homo sapiens; identical to SEQ ID NO: 74752
  misc_feature 1..71: note = chr12:49393665-49393736
  misc_feature 1..71: note = Hyper
  source 1..71: mol_type = genomic DNA

SEQ ID NO: 107611 - DNA, 30 bp, Homo sapiens; identical to SEQ ID NO: 74753
  misc_feature 1..30: note = chr12:49443844-49443874
  misc_feature 1..30: note = Hypo
  source 1..30: mol_type = genomic DNA

SEQ ID NO: 107612 - DNA, 541 bp, Homo sapiens; identical to SEQ ID NO: 74754
  misc_feature 1..541: note = chr12:49483686-49484227
  misc_feature 1..541: note = Hyper
  source 1..541: mol_type = genomic DNA

SEQ ID NO: 107613 - DNA, 198 bp, Homo sapiens; identical to SEQ ID NO: 74755
  misc_feature 1..198: note = chr12:49485716-49485914
  misc_feature 1..198: note = Hyper
  source 1..198: mol_type = genomic DNA

SEQ ID NO: 107614 - DNA, 92 bp, Homo sapiens; identical to SEQ ID NO: 74756
  misc_feature 1..92: note = chr12:49486186-49486278
  misc_feature 1..92: note = Hyper
  source 1..92: mol_type = genomic DNA

SEQ ID NO: 107615 - DNA, 30 bp, Homo sapiens; identical to SEQ ID NO: 34360
  misc_feature 1..30: note = chr12:49487666-49487696
  misc_feature 1..30: note = Hyper
  source 1..30: mol_type = genomic DNA

SEQ ID NO: 107616 - DNA, 34 bp, Homo sapiens; identical to SEQ ID NO: 74758
  misc_feature 1..34: note = chr12:49515539-49515573
  misc_feature 1..34: note = Hypo
  source 1..34: mol_type = genomic DNA

SEQ ID NO: 107617 - DNA, 37 bp, Homo sapiens; identical to SEQ ID NO: 74760
  misc_feature 1..37: note = chr12:49596183-49596220
  misc_feature 1..37: note = Hypo
  source 1..37: mol_type = genomic DNA

SEQ ID NO: 107618 - DNA, 150 bp, Homo sapiens; identical to SEQ ID NO: 74761
  misc_feature 1..150: note = chr12:49657572-49657722
  misc_feature 1..150: note = Hypo
  source 1..150: mol_type = genomic DNA

SEQ ID NO: 107619 - DNA, 17 bp, Homo sapiens
  misc_feature 1..17: note = chr12:49661147-49661164
  misc_feature 1..17: note = Hypo
  source 1..17: mol_type = genomic DNA
aggtaaacatgatgccg

SEQ ID NO: 107620 - DNA, 30 bp, Homo sapiens; identical to SEQ ID NO: 34361
  misc_feature 1..30: note = chr12:49688858-49688888
  misc_feature 1..30: note = Hyper
  source 1..30: mol_type = genomic DNA

SEQ ID NO: 107621 - DNA, 38 bp, Homo sapiens; identical to SEQ ID NO: 74764
  misc_feature 1..38: note = chr12:49690563-49690601
  misc_feature 1..38: note = Hyper
  source 1..38: mol_type = genomic DNA

SEQ ID NO: 107622 - DNA, 109 bp, Homo sapiens; identical to SEQ ID NO: 74765
  misc_feature 1..109: note = chr12:49690983-49691092
  misc_feature 1..109: note = Hyper
  source 1..109: mol_type = genomic DNA

SEQ ID NO: 107623 - DNA, 283 bp, Homo sapiens
  misc_feature 1..283: note = chr12:49726844-49727127
  misc_feature 1..283: note = Hyper
  source 1..283: mol_type = genomic DNA
ggtagatgatgaagccggagaaggtgctgtacttgttggtgttgccgccgtgcactttcccgccgtccagcttgatgaagacctcgtcgcccacgtccaggtgcagaatgacgctgttgctggcgtagtcgtagttctggtccgcgtcctgagcaatggcgctggcccggacctatcgagggagaagaacctgctcatgctctgtgtggagctggggtgacgagaggggtcggggcggctgggcgtgcgaaggcggccgggcagccgccgcaggggctgggga

SEQ ID NO: 107624 - DNA, 667 bp, Homo sapiens; identical to SEQ ID NO: 74769
  misc_feature 1..667: note = chr12:49729713-49730380
  misc_feature 1..667: note = Hyper
  source 1..667: mol_type = genomic DNA

SEQ ID NO: 107625 - DNA, 117 bp, Homo sapiens; identical to SEQ ID NO: 74770
  misc_feature 1..117: note = chr12:49735966-49736083
  misc_feature 1..117: note = Hyper
  source 1..117: mol_type = genomic DNA

SEQ ID NO: 107626 - DNA, 36 bp, Homo sapiens; identical to SEQ ID NO: 34366
  misc_feature 1..36: note = chr12:49736792-49736828
  misc_feature 1..36: note = Hyper
  source 1..36: mol_type = genomic DNA

SEQ ID NO: 107627 - DNA, 108 bp, Homo sapiens; identical to SEQ ID NO: 74772
  misc_feature 1..108: note = chr12:49931485-49931593
  misc_feature 1..108: note = Hyper
  source 1..108: mol_type = genomic DNA

SEQ ID NO: 107628 - DNA, 30 bp, Homo sapiens; identical to SEQ ID NO: 74773
  misc_feature 1..30: note = chr12:49932996-49933026
  misc_feature 1..30: note = Hyper
  source 1..30: mol_type = genomic DNA

SEQ ID NO: 107629 - DNA, 67 bp, Homo sapiens; identical to SEQ ID NO: 74774
  misc_feature 1..67: note = chr12:49933430-49933497
  misc_feature 1..67: note = Hyper
  source 1..67: mol_type = genomic DNA

SEQ ID NO: 107630 - DNA, 36 bp, Homo sapiens; identical to SEQ ID NO: 74775
  misc_feature 1..36: note = chr12:49944080-49944116
  misc_feature 1..36: note = Hypo
  source 1..36: mol_type = genomic DNA

SEQ ID NO: 107631 - DNA, 35 bp, Homo sapiens; identical to SEQ ID NO: 74776
  misc_feature 1..35: note = chr12:50036399-50036434
  misc_feature 1..35: note = Hypo
  source 1..35: mol_type = genomic DNA

SEQ ID NO: 107632 - DNA, 54 bp, Homo sapiens; identical to SEQ ID NO: 74777
  misc_feature 1..54: note = chr12:50052209-50052263
  misc_feature 1..54: note = Hypo
  source 1..54: mol_type = genomic DNA

SEQ ID NO: 107633 - DNA, 30 bp, Homo sapiens; identical to SEQ ID NO: 74779
  misc_feature 1..30: note = chr12:50186522-50186552
  misc_feature 1..30: note = Hypo
  source 1..30: mol_type = genomic DNA

SEQ ID NO: 107634 - DNA, 627 bp, Homo sapiens
  misc_feature 1..627: note = chr12:50297461-50298088
  misc_feature 1..627: note = Hyper
  source 1..627: mol_type = genomic DNA
aggggaggatgctttcgtggtccagagggcttgctgaggatgacagggagccgggagccggaggatggaggatggtgcaggctggggagatgccggtacctttccctgggtcatggtgccgtctctcggggaaggggtccctgaggcccgggtggccgcttgggtaaccgcagcctgcctgcgtctcttccttcctccgcgtgggttctagcaacatccactgcagccgggccaggcgagccggcgcgtaccatcggcgcggggggaggagagggccgggcctgggaagatgctgcggaggacgctgcggattcgcgagcccggggtaaggcggcggcgcaccgccccctcccgccgcttcccccccaccccgccccccaccgccgcccttagccctcccccgggatgagagagagtcgcgctgcggagcaaccccagtggatgggtccgcgggggctgagcgggcggaggacgcgggaactccgtgacaccgaccagctgacgctgcccgcgtgaaaccagagccgggcatcagggcctcatctccactgtctctgcacctctctgcagctccagctgcgcctctgccttttcctcctccctctttggatgcggccctgatttctg

SEQ ID NO: 107635 - DNA, 905 bp, Homo sapiens
  misc_feature 1..905: note = chr12:50354892-50355797
  misc_feature 1..905: note = Hyper
  source 1..905: mol_type = genomic DNA
gcgcctccggggatccgttgcctagtccaggtactgcccagctaccgggcgtcgaggattgcgaagcgtcggggcaggctggcacggtgcccacttttcccaaaacgccagccttccaagcccagaagctcgcccggcccaggccgggagcggcccacgtcggacggccggaccgccctgcaggacccagcccggccgcccgcccccgccgccggcggtgagggaggtgagcggcgccgacctgcgggacgagcatcactccgacccagccgggggtgaggcgggtcaggatgctccggtcgcaggaggaaaaggaggagctggaccaaaagcccgaagagaagaaaaggggaaggccgcgcacggagcgcggtaaaggccggcggagctagacgccccgaggtcggagtgaagcgccgggaccgagccccgtctcccagggagtccggggcgcacggcaccgaggagagcgcgggagccaacctgggcgcatcatgcgcagggcccgggacgctgggccggtctacaccgccgcctgggtcacgtggcccggacgggccggcggctgccccggccggggggcgggggtcgcgccggggttgcgctggacgacggagagcggcgggcccgcagcggcctggagcctcccaacccgcgcgccgcgctggcccccgagcgtaggagccgccccctgcccccccgcgccggccccgcgcccggccgcccgccccctatatagcgcgccccagcagggcccgcgccaggccgccagcctcggagtgggcgcgggacagtgcgcggcgccccgcagccaggcccccgcccccgccgcatccacctcctccgccgcctgcgacccaacgggcgccccccgccgcggcagctgccgccgggcccccgcggcc

SEQ ID NO: 107636 - DNA, 146 bp, Homo sapiens; identical to SEQ ID NO: 74789
  misc_feature 1..146: note = chr12:50426748-50426894
  misc_feature 1..146: note = Hyper
  source 1..146: mol_type = genomic DNA

SEQ ID NO: 107637 - DNA, 241 bp, Homo sapiens; identical to SEQ ID NO: 34371
  misc_feature 1..241: note = chr12:50444182-50444423
  misc_feature 1..241: note = Hyper
  source 1..241: mol_type = genomic DNA

SEQ ID NO: 107638 - DNA, 30 bp, Homo sapiens; identical to SEQ ID NO: 74791
  misc_feature 1..30: note = chr12:50444626-50444656
  misc_feature 1..30: note = Hyper
  source 1..30: mol_type = genomic DNA

SEQ ID NO: 107639 - DNA, 41 bp, Homo sapiens; identical to SEQ ID NO: 74792
  misc_feature 1..41: note = chr12:50508302-50508343
  misc_feature 1..41: note = Hypo
  source 1..41: mol_type = genomic DNA

SEQ ID NO: 107640 - DNA, 30 bp, Homo sapiens; identical to SEQ ID NO: 74793
  misc_feature 1..30: note = chr12:50575698-50575728
  misc_feature 1..30: note = Hypo
  source 1..30: mol_type = genomic DNA

SEQ ID NO: 107641 - DNA, 19 bp, Homo sapiens
  misc_feature 1..19: note = chr12:50664625-50664644
  misc_feature 1..19: note = Hypo
  source 1..19: mol_type = genomic DNA
agcactttgggaggccgag

SEQ ID NO: 107642 - DNA, 30 bp, Homo sapiens; identical to SEQ ID NO: 43452
  misc_feature 1..30: note = chr12:50790622-50790652
  misc_feature 1..30: note = Hypo
  source 1..30: mol_type = genomic DNA

SEQ ID NO: 107643 - DNA, 24 bp, Homo sapiens
  misc_feature 1..24: note = chr12:50897742-50897766
  misc_feature 1..24: note = Hypo
  source 1..24: mol_type = genomic DNA
tttcttttctttagacggagtgtt

SEQ ID NO: 107644 - DNA, 30 bp, Homo sapiens; identical to SEQ ID NO: 74797
  misc_feature 1..30: note = chr12:50938109-50938139
  misc_feature 1..30: note = Hypo
  source 1..30: mol_type = genomic DNA

SEQ ID NO: 107645 - DNA, 30 bp, Homo sapiens; identical to SEQ ID NO: 74798
  misc_feature 1..30: note = chr12:51070876-51070906
  misc_feature 1..30: note = Hypo
  source 1..30: mol_type = genomic DNA

SEQ ID NO: 107646 - DNA, 30 bp, Homo sapiens; identical to SEQ ID NO: 74799
  misc_feature 1..30: note = chr12:51237808-51237838
  misc_feature 1..30: note = Hypo
  source 1..30: mol_type = genomic DNA

SEQ ID NO: 107647 - DNA, 520 bp, Homo sapiens; identical to SEQ ID NO: 74801
  misc_feature 1..520: note = chr12:51421126-51421646
  misc_feature 1..520: note = Hypo
  source 1..520: mol_type = genomic DNA

SEQ ID NO: 107648 - DNA, 104 bp, Homo sapiens; identical to SEQ ID NO: 74802
  misc_feature 1..104: note = chr12:51441353-51441457
  misc_feature 1..104: note = Hypo
  source 1..104: mol_type = genomic DNA

SEQ ID NO: 107649 - DNA, 32 bp, Homo sapiens; identical to SEQ ID NO: 74806
  misc_feature 1..32: note = chr12:51565442-51565474
  misc_feature 1..32: note = Hypo
  source 1..32: mol_type = genomic DNA

SEQ ID NO: 107650 - DNA, 41 bp, Homo sapiens; identical to SEQ ID NO: 74807
  misc_feature 1..41: note = chr12:51749684-51749725
  misc_feature 1..41: note = Hypo
  source 1..41: mol_type = genomic DNA

SEQ ID NO: 107651 - DNA, 30 bp, Homo sapiens; identical to SEQ ID NO: 74808
  misc_feature 1..30: note = chr12:51819149-51819179
  misc_feature 1..30: note = Hyper
  source 1..30: mol_type = genomic DNA

SEQ ID NO: 107652 - DNA, 86 bp, Homo sapiens; identical to SEQ ID NO: 74809
  misc_feature 1..86: note = chr12:51930708-51930794
  misc_feature 1..86: note = Hypo
  source 1..86: mol_type = genomic DNA

SEQ ID NO: 107653 - DNA, 59 bp, Homo sapiens; identical to SEQ ID NO: 74810
  misc_feature 1..59: note = chr12:51985238-51985297
  misc_feature 1..59: note = Hyper
  source 1..59: mol_type = genomic DNA

SEQ ID NO: 107654 - DNA, 30 bp, Homo sapiens; identical to SEQ ID NO: 74811
  misc_feature 1..30: note = chr12:52074429-52074459
  misc_feature 1..30: note = Hypo
  source 1..30: mol_type = genomic DNA

SEQ ID NO: 107655 - DNA, 523 bp, Homo sapiens
  misc_feature 1..523: note = chr12:52207881-52208404
  misc_feature 1..523: note = Hyper
  source 1..523: mol_type = genomic DNA
agccctgcactgtggcgagcgggccggggctgccgggcgacgcccggtcgccgtcgccgccagtgatccatagcgtgagcaggacgaccagcgccccggtgcccagcgcccccacgaagccggtgaggaggccgagcgccagcggccccgcccaacccatggggctccgctcgtacaggggctgcggcaggcgctccacgatcagctgcagggcgtcccagtccggcgcggggaccgcggcgcgccgggggcgcggggccggggcaaagggcacgcgggcggcggcgccgggccgcggcaggaagcgctgcccgaacttgcgcagctgcagcgtcgcctgctggtggaggttcttgcccagctccctggccacgtccgggcggccgctgcgccgcagggcccgagccaggcggtcccaggacagggacgcggcctggggggccagccaggccgccagcgcctcccggcagccgtcggacacctctccaggcccggctaccctgcccgccgggtcctcggccgc

SEQ ID NO: 107656 - DNA, 85 bp, Homo sapiens; identical to SEQ ID NO: 34372
  misc_feature 1..85: note = chr12:52208668-52208753
  misc_feature 1..85: note = Hyper
  source 1..85: mol_type = genomic DNA

SEQ ID NO: 107657 - DNA, 30 bp, Homo sapiens; identical to SEQ ID NO: 74815
  misc_feature 1..30: note = chr12:52241437-52241467
  misc_feature 1..30: note = Hyper
  source 1..30: mol_type = genomic DNA

SEQ ID NO: 107658 - DNA, 128 bp, Homo sapiens; identical to SEQ ID NO: 74816
  misc_feature 1..128: note = chr12:52241703-52241831
  misc_feature 1..128: note = Hyper
  source 1..128: mol_type = genomic DNA

SEQ ID NO: 107659 - DNA, 307 bp, Homo sapiens; identical to SEQ ID NO: 74817
  misc_feature 1..307: note = chr12:52242119-52242426
  misc_feature 1..307: note = Hyper
  source 1..307: mol_type = genomic DNA

SEQ ID NO: 107660 - DNA, 152 bp, Homo sapiens; identical to SEQ ID NO: 74818
  misc_feature 1..152: note = chr12:52258092-52258244
  misc_feature 1..152: note = Hyper
  source 1..152: mol_type = genomic DNA

SEQ ID NO: 107661 - DNA, 625 bp, Homo sapiens; identical to SEQ ID NO: 74819
  misc_feature 1..625: note = chr12:52262788-52263413
  misc_feature 1..625: note = Hyper
  source 1..625: mol_type = genomic DNA

SEQ ID NO: 107662 - DNA, 495 bp, Homo sapiens
  misc_feature 1..495: note = chr12:52301024-52301519
  misc_feature 1..495: note = Hyper
  source 1..495: mol_type = genomic DNA
gccccctcggggaggcggatgtgggaggcccggcccgggtgcgggccagcgacccgggagctgcgggcggctgggaggggaggccgccctgaggggctgggagcggcgcgggggtgggtcccggtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagaggtgagtcgaggtccgcggacgggaccgggtggcgggcggc

SEQ ID NO: 107663 - DNA, 37 bp, Homo sapiens; identical to SEQ ID NO: 74822
  misc_feature 1..37: note = chr12:52309137-52309174
  misc_feature 1..37: note = Hypo
  source 1..37: mol_type = genomic DNA

SEQ ID NO: 107664 - DNA, 72 bp, Homo sapiens; identical to SEQ ID NO: 74823
  misc_feature 1..72: note = chr12:52317378-52317450
  misc_feature 1..72: note = Hyper
  source 1..72: mol_type = genomic DNA

SEQ ID NO: 107665 - DNA, 206 bp, Homo sapiens; identical to SEQ ID NO: 74824
  misc_feature 1..206: note = chr12:52387854-52388060
  misc_feature 1..206: note = Hypo
  source 1..206: mol_type = genomic DNA

SEQ ID NO: 107666 - DNA, 198 bp, Homo sapiens; identical to SEQ ID NO: 74825
  misc_feature 1..198: note = chr12:52388300-52388498
  misc_feature 1..198: note = Hypo
  source 1..198: mol_type = genomic DNA

SEQ ID NO: 107667 - DNA, 1282 bp, Homo sapiens
  misc_feature 1..1282: note = chr12:52400255-52401537
  misc_feature 1..1282: note = Hyper
  source 1..1282: mol_type = genomic DNA
ccacccctactcctgcgcagccccgctgccgctctccctgccctggagtctcctgcagccccttggatctccgtgactctccctacctccccgactccccaggcttcttacagtgacctcttaccgtgccccactccatgaatcgccagagctattcgtccctaaatttcaaaccttgcgcaatgtcccttcacagacccctccaggtatcacgcagccccgagccccgagccccgccccgggggcctcatcccgccccttcgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgcagcagaaggaggaggcggcggccaccccggaccccgccgcccggactcccgactcggaagtcgcgcccgccgctccggtcccgaccccgggaccccctgccgcagccgccacccctgggcccccagcggacgagctgtacgcggcgctggaggactatcaccctgccgagctgtaccgcgcgctcgccgtgtccgggggcaccctgccccgccgaaaggtgcgtcccccgcccgccttcaggatctgctcagcccctctccgactccctacagggcctgctgactccgcagtgccctctcctcggcgtccgcggagtcccccaccttcttccccggcccgctgggtgcctcgactccccgcgttccccgctgctgcgaaggccgtggccctcgcctgcacaccgcgcccaggctcggtggctcttaactccgcgccccatgcacgccccctctctccctccttgactcctcccagcaccccccttctcctacccgctccatctggctttctgccccccatgccccgcctccccgtggccaggtgtcctgggtccccaggagcccctcgcccgagggacagagacagccccaggcaagttgaaggtccgagagcccccggtgggagaagcgggccggtggctgcgccgcgtgcgttctcactctgaggaagtgcgtggggagccgctgactccggatagcacaccct

SEQ ID NO: 107668 - DNA, 32 bp, Homo sapiens; identical to SEQ ID NO: 74829
  misc_feature 1..32: note = chr12:52416953-52416985
  misc_feature 1..32: note = Hyper
  source 1..32: mol_type = genomic DNA

SEQ ID NO: 107669 - DNA, 39 bp, Homo sapiens; identical to SEQ ID NO: 74830
  misc_feature 1..39: note = chr12:52467638-52467677
  misc_feature 1..39: note = Hypo
  source 1..39: mol_type = genomic DNA

SEQ ID NO: 107670 - DNA, 53 bp, Homo sapiens; identical to SEQ ID NO: 74831
  misc_feature 1..53: note = chr12:52491074-52491127
  misc_feature 1..53: note = Hypo
  source 1..53: mol_type = genomic DNA

SEQ ID NO: 107671 - DNA, 30 bp, Homo sapiens; identical to SEQ ID NO: 74832
  misc_feature 1..30: note = chr12:52514449-52514479
  misc_feature 1..30: note = Hypo
  source 1..30: mol_type = genomic DNA

SEQ ID NO: 107672 - DNA, 172 bp, Homo sapiens; identical to SEQ ID NO: 74834
  misc_feature 1..172: note = chr12:52524463-52524635
  misc_feature 1..172: note = Hypo
  source 1..172: mol_type = genomic DNA

SEQ ID NO: 107673 - DNA, 30 bp, Homo sapiens; identical to SEQ ID NO: 34381
  misc_feature 1..30: note = chr12:52615930-52615960
  misc_feature 1..30: note = Hyper
  source 1..30: mol_type = genomic DNA

SEQ ID NO: 107674 - DNA, 471 bp, Homo sapiens
  misc_feature 1..471: note = chr12:52626815-52627286
  misc_feature 1..471: note = Hyper
  source 1..471: mol_type = genomic DNA
gccgtctagggatggcgctcctgcctactccggaccatccctgcttggactgaaagcctgggcttcggcggggcgggcgggcagagggcggagggcggccccaggaggggcctggcagcagagaaaggtggcccgcggcagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaa

SEQ ID NO: 107675 - DNA, 517 bp, Homo sapiens
  misc_feature 1..517: note = chr12:52652138-52652655
  misc_feature 1..517: note = Hyper
  source 1..517: mol_type = genomic DNA
tgcgtccgcaggagccggcgcggaagcccccgcacacgctgtggctgccgaagcctccggtgaggccgcggtagcaggagacgccgcggtagggggcggcggtgatgcagcagcggccgggccggggcccgcaggccgagatgcagctgaaggcgcggaccccgcagggggcgctgaggcgggagtagaggcaggacatggtgcggtggcggcaggggcgggcggctggaccccaagccggcgctgcgccttatatgacggcccgcgggcccggggagggagctcgcggccaaggcgtttacgagcttggagggctcggccctcgcgcctcgcggagccgggaatgaaagcgagccaggccgcccggccgcctgcataaaacggcgttcgcctcccgcccgagttttatggggccgggaagcgcctggtcagccccgctgcccgtgcgctgcggtcagtgcgagtggaacccctccacctgtccgcccctccgccgggactccgagctttgccttgt

SEQ ID NO: 107676 - DNA, 76 bp, Homo sapiens; identical to SEQ ID NO: 74840
  misc_feature 1..76: note = chr12:52701967-52702043
  misc_feature 1..76: note = Hyper
  source 1..76: mol_type = genomic DNA

SEQ ID NO: 107677 - DNA, 211 bp, Homo sapiens; identical to SEQ ID NO: 11234
  misc_feature 1..211: note = chr12:52702362-52702573
  misc_feature 1..211: note = Hyper
  source 1..211: mol_type = genomic DNA

SEQ ID NO: 107678 - DNA, 30 bp, Homo sapiens; identical to SEQ ID NO: 43460
  misc_feature 1..30: note = chr12:52913808-52913838
  misc_feature 1..30: note = Hypo
  source 1..30: mol_type = genomic DNA

SEQ ID NO: 107679 - DNA, 30 bp, Homo sapiens; identical to SEQ ID NO: 43461
  misc_feature 1..30: note = chr12:52914057-52914087
  misc_feature 1..30: note = Hypo
  source 1..30: mol_type = genomic DNA

SEQ ID NO: 107680 - DNA, 41 bp, Homo sapiens; identical to SEQ ID NO: 74844
  misc_feature 1..41: note = chr12:53004285-53004326
  misc_feature 1..41: note = Hyper
  source 1..41: mol_type = genomic DNA

SEQ ID NO: 107681 - DNA, 102 bp, Homo sapiens; identical to SEQ ID NO: 43462
  misc_feature 1..102: note = chr12:53069161-53069263
  misc_feature 1..102: note = Hypo
  source 1..102: mol_type = genomic DNA

SEQ ID NO: 107682 - DNA, 196 bp, Homo sapiens; identical to SEQ ID NO: 74846
  misc_feature 1..196: note = chr12:53084865-53085061
  misc_feature 1..196: note = Hyper
  source 1..196: mol_type = genomic DNA

SEQ ID NO: 107683 - DNA, 30 bp, Homo sapiens; identical to SEQ ID NO: 74847
  misc_feature 1..30: note = chr12:53088494-53088524
  misc_feature 1..30: note = Hypo
  source 1..30: mol_type = genomic DNA

SEQ ID NO: 107684 - DNA, 615 bp, Homo sapiens; identical to SEQ ID NO: 74848
  misc_feature 1..615: note = chr12:53107999-53108614
  misc_feature 1..615: note = Hyper
  source 1..615: mol_type = genomic DNA

SEQ ID NO: 107685 - DNA, 210 bp, Homo sapiens; identical to SEQ ID NO: 43463
  misc_feature 1..210: note = chr12:53189513-53189723
  misc_feature 1..210: note = Hypo
  source 1..210: mol_type = genomic DNA

SEQ ID NO: 107686 - DNA, 78 bp, Homo sapiens; identical to SEQ ID NO: 74852
  misc_feature 1..78: note = chr12:53241495-53241573
  misc_feature 1..78: note = Hypo
  source 1..78: mol_type = genomic DNA

SEQ ID NO: 107687 - DNA, 32 bp, Homo sapiens; identical to SEQ ID NO: 74853
  misc_feature 1..32: note = chr12:53342879-53342911
  misc_feature 1..32: note = Hyper
  source 1..32: mol_type = genomic DNA

SEQ ID NO: 107688 - DNA, 320 bp, Homo sapiens
  misc_feature 1..320: note = chr12:53359275-53359595
  misc_feature 1..320: note = Hyper
  source 1..320: mol_type = genomic DNA
cctccttaaagatctcgcagtgaggttagggagctgctccccggctctgggaagccgctatcctgcccataccctcctttctctccgctgctgcccctgcctcgctcccgcgcgctcccattgggtggtgcctgggtgtccccggctcggcagctgcggctgcttcccagccccggggtctcagggccgtcccgccggtcccagggcaccgctcctgtgccccacgccgccgcttccccagttgccccctgactgcaagagtctcctggttttcggcttgtcctgggactcctgggagagcccaccgagagttctggggc

SEQ ID NO: 107689 - DNA, 21 bp, Homo sapiens
  misc_feature 1..21: note = chr12:53402530-53402551
  misc_feature 1..21: note = Hypo
  source 1..21: mol_type = genomic DNA
ttcttaaaggccgggcgcggt

SEQ ID NO: 107690 - DNA, 223 bp, Homo sapiens; identical to SEQ ID NO: 74858
  misc_feature 1..223: note = chr12:53454914-53455137
  misc_feature 1..223: note = Hypo
  source 1..223: mol_type = genomic DNA

SEQ ID NO: 107691 - DNA, 30 bp, Homo sapiens; identical to SEQ ID NO: 43464
  misc_feature 1..30: note = chr12:53455806-53455836
  misc_feature 1..30: note = Hypo
  source 1..30: mol_type = genomic DNA

SEQ ID NO: 107692 - DNA, 38 bp, Homo sapiens; identical to SEQ ID NO: 74860
  misc_feature 1..38: note = chr12:53456042-53456080
  misc_feature 1..38: note = Hypo
  source 1..38: mol_type = genomic DNA

SEQ ID NO: 107693 - DNA, 50 bp, Homo sapiens; identical to SEQ ID NO: 74861
  misc_feature 1..50: note = chr12:53509507-53509557
  misc_feature 1..50: note = Hypo
  source 1..50: mol_type = genomic DNA

SEQ ID NO: 107694 - DNA, 15 bp, Homo sapiens
  misc_feature 1..15: note = chr12:53535782-53535797
  misc_feature 1..15: note = Hypo
  source 1..15: mol_type = genomic DNA
cggttggagtgtgtg

SEQ ID NO: 107695 - DNA, 240 bp, Homo sapiens; identical to SEQ ID NO: 43466
  misc_feature 1..240: note = chr12:53662984-53663224
  misc_feature 1..240: note = Hypo
  source 1..240: mol_type = genomic DNA

SEQ ID NO: 107696 - DNA, 35 bp, Homo sapiens; identical to SEQ ID NO: 74864
  misc_feature 1..35: note = chr12:53668208-53668243
  misc_feature 1..35: note = Hypo
  source 1..35: mol_type = genomic DNA

SEQ ID NO: 107697 - DNA, 330 bp, Homo sapiens; identical to SEQ ID NO: 74866
  misc_feature 1..330: note = chr12:53719553-53719883
  misc_feature 1..330: note = Hyper
  source 1..330: mol_type = genomic DNA

SEQ ID NO: 107698 - DNA, 120 bp, Homo sapiens; identical to SEQ ID NO: 74867
  misc_feature 1..120: note = chr12:53763895-53764015
  misc_feature 1..120: note = Hypo
  source 1..120: mol_type = genomic DNA

SEQ ID NO: 107699 - DNA, 36 bp, Homo sapiens; identical to SEQ ID NO: 74868
  misc_feature 1..36: note = chr12:53785467-53785503
  misc_feature 1..36: note = Hypo
  source 1..36: mol_type = genomic DNA

SEQ ID NO: 107700 - DNA, 16 bp, Homo sapiens
  misc_feature 1..16: note = chr12:53810619-53810635
  misc_feature 1..16: note = Hypo
  source 1..16: mol_type = genomic DNA
aggtgtggtggctcac

SEQ ID NO: 107701 - DNA, 30 bp, Homo sapiens; identical to SEQ ID NO: 43467
  misc_feature 1..30: note = chr12:53813830-53813860
  misc_feature 1..30: note = Hypo
  source 1..30: mol_type = genomic DNA

SEQ ID NO: 107702 - DNA, 42 bp, Homo sapiens; identical to SEQ ID NO: 74871
  misc_feature 1..42: note = chr12:53832375-53832417
  misc_feature 1..42: note = Hypo
  source 1..42: mol_type = genomic DNA

SEQ ID NO: 107703 - DNA, 120 bp, Homo sapiens; identical to SEQ ID NO: 43468
  misc_feature 1..120: note = chr12:53885488-53885608
  misc_feature 1..120: note = Hypo
  source 1..120: mol_type = genomic DNA

SEQ ID NO: 107704 - DNA, 30 bp, Homo sapiens; identical to SEQ ID NO: 74874
  misc_feature 1..30: note = chr12:54021415-54021445
  misc_feature 1..30: note = Hypo
  source 1..30: mol_type = genomic DNA

SEQ ID NO: 107705 - DNA, 564 bp, Homo sapiens; identical to SEQ ID NO: 34393
  misc_feature 1..564: note = chr12:54089081-54089645
  misc_feature 1..564: note = Hyper
  source 1..564: mol_type = genomic DNA

SEQ ID NO: 107706 - DNA, 287 bp, Homo sapiens; identical to SEQ ID NO: 74876
  misc_feature 1..287: note = chr12:54132239-54132526
  misc_feature 1..287: note = Hyper
  source 1..287: mol_type = genomic DNA

SEQ ID NO: 107707 - DNA, 52 bp, Homo sapiens; identical to SEQ ID NO: 74877
  misc_feature 1..52: note = chr12:54133602-54133654
  misc_feature 1..52: note = Hyper
  source 1..52: mol_type = genomic DNA

SEQ ID NO: 107708 - DNA, 1133 bp, Homo sapiens
  misc_feature 1..1133: note = chr12:54144839-54145972
  misc_feature 1..1133: note = Hyper
  source 1..1133: mol_type = genomic DNA
tcacacacacacacacgcacacactcactcctgcgcacacaggctgctccgcggacacgcttcacggagcaggtgtgcccacgcgcaataccctcctggcccacaggcctccgcacgcacaggacacacacacacactctctcctggcctccctcccgccgcccctcctctgagccctgcggcccggccttccgcacctcccaacgcctgcaggggttgggggcgctggggctcggggcgctcactcggacctcggagccaatcgccagagatctaatggctcctttggcagtgggaaggggtgtgcgtgggtgtcctctccttcactctttccccagccctgtcgcctcccaccccccttccggccgcggcagtttccgaaatcgcccggcggccgcgaattcattagtggggggcggatgtaaacgcagcgcggtggaacgttttaattaggcctgaacaataaacaagctaaacgaggcgcgcaggactccctggtgggccctcagcctcctccgcgcggcgcggactcattacggctgcagccaatttcatgccagcgccgagcactggctgggccgggagtggggtcgggggtgcgtgcgggtgcgatccgggcctgcagggtgcggagcgggggcgtcccggggcgagggcagcgggccggttcccgcccgcccggggccgcggcttccgcatttctgcaccatccacctgcctttttcagtgtccttgagatgacgctccctccccacaccagagcggccggctggagagtctagcttgctttttagggtctctctcccgcctcttttcctcccccgctccctctctccttgcggctgactccagctccccctcggtgcccgtaaccctcctttcctctttttgccgcagtctccgtctctcttccacagggtctctccctccccctctccccgtggttgtcagactttctcctggactttctccgccccgcaccgcccgccccggatgccgagcgtggtagactctgcagccgggctcctcgctgcccgctggcgctgcctacacccccttgggctcccctccaaggtcccctccgctcgcccctctctgcccgctgccgccgccgccgccgccttccaggcctc

SEQ ID NO: 107709 - DNA, 964 bp, Homo sapiens; identical to SEQ ID NO: 74880
  misc_feature 1..964: note = chr12:54321250-54322214
  misc_feature 1..964: note = Hyper
  source 1..964: mol_type = genomic DNA

SEQ ID NO: 107710 - DNA, 433 bp, Homo sapiens; identical to SEQ ID NO: 74881
  misc_feature 1..433: note = chr12:54324532-54324965
  misc_feature 1..433: note = Hyper
  source 1..433: mol_type = genomic DNA

SEQ ID NO: 107711 - DNA, 661 bp, Homo sapiens
  misc_feature 1..661: note = chr12:54329256-54329917
  misc_feature 1..661: note = Hyper
  source 1..661: mol_type = genomic DNA
gcacgcaagcgcacgcgcacacgcacatacacagacgcttcccgtgaaaaagcatattaaatatctcctttctgtgttggatcatttaaaagaaaacatttcagagttgaacttagccgagagcttggttcatgagctgtagctgagggcagagtggcttctgccgctccgcggttgtagaagtccctttgaaaaagcagccgagagcagagccggggcttcccgacgaggctgaggagccgttttccattttcctttcgtataattaaatgctccgtctttctccgcataccagcagctggattttctctaaacttcatccacagtcaaacctcactgcctcatccccgaaggccggcggggcgcgcccgggtgagcaccgcagccgagggtttcagcgccaggccctggaaaggctttctagggcgagatcgccttggagatgtaattactacgtttctagtggtgcatattctcctggagtgtttaatttgattttacttgtgtctcagcgagatccacatttttttttcgggggagggggaagaaaccaccccaggcttaaagttaattaaccagcaaggctttactttccaccgccctcctgcaggctcttgcctcggcgcctcccttcccgatcccggctcgccccagacttgga

SEQ ID NO: 107712 - DNA, 292 bp, Homo sapiens; identical to SEQ ID NO: 74884
  misc_feature 1..292: note = chr12:54330283-54330575
  misc_feature 1..292: note = Hyper
  source 1..292: mol_type = genomic DNA

SEQ ID NO: 107713 - DNA, 345 bp, Homo sapiens; identical to SEQ ID NO: 74885
  misc_feature 1..345: note = chr12:54330790-54331135
  misc_feature 1..345: note = Hyper
  source 1..345: mol_type = genomic DNA

SEQ ID NO: 107714 - DNA, 42 bp, Homo sapiens; identical to SEQ ID NO: 74886
  misc_feature 1..42: note = chr12:54331998-54332040
  misc_feature 1..42: note = Hyper
  source 1..42: mol_type = genomic DNA

SEQ ID NO: 107715 - DNA, 1114 bp, Homo sapiens; identical to SEQ ID NO: 74887
  misc_feature 1..1114: note = chr12:54332740-54333854
  misc_feature 1..1114: note = Hyper
  source 1..1114: mol_type = genomic DNA

SEQ ID NO: 107716 - DNA, 923 bp, Homo sapiens
  misc_feature 1..923: note = chr12:54338666-54339589
  misc_feature 1..923: note = Hyper
  source 1..923: mol_type = genomic DNA
gcaatcctctggccccgttgagcccctgccagaactctgtgcctaggcagcctcgggtcctctatctcagtccagccgcttgcctcacttcttcccgcttgccttatctccccgcagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcat

SEQ ID NO: 107717 - DNA, 292 bp, Homo sapiens
  misc_feature 1..292: note = chr12:54343569-54343861
  misc_feature 1..292: note = Hyper
  source 1..292: mol_type = genomic DNA
aaggccttgatcttccggtggccagcgaaggggagggctgcttgcccccttgacgcgccatcccccttcccgcaggagcccgccgcctctgtttacacacagaggaggtgtcgtctccagtctagacaagggcgctaataacgcccataaaaggcggcctctccagagatgctctggcaactccgctcccgcgcgcctgccgctggccgctttctccacctccccccgccccgcccttctctgataccttggcgaggccggcgcacgggcctggggacggggaatccagaag

SEQ ID NO: 107718 - DNA, 196 bp, Homo sapiens; identical to SEQ ID NO: 74891
  misc_feature 1..196: note = chr12:54345040-54345236
  misc_feature 1..196: note = Hyper
  source 1..196: mol_type = genomic DNA

SEQ ID NO: 107719 - DNA, 465 bp, Homo sapiens
  misc_feature 1..465: note = chr12:54345567-54346032
  misc_feature 1..465: note = Hyper
  source 1..465: mol_type = genomic DNA
agagttcgcaccaatcgctccacggtttgggtgcctcggcctgaccacctatagttttgcgcatggtcagcgaagtgccggcgggttaagcccggctagacacggctgccccgactccttgggatgcgagtccctcgcccagccccagcctgctcccggcgaacagctctcgccgaggctggatttagattttaagcgtctcacccgagcctcccgccggccccggggacccagactgggagctgcatttttgtccgagcccggttaaaaaacgggtgcctgagttgcgtgtgtcgcggggttccttaaccacaaacggagcctcggtggtgcaccggaaggctggacgcttagattacctgggtccttgccagagtcctgaaaacccctaggttcccggtgggtctcagggagcaggacaccggggatgcgaattttgctagtggttgtcgacagctctccctg

SEQ ID NO: 107720 - DNA, 653 bp, Homo sapiens
  misc_feature 1..653: note = chr12:54348738-54349391
  misc_feature 1..653: note = Hyper
  source 1..653: mol_type = genomic DNA
ccgggtttgtggggccgctggtaaacatccacacgggagacaccttctacttccccaacttccgcgcgtccggggcgcagcttcccgggctgccttcgctgtcctacccacgccgcgacaacgtgtgctccctgtcctggccgtcggcggagccgtgcaatggctacccgcagccctacctcggcagcccagtgtctctcaaccctcccttcggccgcacgtgcgagctggcgcgcgtggaggacggcaagggttactaccgcgagccgtgcgccgagggtggcggcgggggcctgaagcgtgaggagcgcgggcgcgacccgggagccgggcccggggcagcgctgctcccgctggagccgtcggggccgcctgcgctcggcttcaagtacgactacgcggcgggcggcggcggtggcgacggcggcggcggcgcaggacctccgcacgacccgccctcctgccagtcgctggaatccgactccagttcgtccctgctcaacgagggcaacaagggcgccggcgcaggcgaccccggcagcttggtatcgccgttgaaccccggcggcgggctctcggccagcggtaaggaccccggccactcaagcggcggattcaaacccgacctcttaccagggcgggcagaacaggac

SEQ ID NO: 107721 - DNA, 998 bp, Homo sapiens
  misc_feature 1..998: note = chr12:54354476-54355474
  misc_feature 1..998: note = Hyper
  source 1..998: mol_type = genomic DNA
tctgctccactctgacgtgcacagacgaaattgagtatttaaagccactaagccgctatcgagccggcaggtgatgggtccggccgtctgggttctgtgggtgctaatgtagccggaaatccggcgcgatcgatggctgagacccagagcagagcagggaccgctggccccggtccgcgaacaaagcaaactccggggacttggggttccggccaggccggagcccctgcccaccctccctgctatatccaggaaagcagaagcggtttttcggccccaggccgcgcgagaaacgcactctggagccgccaatcctctctgcatggcacctggaggcgcggaaggttccggtgtaattcagcgggaggtggaaggcaggccccgatcccacagcgcgcctatgctcagcctttggtccgagcggccgccctcctgcgtgtgcctcggtccagacggcgctgccgattttccaaggagaggccgtggcccgcgtccgccgctgcaggactccccagcttcgccctccgctccgcgctgcagccctgcgcggtgctctcggttgccactctagccgaggcctcgagacaaagacgcgccgggcactggtggacgacccgggcgcctgggacactccctgactcgcgcctggagtgctcagcatcccggccctgtggcgaaggttgtgagaccttggtccaattccccgaccgtcgtggtcccggctgcggtcctctccagggtccagggagaggaaacccggcgcgcccacagccccggctgactcgagcagctcccgcgcccgacagcgccggcagctctggtctcctccggagggctgctgtgcccccgcgaaggacgagatgacccctgctggccggagctgtggaggttgcctcgccgagacccggatctgtccagtcgctcgtccctgagcaccctaggcgttggggggacgccctgtgagtgtgagagacctccaagagcggctggagtctgag

SEQ ID NO: 107722 - DNA, 465 bp, Homo sapiens
  misc_feature 1..465: note = chr12:54359619-54360084
  misc_feature 1..465: note = Hyper
  source 1..465: mol_type = genomic DNA
aaagataaaaagaggcgggagggaggcagaagcaagggtcggctgttgctctccctcgcccgggcgcctgcagcagtctgggtgggcgggggcgccatgacaaagtgaaggtcaagttagcatcgtaccttataaggaaggcgccggtcctccatttcagccttttctctgccaggacgcggccgtggcatttctggtcttgtaaacatcagactctttggggccttaaaaaaataaagacgcccctccttcctttaccgggggtgagccggccggggaaagcggcggacagggaaatcaactaatgaagactccgggaaacttttctctctttttctctctctggctccgctccccgccagctggggacccttccctccctccttcctccccctcccttcccccgcctctctttttctctatctcccagtcttctgtacctctcgccgccgtctgtaactctgg

SEQ ID NO: 107723 - DNA, 80 bp, Homo sapiens; identical to SEQ ID NO: 74900
  misc_feature 1..80: note = chr12:54360569-54360649
  misc_feature 1..80: note = Hyper
  source 1..80: mol_type = genomic DNA

SEQ ID NO: 107724 - DNA, 120 bp, Homo sapiens; identical to SEQ ID NO: 74901
  misc_feature 1..120: note = chr12:54363641-54363761
  misc_feature 1..120: note = Hyper
  source 1..120: mol_type = genomic DNA

SEQ ID NO: 107725 - DNA, 781 bp, Homo sapiens
  misc_feature 1..781: note = chr12:54366849-54367630
  misc_feature 1..781: note = Hyper
  source 1..781: mol_type = genomic DNA
cccctcctacgtctgcgaagtgctccgaactgatatatgacaatatctactttggatcacgtgctcagagagagagagactaagacggataacgcgtcatctcgccttcccaaattttcccccctcgctagaccgggtccaaaacctccatccggagccggcaggagaggagaacgatgtttaactcggtcaacctgggcaacttctgctctccgtcgcgcaaggagaggggcgcagatttcggcgagcgagggagctgcgcctccaacctctatctgcccagttgcacttactacatgcccgagttctccacggtctcctccttcctgccccaggccccctctcgtcagatctcctatccctactcggcccaagtgcccccggtccgggaggtctcctacggcctggagccatccggcaagtggcaccatcggaacagctactcctcctgctatgcggcggccgacgagcttatgcaccgggagtgcctgcctccttccaccgtcaccgagatcctcatgaaaaacgaaggctcctacggcggccaccaccaccccagcgccccgcacgcaacccccgccggcttctactcctcagtcaacaagaacagcgtcctgcctcaagccttcgaccgtttcttcgacaacgcctactgcggtggcggcgacccgcccgccgagcccccctgctccggcaagggcgaggccaagggggagcccgaggcacccccggcctcgggactggcgtcccgggctgaggcgggtgccgaggcggaggctga

SEQ ID NO: 107726 - DNA, 135 bp, Homo sapiens; identical to SEQ ID NO: 74904
  misc_feature 1..135: note = chr12:54368297-54368432
  misc_feature 1..135: note = Hyper
  source 1..135: mol_type = genomic DNA

SEQ ID NO: 107727 - DNA, 355 bp, Homo sapiens; identical to SEQ ID NO: 34422
  misc_feature 1..355: note = chr12:54368647-54369002
  misc_feature 1..355: note = Hyper
  source 1..355: mol_type = genomic DNA

SEQ ID NO: 107728 - DNA, 44 bp, Homo sapiens; identical to SEQ ID NO: 74906
  misc_feature 1..44: note = chr12:54369259-54369303
  misc_feature 1..44: note = Hyper
  source 1..44: mol_type = genomic DNA

SEQ ID NO: 107729 - DNA, 154 bp, Homo sapiens; identical to SEQ ID NO: 74907
  misc_feature 1..154: note = chr12:54377085-54377239
  misc_feature 1..154: note = Hyper
  source 1..154: mol_type = genomic DNA

SEQ ID NO: 107730 - DNA, 474 bp, Homo sapiens
  misc_feature 1..474: note = chr12:54377853-54378327
  misc_feature 1..474: note = Hyper
  source 1..474: mol_type = genomic DNA
tgtgtgctggtttcccgtgtgatacgtgactcctccaaactgaccgaggctccgcaggttccctctttctttcccggaatattccctgttttagcgggggcaaggtcaagcggaaagcgaggaccgccagggcctgaagtaaagcagcagaaccggctccaaggccaaagccttgtgggcccctgagatggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccctggcccaccctagaggctggagattcccagtcaacccccacaggaaacttgcaactccagcgccgcggcccccaagcttccagccccgagggccaagcccggggaaaagaggaggcgggagagcagaaac

SEQ ID NO: 107731 - DNA, 1672 bp, Homo sapiens
  misc_feature 1..1672: note = chr12:54378720-54380392
  misc_feature 1..1672: note = Hyper
  source 1..1672: mol_type = genomic DNA
cgcggggaagggctccggtgcccctaccccgaggcagctgctagatggcgctgttactccactctgcgcgctccgcctgccgacaacttgaccccgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactagcgtccgctgagctccaggctggtggcgcgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggagg

SEQ ID NO: 107732 - DNA, 191 bp, Homo sapiens
  misc_feature 1..191: note = chr12:54384576-54384767
  misc_feature 1..191: note = Hyper
  source 1..191: mol_type = genomic DNA
aggaggaggaggcagcgacaaggtaagagaagcggtttcttgttcttctcttggcggcggagtggggatgagcggtgtccccaggtgtccggcgtgcagcggacagagcctggaggaaggtgtttagggcatccgtgcttgccgagaacccaggctttcctagtggccgctggcagcggagggcagcgact

SEQ ID NO: 107733 - DNA, 536 bp, Homo sapiens; identical to SEQ ID NO: 74914
  misc_feature 1..536: note = chr12:54387818-54388354
  misc_feature 1..536: note = Hyper
  source 1..536: mol_type = genomic DNA

SEQ ID NO: 107734 - DNA, 251 bp, Homo sapiens; identical to SEQ ID NO: 74915
  misc_feature 1..251: note = chr12:54388604-54388855
  misc_feature 1..251: note = Hyper
  source 1..251: mol_type = genomic DNA

SEQ ID NO: 107735 - DNA, 210 bp, Homo sapiens; identical to SEQ ID NO: 74916
  misc_feature 1..210: note = chr12:54389111-54389321
  misc_feature 1..210: note = Hyper
  source 1..210: mol_type = genomic DNA

SEQ ID NO: 107736 - DNA, 497 bp, Homo sapiens
  misc_feature 1..497: note = chr12:54391267-54391764
  misc_feature 1..497: note = Hyper
  source 1..497: mol_type = genomic DNA
gacagaagtggccgccgcgcccggagccggtcccgcggcaaaggcccggcaagccagcgggctgcacaatgccacggctgctccgccagctcgcccctgccccgtcctgcctgcctacggccgcccttcctccgcctccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcgctgccagcagccgcccaagtgccgggcccggtcctcagccgccctgggctgggggaggtgctggctgtactggggatttggagaaagcctcggcagggggactgg

SEQ ID NO: 107737 - DNA, 30 bp, Homo sapiens; identical to SEQ ID NO: 74919
  misc_feature 1..30: note = chr12:54392718-54392748
  misc_feature 1..30: note = Hyper
  source 1..30: mol_type = genomic DNA

SEQ ID NO: 107738 - DNA, 1375 bp, Homo sapiens
  misc_feature 1..1375: note = chr12:54393359-54394734
  misc_feature 1..1375: note = Hyper
  source 1..1375: mol_type = genomic DNA
cacactatttaaaaacgcatttttaaaagccacgttccgaactgacaatcgctgatctcggctcgcgcagagactgcgggagcgtcggggccgacagagacggattacgtcaagaaatagttcctccacctacctcggtcggcctccccgcccctgcggggctcccgcgcccagctcggccctgggggtccgagaaccctggcttcggggactggcattttcaccccattaaaaaatcctcatggttggggggaggccatctgcttatgggtggacatgggcacaggggcttctcagatgagctaggagccgtcctgagggggtgaccggtgccttgggtccagagttccggacccccaggaaatcgcaggtcgcggggagcagcagagagaagggggtgggagagggggaaaagaaggcaaggaaaaaaaagcccctgcgcattgatccgcgccgtatttttgggtaaatacgatcacgtgggggccggggagccaatgagctgtggggaaaaggctggaaaaataattacctgacttgattgttctgtgagcagataaaaagtacatatacagttcatacaataatcttatgtatgtaaaaccccgttacgatgtcggcgacggggcccatcagtaactattacgtggactcgctcatctctcacgacaatgaagacctcctagcgtccaggtttccggccaccggggctcatcccgccgccgccagacccagcggtttggtgccggactgtagcgattttccgtcctgtagcttcgcgcccaagccggcagtgttcagcacgtcgtgggcgcccgtgccctctcagtcgtccgtggtatatcacccgtacggcccccagccccacctcggcgccgacacgcgctacatgcggacttggctcgagccgctgtccggcgccgtctccttccccagcttcccggccgggggccgtcactacgccctcaagccggacgcctaccccgggcgccgcgcggactgcggcccaggggagggccgcagctacccggactacatgtacggctcgcccggggagctgcgcgaccgcgccccgcagacactgccctcgcccgaggcggacgcgctcgccggcagcaagcacaaagaggagaaggccgacctggaccccagtaagttgggagcaattttcctttacaaccggcgcgggaggggaggggaggacgggcgggggcagccgaattacagccctcccgaaccgtgcagggagcgcgggagaggggcgagggggcgaggactcaataaaagcgaattaccttggggagctttcaggggcaggaggtctgagaatggggcccagggagacaggttgggagagggccgaggggagctcctc

SEQ ID NO: 107739 - DNA, 958 bp, Homo sapiens
  misc_feature 1..958: note = chr12:54398709-54399667
  misc_feature 1..958: note = Hyper
  source 1..958: mol_type = genomic DNA
cctctctcccctggtcgggagcgctgggatgcgggcttctctcccagaccgagagcggcgtttccgggcttccaccccgcccctgctcccaggccctgtcgcctcccctcagcgtccatcagcgcggcctgcttcctgcagccggcctgagcggccttactgcgggcaggaaggagggccgcgggcttggaggaccctgaggaaagcatgggatgcagaacaggcccacccggcccggcccactgttcaatcccagcccagcctgcaggtcaggattggaatcattttttattcgctatcatttacgaattaacaacacaacacgcatctggggaaagaaatgaaagctgggggtagagaggggctagcaaacgccctcttcccctaatcttcccctcccacctctcctctgctcctttgtcagaatcacaaaaccctaaagattgttccacttgagaaggcagcggataggtacatttccgcagccccgaaatgccacttttatggcgctgtttgtctccctgttctgggttctcaatggggccgaacaaaacagcagcgcggagctggctagacgtctgggcttaattgttttatggtttaaataaggtggacactttcctttgaaatcggattataggaatgttttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgttccaagcccagaaatgcgcctgaatggggggagatcgcggcagttgctttgc

SEQ ID NO: 107740 - DNA, 160 bp, Homo sapiens; identical to SEQ ID NO: 74926
  misc_feature 1..160: note = chr12:54402652-54402812
  misc_feature 1..160: note = Hyper
  source 1..160: mol_type = genomic DNA

SEQ ID NO: 107741 - DNA, 820 bp, Homo sapiens; identical to SEQ ID NO: 74927
  misc_feature 1..820: note = chr12:54402872-54403692
  misc_feature 1..820: note = Hyper
  source 1..820: mol_type = genomic DNA

SEQ ID NO: 107742 - DNA, 30 bp, Homo sapiens; identical to SEQ ID NO: 74928
  misc_feature 1..30: note = chr12:54404826-54404856
  misc_feature 1..30: note = Hyper
  source 1..30: mol_type = genomic DNA

SEQ ID NO: 107743 - DNA, 476 bp, Homo sapiens; identical to SEQ ID NO: 74929
  misc_feature 1..476: note = chr12:54408316-54408792
  misc_feature 1..476: note = Hyper
  source 1..476: mol_type = genomic DNA

SEQ ID NO: 107744 - DNA, 78 bp, Homo sapiens; identical to SEQ ID NO: 74930
  misc_feature 1..78: note = chr12:54410286-54410364
  misc_feature 1..78: note = Hyper
  source 1..78: mol_type = genomic DNA

SEQ ID NO: 107745 - DNA, 30 bp, Homo sapiens
  misc_feature 1..30: note = chr12:54420671-54420701
  misc_feature 1..30: note = Hyper
  source 1..30: mol_type = genomic DNA
aaagatcataaaatccggcgacatccgggt

SEQ ID NO: 107746 - DNA, 30 bp, Homo sapiens; identical to SEQ ID NO: 74931
  misc_feature 1..30: note = chr12:54422111-54422141
  misc_feature 1..30: note = Hyper
  source 1..30: mol_type = genomic DNA

SEQ ID NO: 107747 - DNA, 94 bp, Homo sapiens; identical to SEQ ID NO: 74932
  misc_feature 1..94: note = chr12:54422431-54422525
  misc_feature 1..94: note = Hyper
  source 1..94: mol_type = genomic DNA

SEQ ID NO: 107748 - DNA, 434 bp, Homo sapiens
  misc_feature 1..434: note = chr12:54424752-54425186
  misc_feature 1..434: note = Hyper
  source 1..434: mol_type = genomic DNA
ccttctgttcgttctcgcgatcgcactgaggggctgggaggcctctctgggctccctgcgcggagcaacacacacaccctgcgggaaaaagccgcgtaggattttgttgcggggggagctgggatcagtcggtttgggcaccaaccccacgcaggcctttcttcctgcctgtggcagccggtgtcctcggcgtccgaaccctgaggcgccccgaaagaccagtaaagaagcactatccaggcaccagggtctcctccacccactcccgggagttggaggcggggggcgccgtgagagcaagccccaggcccgcgccaagctggctgttgcgaaacgtagcggaggcggagagcggagggaaagagaagaccgcgggactggagccctgtcggcagggattgagcgattcaaggacatctcgagagagaaagcct

SEQ ID NO: 107749 - DNA, 49 bp, Homo sapiens
  misc_feature 1..49: note = chr12:54427258-54427307
  misc_feature 1..49: note = Hyper
  source 1..49: mol_type = genomic DNA
tcaaagaggagcaggcgcagacagggcagcccgccggactgagccagcc

SEQ ID NO: 107750 - DNA, 51 bp, Homo sapiens
  misc_feature 1..51: note = chr12:54427910-54427961
  misc_feature 1..51: note = Hyper
  source 1..51: mol_type = genomic DNA
gggctggcccgcctgcggcccgcgtggcctgtcttgcggctctcgcctcct

SEQ ID NO: 107751 - DNA, 161 bp, Homo sapiens
  misc_feature 1..161: note = chr12:54428267-54428428
  misc_feature 1..161: note = Hyper
  source 1..161: mol_type = genomic DNA
gctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggca

SEQ ID NO: 107752 - DNA, 356 bp, Homo sapiens
  misc_feature 1..356: note = chr12:54440843-54441199
  misc_feature 1..356: note = Hyper
  source 1..356: mol_type = genomic DNA
tcttctggtgcttctcgcccgccagcgcagggcccaggtgtttgaggcgaaggggctctagctccccgcaagcctggagccaggcgtcgcgcttcctccgggcttaatccagacctttcaacacacacctcattcgggggaggagaaaagcacaggaccgcggagagcccagctttgaggccaggcctgaagggataacccacacagggaacgttttcctatcagagaataatggagcacaaaataattcagaaagcgaatgggcaggaccacagcctgagagtcccgcgccgcggggccgctgcagagccggtctcccgagcaccgcggcaggaccatttcgttggaatgtaggg

SEQ ID NO: 107753 - DNA, 30 bp, Homo sapiens; identical to SEQ ID NO: 34445
  misc_feature 1..30: note = chr12:54446784-54446814
  misc_feature 1..30: note = Hyper
  source 1..30: mol_type = genomic DNA

SEQ ID NO: 107754 - DNA, 30 bp, Homo sapiens
  misc_feature 1..30: note = chr12:54447414-54447444
  misc_feature 1..30: note = Hyper
  source 1..30: mol_type = genomic DNA
gggttgtcagtctggcgggatgtgcactgg

SEQ ID NO: 107755 - DNA, 223 bp, Homo sapiens
  misc_feature 1..223: note = chr12:54447818-54448041
  misc_feature 1..223: note = Hyper
  source 1..223: mol_type = genomic DNA
gccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtcccc

SEQ ID NO: 107756 - DNA, 30 bp, Homo sapiens; identical to SEQ ID NO: 74940
  misc_feature 1..30: note = chr12:54475536-54475566
  misc_feature 1..30: note = Hyper
  source 1..30: mol_type = genomic DNA

SEQ ID NO: 107757 - DNA, 228 bp, Homo sapiens
  misc_feature 1..228: note = chr12:54484237-54484465
  misc_feature 1..228: note = Hyper
  source 1..228: mol_type = genomic DNA
ggagggagggactcccgggctcgccaaacagcggggcctcgggcaagagcgtcgccagcgcgtcctcattctgcgattactgtcaggggaccatccatcagcgccgcccgggacgctgggccagactgcccgccgcccgcccgggtctctccagatcgcattagcgtggggcgagggcgcagtgcggcaccggctgctgagggagaggcgtggcggggaggggggcgg

SEQ ID NO: 107758 - DNA, 102 bp, Homo sapiens; identical to SEQ ID NO: 74943
  misc_feature 1..102: note = chr12:54500112-54500214
  misc_feature 1..102: note = Hyper
  source 1..102: mol_type = genomic DNA

SEQ ID NO: 107759 - DNA, 30 bp, Homo sapiens
  misc_feature 1..30: note = chr12:54500684-54500714
  misc_feature 1..30: note = Hyper
  source 1..30: mol_type = genomic DNA
ccgcgagatccctgccgctccagttcggaa

SEQ ID NO: 107760 - DNA, 1081 bp, Homo sapiens
  misc_feature 1..1081: note = chr12:54519930-54521011
  misc_feature 1..1081: note = Hyper
  source 1..1081: mol_type = genomic DNA
ttcaccctcccttttcgccatgtgggggccctgagcgccgccccagaagaggtcgagggaatgttgtgggctggggcacaccagcacggcagaaactggagaaagcgagagacgtcgccagggacccagggacctctccctccagttccccgggcccgcccggccctgatggccactcacgctatagcgcccactctgtcctgggccatcccgcgccagcagtgtagcccccagcccgggcgcctgaatgctctccctccggatcgctgctcgggtccccactttggcgaccgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgaggggagatggagaagggagcggagttggggtttcgagggctaaagtgggagagagggtgctccgcttcccgtactgaaggaaggatgtgtgtgcttattccccagtcgggaccgattaccagcctagaaaaacccagccgcgtcccaaacccgctcaccccagcaggcccttagagacgcttggagatccccagacacgccccgcggaaagggaaggaaatgccagcccgagttgccgactctgccgggacggggcgggggatccgccca

SEQ ID NO: 107761 - DNA, 188 bp, Homo sapiens; identical to SEQ ID NO: 74946
  misc_feature 1..188: note = chr12:54567315-54567503
  misc_feature 1..188: note = Hyper
  source 1..188: mol_type = genomic DNA

SEQ ID NO: 107762 - DNA, 30 bp, Homo sapiens; identical to SEQ ID NO: 74947
  misc_feature 1..30: note = chr12:54609854-54609884
  misc_feature 1..30: note = Hyper
  source 1..30: mol_type = genomic DNA

SEQ ID NO: 107763 - DNA, 94 bp, Homo sapiens; identical to SEQ ID NO: 74948
  misc_feature 1..94: note = chr12:54611458-54611552
  misc_feature 1..94: note = Hyper
  source 1..94: mol_type = genomic DNA

SEQ ID NO: 107764 - DNA, 83 bp, Homo sapiens; identical to SEQ ID NO: 74949
  misc_feature 1..83: note = chr12:54720220-54720303
  misc_feature 1..83: note = Hypo
  source 1..83: mol_type = genomic DNA

SEQ ID NO: 107765 - DNA, 37 bp, Homo sapiens; identical to SEQ ID NO: 74950
  misc_feature 1..37: note = chr12:54767860-54767897
  misc_feature 1..37: note = Hypo
  source 1..37: mol_type = genomic DNA

SEQ ID NO: 107766 - DNA, 640 bp, Homo sapiens; identical to SEQ ID NO: 74951
  misc_feature 1..640: note = chr12:54811982-54812622
  misc_feature 1..640: note = Hyper
  source 1..640: mol_type = genomic DNA

SEQ ID NO: 107767 - DNA, 50 bp, Homo sapiens; identical to SEQ ID NO: 74952
  misc_feature 1..50: note = chr12:54812829-54812879
  misc_feature 1..50: note = Hyper
  source 1..50: mol_type = genomic DNA

SEQ ID NO: 107768 - DNA, 164 bp, Homo sapiens; identical to SEQ ID NO: 74953
  misc_feature 1..164: note = chr12:54914315-54914479
  misc_feature 1..164: note = Hypo
  source 1..164: mol_type = genomic DNA

SEQ ID NO: 107769 - DNA, 94 bp, Homo sapiens; identical to SEQ ID NO: 74954
  misc_feature 1..94: note = chr12:54936727-54936821
  misc_feature 1..94: note = Hypo
  source 1..94: mol_type = genomic DNA

SEQ ID NO: 107770 - DNA, 95 bp, Homo sapiens; identical to SEQ ID NO: 74955
  misc_feature 1..95: note = chr12:54942993-54943088
  misc_feature 1..95: note = Hyper
  source 1..95: mol_type = genomic DNA

SEQ ID NO: 107771 - DNA, 72 bp, Homo sapiens; identical to SEQ ID NO: 74956
  misc_feature 1..72: note = chr12:54943351-54943423
  misc_feature 1..72: note = Hyper
  source 1..72: mol_type = genomic DNA

SEQ ID NO: 107772 - DNA, 125 bp, Homo sapiens; identical to SEQ ID NO: 74957
  misc_feature 1..125: note = chr12:54982532-54982657
  misc_feature 1..125: note = Hyper
  source 1..125: mol_type = genomic DNA

SEQ ID NO: 107773 - DNA, 111 bp, Homo sapiens; identical to SEQ ID NO: 43470
  misc_feature 1..111: note = chr12:55356770-55356881
  misc_feature 1..111: note = Hypo
  source 1..111: mol_type = genomic DNA

SEQ ID NO: 107774 - DNA, 30 bp, Homo sapiens; identical to SEQ ID NO: 74959
  misc_feature 1..30: note = chr12:55390771-55390801
  misc_feature 1..30: note = Hypo
  source 1..30: mol_type = genomic DNA

SEQ ID NO: 107775 - DNA, 30 bp, Homo sapiens; identical to SEQ ID NO: 74961
  misc_feature 1..30: note = chr12:55413842-55413872
  misc_feature 1..30: note = Hyper
  source 1..30: mol_type = genomic DNA

SEQ ID NO: 107776 - DNA, 30 bp, Homo sapiens; identical to SEQ ID NO: 74964
  misc_feature 1..30: note = chr12:55632656-55632686
  misc_feature 1..30: note = Hypo
  source 1..30: mol_type = genomic DNA

SEQ ID NO: 107777 - DNA, 86 bp, Homo sapiens; identical to SEQ ID NO: 74965
  misc_feature 1..86: note = chr12:55786340-55786426
  misc_feature 1..86: note = Hypo
  source 1..86: mol_type = genomic DNA

SEQ ID NO: 107778 - DNA, 51 bp, Homo sapiens; identical to SEQ ID NO: 74966
  misc_feature 1..51: note = chr12:56031566-56031617
  misc_feature 1..51: note = Hypo
  source 1..51: mol_type = genomic DNA

SEQ ID NO: 107779 - DNA, 30 bp, Homo sapiens; identical to SEQ ID NO: 43472
  misc_feature 1..30: note = chr12:56094359-56094389
  misc_feature 1..30: note = Hypo
  source 1..30: mol_type = genomic DNA

SEQ ID NO: 107780 - DNA, 41 bp, Homo sapiens; identical to SEQ ID NO: 74968
  misc_feature 1..41: note = chr12:56441277-56441318
  misc_feature 1..41: note = Hypo
  source 1..41: mol_type = genomic DNA

SEQ ID NO: 107781 - DNA, 120 bp, Homo sapiens; identical to SEQ ID NO: 74969
  misc_feature 1..120: note = chr12:56881719-56881839
  misc_feature 1..120: note = Hyper
  source 1..120: mol_type = genomic DNA

SEQ ID NO: 107782 - DNA, 30 bp, Homo sapiens; identical to SEQ ID NO: 74970
  misc_feature 1..30: note = chr12:56882439-56882469
  misc_feature 1..30: note = Hyper
  source 1..30: mol_type = genomic DNA

SEQ ID NO: 107783 - DNA, 39 bp, Homo sapiens; identical to SEQ ID NO: 74972
  misc_feature 1..39: note = chr12:57054141-57054180
  misc_feature 1..39: note = Hypo
  source 1..39: mol_type = genomic DNA

SEQ ID NO: 107784 - DNA, 30 bp, Homo sapiens; identical to SEQ ID NO: 74973
  misc_feature 1..30: note = chr12:57054388-57054418
  misc_feature 1..30: note = Hypo
  source 1..30: mol_type = genomic DNA

SEQ ID NO: 107785 - DNA, 38 bp, Homo sapiens; identical to SEQ ID NO: 74974
  misc_feature 1..38: note = chr12:57120619-57120657
  misc_feature 1..38: note = Hypo
  source 1..38: mol_type = genomic DNA

SEQ ID NO: 107786 - DNA, 30 bp, Homo sapiens; identical to SEQ ID NO: 74977
  misc_feature 1..30: note = chr12:57423345-57423375
  misc_feature 1..30: note = Hypo
  source 1..30: mol_type = genomic DNA

SEQ ID NO: 107787 - DNA, 152 bp, Homo sapiens; identical to SEQ ID NO: 74978
  misc_feature 1..152: note = chr12:57483850-57484002
  misc_feature 1..152: note = Hyper
  source 1..152: mol_type = genomic DNA

SEQ ID NO: 107788 - DNA, 30 bp, Homo sapiens; identical to SEQ ID NO: 43474
  misc_feature 1..30: note = chr12:57493886-57493916
  misc_feature 1..30: note = Hypo
  source 1..30: mol_type = genomic DNA

SEQ ID NO: 107789 - DNA, 285 bp, Homo sapiens; identical to SEQ ID NO: 74980
  misc_feature 1..285: note = chr12:57504479-57504764
  misc_feature 1..285: note = Hyper
  source 1..285: mol_type = genomic DNA

SEQ ID NO: 107790 - DNA, 33 bp, Homo sapiens; identical to SEQ ID NO: 74981
  misc_feature 1..33: note = chr12:57522742-57522775
  misc_feature 1..33: note = Hyper
  source 1..33: mol_type = genomic DNA

SEQ ID NO: 107791 - DNA, 56 bp, Homo sapiens; identical to SEQ ID NO: 43475
  misc_feature 1..56: note = chr12:57559766-57559822
  misc_feature 1..56: note = Hypo
  source 1..56: mol_type = genomic DNA

SEQ ID NO: 107792 - DNA, 152 bp, Homo sapiens; identical to SEQ ID NO: 74983
  misc_feature 1..152: note = chr12:57570049-57570201
  misc_feature 1..152: note = Hypo
  source 1..152: mol_type = genomic DNA

SEQ ID NO: 107793 - DNA, 78 bp, Homo sapiens; identical to SEQ ID NO: 74984
  misc_feature 1..78: note = chr12:57576610-57576688
  misc_feature 1..78: note = Hypo
  source 1..78: mol_type = genomic DNA

SEQ ID NO: 107794 - DNA, 146 bp, Homo sapiens; identical to SEQ ID NO: 74985
  misc_feature 1..146: note = chr12:57587641-57587787
  misc_feature 1..146: note = Hypo
  source 1..146: mol_type = genomic DNA

SEQ ID NO: 107795 - DNA, 30 bp, Homo sapiens; identical to SEQ ID NO: 74986
  misc_feature 1..30: note = chr12:57604796-57604826
  misc_feature 1..30: note = Hypo
  source 1..30: mol_type = genomic DNA

SEQ ID NO: 107796 - DNA, 601 bp, Homo sapiens; identical to SEQ ID NO: 74987
  misc_feature 1..601: note = chr12:57613840-57614441
  misc_feature 1..601: note = Hyper
  source 1..601: mol_type = genomic DNA

SEQ ID NO: 107797 - DNA, 583 bp, Homo sapiens
  misc_feature 1..583: note = chr12:57618574-57619157
  misc_feature 1..583: note = Hyper
  source 1..583: mol_type = genomic DNA
gtggaaagggactggcgtcgatagggctctggcaggatggcgggggacaaccccagcgtctctctctcctctttcttcgtgcacaggccgtcagtgcccagataccagagtccggaaggccgcagtacctggggctgcgccccgccgcggccggagcgggtgcccccggccagcagctcccagagccaaggtcttcggacggcctaggcgtgggccgcgcctggagctgggcctggccgaccaaccacacgggggcgctggcccgggcaggggcagccggggcgttgcccgcgcagcgcaccaagaggaagccgtccatcaaggcggcgcgcgccaaaaagatcttcggctggggggacttctactttcgggtgcataccctcaagttttcgctgctggtgaccggcaagatcgtggaccatgtgaacggtaccttcagtgtgtatttccgccacaactcgtccagcctgggcaacctcagtgtcagcatcgtgccgccctccaagcgtgtcgagttcggaggagtctggctgcccgggcctgtcccccaccctctgcagtctacgctcgccctggagggggt

SEQ ID NO: 107798 - DNA, 30 bp, Homo sapiens; identical to SEQ ID NO: 74990
  misc_feature 1..30: note = chr12:57620559-57620589
  misc_feature 1..30: note = Hyper
  source 1..30: mol_type = genomic DNA

SEQ ID NO: 107799 - DNA, 88 bp, Homo sapiens; identical to SEQ ID NO: 74991
  misc_feature 1..88: note = chr12:57632036-57632124
  misc_feature 1..88: note = Hyper
  source 1..88: mol_type = genomic DNA

SEQ ID NO: 107800 - DNA, 64 bp, Homo sapiens; identical to SEQ ID NO: 34460
  misc_feature 1..64: note = chr12:57632479-57632543
  misc_feature 1..64: note = Hyper
  source 1..64: mol_type = genomic DNA

SEQ ID NO: 107801 - DNA, 103 bp, Homo sapiens; identical to SEQ ID NO: 74993
  misc_feature 1..103: note = chr12:57635003-57635106
  misc_feature 1..103: note = Hyper
  source 1..103: mol_type = genomic DNA

SEQ ID NO: 107802 - DNA, 30 bp, Homo sapiens; identical to SEQ ID NO: 74994
  misc_feature 1..30: note = chr12:57635463-57635493
  misc_feature 1..30: note = Hyper
  source 1..30: mol_type = genomic DNA

SEQ ID NO: 107803 - DNA, 30 bp, Homo sapiens; identical to SEQ ID NO: 74996
  misc_feature 1..30: note = chr12:57857277-57857307
  misc_feature 1..30: note = Hypo
  source 1..30: mol_type = genomic DNA

SEQ ID NO: 107804 - DNA, 30 bp, Homo sapiens; identical to SEQ ID NO: 74997
  misc_feature 1..30: note = chr12:57862418-57862448
  misc_feature 1..30: note = Hypo
  source 1..30: mol_type = genomic DNA

SEQ ID NO: 107805 - DNA, 343 bp, Homo sapiens; identical to SEQ ID NO: 74998
  misc_feature 1..343: note = chr12:57869912-57870255
  misc_feature 1..343: note = Hyper
  source 1..343: mol_type = genomic DNA

SEQ ID NO: 107806 - DNA, 341 bp, Homo sapiens; identical to SEQ ID NO: 74999
  misc_feature 1..341: note = chr12:57881038-57881379
  misc_feature 1..341: note = Hypo
  source 1..341: mol_type = genomic DNA

SEQ ID NO: 107807 - DNA, 30 bp, Homo sapiens; identical to SEQ ID NO: 75000
  misc_feature 1..30: note = chr12:57939956-57939986
  misc_feature 1..30: note = Hypo
  source 1..30: mol_type = genomic DNA

SEQ ID NO: 107808 - DNA, 442 bp, Homo sapiens; identical to SEQ ID NO: 75001
  misc_feature 1..442: note = chr12:57943746-57944188
  misc_feature 1..442: note = Hyper
  source 1..442: mol_type = genomic DNA

SEQ ID NO: 107809 - DNA, 62 bp, Homo sapiens; identical to SEQ ID NO: 75002
  misc_feature 1..62: note = chr12:57963777-57963839
  misc_feature 1..62: note = Hypo
  source 1..62: mol_type = genomic DNA

SEQ ID NO: 107810 - DNA, 405 bp, Homo sapiens
  misc_feature 1..405: note = chr12:58004542-58004947
  misc_feature 1..405: note = Hyper
  source 1..405: mol_type = genomic DNA
tattagcataaagttcgcatctaatttgcatgagacccatttaatcgcagagacctccactcttcttgccttcgagtccaatgtgtgtcccccatcccagtcgatcccgagccctcgcaggcagagtgtccccgcgccccacccctggcccctcgccagcccgggctccaggacttcgccttaattggcgattagtcttagctggagtcccggggcctggaggaaagaagggtcctgagagagggcggcatctgggttgtgttcacccacaaaagactccccatacacgcaccccgtaccagggggcctctgtccactcggccggggacagccccaaacccagaacatcttcgcacaggccaaggccccatccactgagtcctccttcatcgcagaggccaaggg

SEQ ID NO: 107811 - DNA, 574 bp, Homo sapiens
  misc_feature 1..574: note = chr12:58014693-58015267
  misc_feature 1..574: note = Hyper
  source 1..574: mol_type = genomic DNA
tctgcatttgtcccccggcggcaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatggtgagggaggacccggggaggaacccggggggatccctgctgaggggccagggaaattgggccggggaagagggagggaccagctttcggcttgggttcgggagggcggaggtgcgcggggttggtttgctcctcctctagatggtgacagcgcgtcttctcccccacagctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaaggtgggggtggaagaagaaaggagaaggggcttctagaggtcccgtgaatagggaaac

SEQ ID NO: 107812 - DNA, 69 bp, Homo sapiens; identical to SEQ ID NO: 75006
  misc_feature 1..69: note = chr12:58015479-58015548
  misc_feature 1..69: note = Hyper
  source 1..69: mol_type = genomic DNA

SEQ ID NO: 107813 - DNA, 700 bp, Homo sapiens
  misc_feature 1..700: note = chr12:58021293-58021993
  misc_feature 1..700: note = Hyper
  source 1..700: mol_type = genomic DNA
ccgctggcggctgggcgcgggtgcagcctaggaggagaggcgcgtgaccgtgcgccagctccccgtggggctcctgccagggtcgaccgggagggggtgccactcacccagatgagccacgcggctgaggcgggggtcgaaaccgacctcgcgcaccttgtcagtccgcgccaggaagaagttaaccacgccgtcggtgaccacgcagcctgggaagccgacgagctcgtggtggaagccgcgcctttgccggaggcagttcccgaggcctggggcgccgggctccacgctcagcagctgccgataagtggtggcaaagccggagatctcgcgcaccgcgccccccacctgcagggagagggaggttgcctccaggcgggcctgggataggggacccgaaggggtcaaggtctgcgctccggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcggcgtccgctccagcacgtccacaagcctctccagccgcgtccgcgccgtgaagacgaagtcgtcgtccacccacagca

SEQ ID NO: 107814 - DNA, 735 bp, Homo sapiens
  misc_feature 1..735: note = chr12:58025580-58026315
  misc_feature 1..735: note = Hyper
  source 1..735: mol_type = genomic DNA
tcactccacacagcccgttaggagaatgcaggcatctgagcccagcagtggagaaaacaaaagcccccagaccacccccagcgagcgctgcgctgcgccgccgcggtcggcactcaccccactacttgctccttgatcctgaccgggatgtgtgcgtagcggggctcaggagcaagatctggcagctcgggcctgcgggggctttgcgggggcgcccacggcgcaagaggtagccggaggccgggcgcgtcccgggtgctcgcgtacaggagccccagcgaggcgcaggcgagcagaaggaccagagcgcacagggcccggcggcccagccacatcctaggtgggggtagggtggggagtgagaaagggagggaagaagggagggcaagggatggggcccttggcccccgcgtcctcagaggctcctgccggctcccaagagcgctctccactccacacatcgcgctagggtttgcactgccagccgcggttttcccggtacccctcccctcacttcccaggccccagggtctcccggcctcctttcttctcgccctctcctgcatctcggtttcctcacacacccgaggcctggcatcttaatgctgaagacatttggatgccgcggtttcgacgcggccgtgcgtaagcggaaaagccccgctctatcagggcagtggcagtccccaagcccgccgcccgccctggccggcgcgcccccgactcctcagtctg

SEQ ID NO: 107815 - DNA, 160 bp, Homo sapiens; identical to SEQ ID NO: 75012
  misc_feature 1..160: note = chr12:58125465-58125625
  misc_feature 1..160: note = Hypo
  source 1..160: mol_type = genomic DNA

SEQ ID NO: 107816 - DNA, 35 bp, Homo sapiens; identical to SEQ ID NO: 75013
  misc_feature 1..35: note = chr12:58144980-58145015
  misc_feature 1..35: note = Hypo
  source 1..35: mol_type = genomic DNA

SEQ ID NO: 107817 - DNA, 87 bp, Homo sapiens; identical to SEQ ID NO: 75014
  misc_feature 1..87: note = chr12:58158951-58159038
  misc_feature 1..87: note = Hyper
  source 1..87: mol_type = genomic DNA

SEQ ID NO: 107818 - DNA, 57 bp, Homo sapiens; identical to SEQ ID NO: 75015
  misc_feature 1..57: note = chr12:58159289-58159346
  misc_feature 1..57: note = Hyper
  source 1..57: mol_type = genomic DNA

SEQ ID NO: 107819 - DNA, 97 bp, Homo sapiens; identical to SEQ ID NO: 34472
  misc_feature 1..97: note = chr12:58159773-58159870
  misc_feature 1..97: note = Hyper
  source 1..97: mol_type = genomic DNA

SEQ ID NO: 107820 - DNA, 124 bp, Homo sapiens; identical to SEQ ID NO: 75017
  misc_feature 1..124: note = chr12:58160215-58160339
  misc_feature 1..124: note = Hyper
  source 1..124: mol_type = genomic DNA

SEQ ID NO: 107821 - DNA, 24 bp, Homo sapiens
  misc_feature 1..24: note = chr12:58177383-58177407
  misc_feature 1..24: note = Hypo
  source 1..24: mol_type = genomic DNA
tttttttttttcagacggagtctt

SEQ ID NO: 107822 - DNA, 120 bp, Homo sapiens; identical to SEQ ID NO: 75019
  misc_feature 1..120: note = chr12:58204698-58204818
  misc_feature 1..120: note = Hypo
  source 1..120: mol_type = genomic DNA

SEQ ID NO: 107823 - DNA, 90 bp, Homo sapiens; identical to SEQ ID NO: 43477
  misc_feature 1..90: note = chr12:58241509-58241599
  misc_feature 1..90: note = Hypo
  source 1..90: mol_type = genomic DNA

SEQ ID NO: 107824 - DNA, 30 bp, Homo sapiens; identical to SEQ ID NO: 75022
  misc_feature 1..30: note = chr12:58517132-58517162
  misc_feature 1..30: note = Hypo
  source 1..30: mol_type = genomic DNA

SEQ ID NO: 107825 - DNA, 281 bp, Homo sapiens; identical to SEQ ID NO: 75023
  misc_feature 1..281: note = chr12:59313662-59313943
  misc_feature 1..281: note = Hyper
  source 1..281: mol_type = genomic DNA

SEQ ID NO: 107826 - DNA, 72 bp, Homo sapiens; identical to SEQ ID NO: 75024
  misc_feature 1..72: note = chr12:59924125-59924197
  misc_feature 1..72: note = Hypo
  source 1..72: mol_type = genomic DNA

SEQ ID NO: 107827 - DNA, 46 bp, Homo sapiens; identical to SEQ ID NO: 75025
  misc_feature 1..46: note = chr12:59989556-59989602
  misc_feature 1..46: note = Hyper
  source 1..46: mol_type = genomic DNA

SEQ ID NO: 107828 - DNA, 491 bp, Homo sapiens; identical to SEQ ID NO: 75026
  misc_feature 1..491: note = chr12:59990053-59990544
  misc_feature 1..491: note = Hyper
  source 1..491: mol_type = genomic DNA

SEQ ID NO: 107829 - DNA, 21 bp, Homo sapiens
  misc_feature 1..21: note = chr12:60167632-60167653
  misc_feature 1..21: note = Hypo
  source 1..21: mol_type = genomic DNA
cactcccggcctaaatcaatg

SEQ ID NO: 107830 - DNA, 30 bp, Homo sapiens; identical to SEQ ID NO: 75029
  misc_feature 1..30: note = chr12:62075123-62075153
  misc_feature 1..30: note = Hypo
  source 1..30: mol_type = genomic DNA

SEQ ID NO: 107831 - DNA, 42 bp, Homo sapiens; identical to SEQ ID NO: 75030
  misc_feature 1..42: note = chr12:62253491-62253533
  misc_feature 1..42: note = Hypo
  source 1..42: mol_type = genomic DNA

SEQ ID NO: 107832 - DNA, 17 bp, Homo sapiens
  misc_feature 1..17: note = chr12:62384406-62384423
  misc_feature 1..17: note = Hypo
  source 1..17: mol_type = genomic DNA
cccggcccactgtgcca

SEQ ID NO: 107833 - DNA, 31 bp, Homo sapiens; identical to SEQ ID NO: 43479
  misc_feature 1..31: note = chr12:62539074-62539105
  misc_feature 1..31: note = Hypo
  source 1..31: mol_type = genomic DNA

SEQ ID NO: 107834 - DNA, 31 bp, Homo sapiens; identical to SEQ ID NO: 43480
  misc_feature 1..31: note = chr12:62539225-62539256
  misc_feature 1..31: note = Hypo
  source 1..31: mol_type = genomic DNA

SEQ ID NO: 107835 - DNA, 42 bp, Homo sapiens; identical to SEQ ID NO: 43481
  misc_feature 1..42: note = chr12:62563338-62563380
  misc_feature 1..42: note = Hypo
  source 1..42: mol_type = genomic DNA

SEQ ID NO: 107836 - DNA, 168 bp, Homo sapiens; identical to SEQ ID NO: 43482
  misc_feature 1..168: note = chr12:62580835-62581003
  misc_feature 1..168: note = Hypo
  source 1..168: mol_type = genomic DNA

SEQ ID NO: 107837 - DNA, 2088 bp, Homo sapiens
  misc_feature 1..2088: note = chr12:62584250-62586338
  misc_feature 1..2088: note = Hyper
  source 1..2088: mol_type = genomic DNA
actagtagcaagatccgggagacatctaaccggaaagaaataaaaaaccattagtttcccgaagccattcttattctgaacgctgttcgttaagagaatcatttactaaagctctcttgtagtagcctttacaaaagctttatttcattcagtaagaaagcgccccgtcccaaatctaaataaaccttacatagatgaggctccggaaattatcagcttgattctttatgaagatagttagaggtggataaatcaatagactcgctgaaacacccaccttctgcaaacaggcctgagaattaactaatcagaagtggacaaaaagtagggatttcagaaagatgacctgacacatcccattgatcttccctggaatgcgacccccaactccttattaagagtccaaaatggttaccagccaggatgggtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgaccgcccgcgagggagacgccggccgatggacccgcatctgccctcacctctcgccttccccgggcgatccctctacagtcccggacccccgagaaaggggaagggagacgtgtgcacacgggggcttccgggaccgcggtcctgcagttgccgctccggtccccagcgctggccggcgacccgaggcgcggctcgcacctacctgcagccccgcttcccggtggcggcaacacctagcgatgctcctgcagcttttgcgggccggcgccagccttatcgctctcgcatcgcttccaagatgccaatccgccgtcaccatccaggggcatagggaaccgaagtctggtgctgtgtgatcgtggagggcggcgtgtgagtgtggccctgagcgtgcgagtgtgcgcgcgcgtgtgtggatgtgtttcctcctccgatggcaaagacggttcaggaatctgacatccaagctggaatccccctgaagcgggtgaaggtgagcctgatccttctccccgcttctttattccacagtgtcaaagtaatcaaaagatttgtttactgaggaaaagccaaagtcccgcagcccttggcagcgcccgcggtcgcctcctgtcctcgccggatgcgcgcggtgcgctcagctccctggactgcaagaatcaaggcggtcttgctgcaattaccgctcttattccatctctgatttgtttgcttttaaggccgactaaagacttttcctctcgcctcacgtcgtctctccctctcacacacacacacactcacacatcctccgttccctctctcccgccctccctcttgttctctggggaaaggcaattggacagaatgattcaccttcaggaaagcagcctcggccacgcacttctcgagttccctggctctcgcaggtaccgggtctccaacgtggcggagttgctgggaagctcgggacaggaaggaggagaggctctgagctcagccgatgtcccccctccagacgcccgcgttcctccgtccaggtgcccctgttcccactgctcgcagataggtccccgctggtgccctcgcggagacttggcgccttccactcgaatccacttagcagcaactcctggccagcttcagcccctcaatcccgcctcgaagtgctgcgggcagagccccacgcagcccacccgctgcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggccgaggaaacaaatccagatcaccggcggagaaagaagccgtttagcaagcaaagcctcctctccgcgtcccaccccagatgctatactgtcaaaagacactgatgctaatcttttagaaagtcgccataaagggcag

SEQ ID NO: 107838 - DNA, 22 bp, Homo sapiens
  misc_feature 1..22: note = chr12:62603703-62603725
  misc_feature 1..22: note = Hypo
  source 1..22: mol_type = genomic DNA
aggcgcaggggctcacgcctgt

SEQ ID NO: 107839 - DNA, 24 bp, Homo sapiens
  misc_feature 1..24: note = chr12:62630991-62631015
  misc_feature 1..24: note = Hypo
  source 1..24: mol_type = genomic DNA
atgatccattctgttcgccgggcg

SEQ ID NO: 107840 - DNA, 175 bp, Homo sapiens; identical to SEQ ID NO: 75040
  misc_feature 1..175: note = chr12:62829159-62829334
  misc_feature 1..175: note = Hyper
  source 1..175: mol_type = genomic DNA

SEQ ID NO: 107841 - DNA, 30 bp, Homo sapiens; identical to SEQ ID NO: 75041
  misc_feature 1..30: note = chr12:62862175-62862205
  misc_feature 1..30: note = Hypo
  source 1..30: mol_type = genomic DNA

SEQ ID NO: 107842 - DNA, 565 bp, Homo sapiens; identical to SEQ ID NO: 75042
  misc_feature 1..565: note = chr12:63025691-63026256
  misc_feature 1..565: note = Hyper
  source 1..565: mol_type = genomic DNA

SEQ ID NO: 107843 - DNA, 40 bp, Homo sapiens; identical to SEQ ID NO: 75043
  misc_feature 1..40: note = chr12:63033701-63033741
  misc_feature 1..40: note = Hypo
  source 1..40: mol_type = genomic DNA

SEQ ID NO: 107844 - DNA, 78 bp, Homo sapiens; identical to SEQ ID NO: 75046
  misc_feature 1..78: note = chr12:63195735-63195813
  misc_feature 1..78: note = Hypo
  source 1..78: mol_type = genomic DNA

SEQ ID NO: 107845 - DNA, 139 bp, Homo sapiens; identical to SEQ ID NO: 75047
  misc_feature 1..139: note = chr12:63327187-63327326
  misc_feature 1..139: note = Hyper
  source 1..139: mol_type = genomic DNA

SEQ ID NO: 107846 - DNA, 1256 bp, Homo sapiens
  misc_feature 1..1256: note = chr12:63543750-63545006
  misc_feature 1..1256: note = Hyper
  source 1..1256: mol_type = genomic DNA
gtgcggatcttggcccgggaaatggacttcacgctgctgacacagggtgcgagcaggaaccccttttggaaggccacacccgcttgctctgcacccttgctctggcgcgacgccgtcttcccgcggacgttgcaccagatgttgtagcagatgaagccgtagcaggtacccaagatgaccacgggcgccacaaagatgccgcccgtcatccaggtcacgtaggcacgagaaccccagggctggatgaaggtggcccagcagtcgcgggccttggtgacattgttcacctcgatcatggagaagacgaagtactgcggcgtgctcagcacgaagctcagcacccaggcggccgcgatcatgaggcgcgagcggcgcgcgggctgttgcagagtcttgagcgggtggcacaccgcgatgtagcggtcggctgtcatgactaccagcatgtaggccgacgcaaacatgccgaacacctgcaggtgcttcaccacgcggcacagccagtcggggccgcggaagcggtaggtgatgtcccagcacatttgcggcagcacctggaagaatgccacggccaggtcggccaggctgaggtgtcggatgaagaggtgcatgcgggacgtcttgcgcggcgtccggtgcagagccagcagtacgctgctgttgcccagcacggccaccgcgaaagtcaccgccagcacggcgatctccagtttggccagctcctcgttgcgcacgtccctcggtgggccgttgccctccccgagggcttcggcctcccggcttgtgttgccagcgccggtggccagaggccaccatgggctggagttgcccgagggccccgcgtcgggaccggcggagagacgcatgctgtccatgcagctcctactcggccctcttcggagctccagccctcgcgggccgctccctccccgtctcggaggacttgggctcctcgtccgaagcgcagggtctttggcgcgctcgcagcttgccgggctctgcgatccctccagtgggcgtctcccggagcagcgtcccgcctgcccactgagcagctctcagcagggtgagctggcccctctccctgctctgccttttttcaacttcggcgaggtcgggaaggtgagctccgagcttccggaagcactgggttcccaactcaagtatttatgcggtgcttgtttccttgggacgcgctccctcccgccctattgccggaagactgctggttgcctactccccgctccctggagttt

SEQ ID NO: 107847 - DNA, 319 bp, Homo sapiens
  misc_feature 1..319: note = chr12:63545267-63545586
  misc_feature 1..319: note = Hyper
  source 1..319: mol_type = genomic DNA
gaaacctccagtccacgcaccggcgtccacgcatctagctcctgcacctgaacctggctctcgacctcacctcctccagtccgggtttcttccttctcaccgagctcacccgtgcagcagtctggcaaattttattccccaggcaaattttcccggggcaaacatttctccccgctcgtgacttaaagagctatctcttcctagtaacgtctttgatgcatgctatttattaccctatgtttgcgacgggaagaacgcactcatcactttgcagccccagtggctgctgtgcctgtattcacagcggggtttgggggga

SEQ ID NO: 107848 - DNA, 30 bp, Homo sapiens; identical to SEQ ID NO: 43485
  misc_feature 1..30: note = chr12:63788043-63788073
  misc_feature 1..30: note = Hypo
  source 1..30: mol_type = genomic DNA

SEQ ID NO: 107849 - DNA, 1373 bp, Homo sapiens
  misc_feature 1..1373: note = chr12:64061778-64063151
  misc_feature 1..1373: note = Hyper
  source 1..1373: mol_type = genomic DNA
aagactcaagaaaagcgccatgcggctccctcctagggctctcctgccctctcctcaccgatgccgagagtggttctgctggagaaccgccgcgcctgcagttcctgcaccttttcccggagctgcgccagggaattacggacgaactggaaggggccgagaagaaaggtcttggccaccacctctagctccaagccttttcgctctttcagactttggatcctccccggggaggacctccaggagccccttggcagtttcccgccgcctagggccgacttttccatctcctcctctacctccggctcccgggcgagggaggccccgcgccgccccttagactggctgcggccggaagattgcagccgctttgagcttactccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccctgagtgtcccctcacgtgctccccagcgcgagcagcacccccgcctctgcgcttcccagagcgtgcagcttccggtgagggcagccccacgcacagccccccacaccctccccagcgcctgcagcctccggtgcgcgcaggccccaagcccacatgcgcagtcctcaccttgcgcgcagccccatgtacagccccggacgggctcccagccccactggcgcagaacccatcaccgcttgcccttcacgcgcttcattgggagtgcagcccccaccccgagcgcgcagctccacgcagcctctccacactctccccagcgcctgcagcacccccagtgcgcacagctctgccagtcgcttccccgggcgccgcccctgcaccacttcggcccataaccttgcggcgactgtctgaagaacttcccgtggtttcattcttttcttcgggtttagtcttagctgtgacattttaaccaaaagattacacgttaattaacgaggtattaaagggaaagatctcagctgaaagaaatgactgtaggaagtgtgtcagggaagccaacggaaccgccggcccgccggcggtgcgcccggcattaggaacgtctctactcccctacgatcgctgaggtatcggacagtcagtgcccgttgccaacgcagagggaacgggccgagactgcgggcaacaagtggcagagccggcgtgagtccggtgggtctgatcccagagcctcaggttgacgccacttccttggcacgggacagcgtttactgaatctt

SEQ ID NO: 107850 - DNA, 137 bp, Homo sapiens; identical to SEQ ID NO: 75065
  misc_feature 1..137: note = chr12:64783185-64783322
  misc_feature 1..137: note = Hypo
  source 1..137: mol_type = genomic DNA

SEQ ID NO: 107851 - DNA, 17 bp, Homo sapiens
  misc_feature 1..17: note = chr12:64783562-64783579
  misc_feature 1..17: note = Hypo
  source 1..17: mol_type = genomic DNA
cacggcacccggcctta

SEQ ID NO: 107852 - DNA, 608 bp, Homo sapiens
  misc_feature 1..608: note = chr12:64784092-64784700
  misc_feature 1..608: note = Hyper
  source 1..608: mol_type = genomic DNA
ccaggtcaatggccacgacgtcccgcagagccactacccgccggatggacttgggcgggttctcggttaggtagacgagccggtcgcttagcaccacatacttgaggatgtggttctcagagttggacaccacgatgcatggctcgtaggcgcggaccgcgtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccagccctgtccagcctctcgatctttgtcctaacctcagacggcgatgggcggggcaagacgctggtccttcaggcccgagttgatgggcacctcgggctcatcaccgtgaagtcccctgcggccgaagggcggtggatttttagggtctctcccgcccacccctaatg

SEQ ID NO: 107853 - DNA, 30 bp, Homo sapiens; identical to SEQ ID NO: 75068
  misc_feature 1..30: note = chr12:64797450-64797480
  misc_feature 1..30: note = Hypo
  source 1..30: mol_type = genomic DNA

SEQ ID NO: 107854 - DNA, 20 bp, Homo sapiens
  misc_feature 1..20: note = chr12:64799707-64799727
  misc_feature 1..20: note = Hypo
  source 1..20: mol_type = genomic DNA
ttgatcgtccaaatgccttc

SEQ ID NO: 107855 - DNA, 24 bp, Homo sapiens
  misc_feature 1..24: note = chr12:65152388-65152412
  misc_feature 1..24: note = Hypo
  source 1..24: mol_type = genomic DNA
caccgcgcccggcccaggcttatt

SEQ ID NO: 107856 - DNA, 1890 bp, Homo sapiens
  misc_feature 1..1890: note = chr12:65218003-65219893
  misc_feature 1..1890: note = Hyper
  source 1..1890: mol_type = genomic DNA
ttccttcattttctccgcgcctctctaatctgccaggaaataattcaacgcaattcgggctgaagcgtgtgcctcgccgcctgcggttgggtcatggccccttctgagactgctcggaagtgggagaggatgcttgcccttacgggtgttctgcccctgagactggcgccccttggtgctccctctgttccctcccagatcttgggagaagcacggacatctctgtttctgcttttggtccccgaacgcagttacgcgcccactggctccctgtctctggcgcttctgggcacgggggagctggggcggccccgcctgcgcacggcggtgccgggattgggggcgggcacgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggtgaggaccccagggctgcagatggggcgctgtaaagtagcgccggggctgcccgcgcttctgccttagcctgactccgtctaggccggggagctctggggaaagtccgcgtgccacctggtgcggggcaccgcgttggcacctgcagggagcgattggtctggaagggtagagggcagacgggggcctgggtggggcagcggccaccccaggcgcggagaacccgctgcttccaccctctccccgcggacccccaccctgcggcctgtgtgctcggctttctccgcgtggcggggaagtgcgggtggctgcccgggccctcagaggccgcaccacctattgtgttccaggctcgcaggaagccagaccttgcgagaggtgtgtgggggcggagagtggcacaggtttgacactgcaggtcggaggaggaagacagtggctgcaaaggcaaaatcgggtgttattttcccaagagtcccttcagcgtgagtgccggggtcagctcgaactggagcctgtaatttgtgagtgcgagtggggagcagcaggagatccttttcataggtgaggtccaggaacgagcctggtcgtgctaggcaaggcccttcccactgtcagcctgtgtttacccatccctgcttctccagactgcataactccgtgtcggctccatcacccggcatccctccccgggattttaagagcctggccctagcgcgggctcctgggcacggaggtttctggcaaggagtggctgcagagggagttggctgtactctcactggtgcttggcgctcacctgttccctggagtggcaccggctgcgttccaggcgggttcacggtccccggcccccgccccccagcgccagcgccttggggacctgctgtagagccgcaggagaatcgagctgcagagtcccaaagggtgggatgcggcactgcctttcccaacctcgtggtttctttgttgttctcccctaggaagtgtctagttgcagaggctgtagtatttattcaccatcttcctttacctcttttttttttcttttaaatctccttcccacgttaaaagtaagtg

SEQ ID NO: 107857 - DNA, 327 bp, Homo sapiens; identical to SEQ ID NO: 3911
  misc_feature 1..327: note = chr12:65220112-65220439
  misc_feature 1..327: note = Hyper
  source 1..327: mol_type = genomic DNA

SEQ ID NO: 107858 - DNA, 761 bp, Homo sapiens; identical to SEQ ID NO: 75078
  misc_feature 1..761: note = chr12:65514835-65515596
  misc_feature 1..761: note = Hyper
  source 1..761: mol_type = genomic DNA

SEQ ID NO: 107859 - DNA, 209 bp, Homo sapiens; identical to SEQ ID NO: 75079
  misc_feature 1..209: note = chr12:65516338-65516547
  misc_feature 1..209: note = Hypo
  source 1..209: mol_type = genomic DNA

SEQ ID NO: 107860 - DNA, 29 bp, Homo sapiens
  misc_feature 1..29: note = chr12:65530856-65530885
  misc_feature 1..29: note = Hypo
  source 1..29: mol_type = genomic DNA
ctagaaaaggccaggcgtggtggcctttt

SEQ ID NO: 107861 - DNA, 22 bp, Homo sapiens
  misc_feature 1..22: note = chr12:65557212-65557234
  misc_feature 1..22: note = Hypo
  source 1..22: mol_type = genomic DNA
gagaagtgatagcatcggccgg

SEQ ID NO: 107862 - DNA, 23 bp, Homo sapiens
  misc_feature 1..23: note = chr12:65562063-65562086
  misc_feature 1..23: note = Hypo
  source 1..23: mol_type = genomic DNA
ttgactaacgtttttctgtacag

SEQ ID NO: 107863 - DNA, 99 bp, Homo sapiens; identical to SEQ ID NO: 75083
  misc_feature 1..99: note = chr12:65672426-65672525
  misc_feature 1..99: note = Hyper
  source 1..99: mol_type = genomic DNA

SEQ ID NO: 107864 - DNA, 524 bp, Homo sapiens; identical to SEQ ID NO: 75084
  misc_feature 1..524: note = chr12:65672776-65673300
  misc_feature 1..524: note = Hyper
  source 1..524: mol_type = genomic DNA

SEQ ID NO: 107865 - DNA, 30 bp, Homo sapiens; identical to SEQ ID NO: 43493
  misc_feature 1..30: note = chr12:65787081-65787111
  misc_feature 1..30: note = Hypo
  source 1..30: mol_type = genomic DNA

SEQ ID NO: 107866 - DNA, 151 bp, Homo sapiens; identical to SEQ ID NO: 11310
  misc_feature 1..151: note = chr12:66122419-66122570
  misc_feature 1..151: note = Hyper
  source 1..151: mol_type = genomic DNA

SEQ ID NO: 107867 - DNA, 793 bp, Homo sapiens
  misc_feature 1..793: note = chr12:66122773-66123566
  misc_feature 1..793: note = Hyper
  source 1..793: mol_type = genomic DNA
ccaatctcccttcctcgagaggtgtctgggcgcaatactctccggcccgaagcaaggggacgtttgcgaggagggagaaatttaaacccccttcgctccgcgccacctgggagcactttggcgccgcagactcaggagccgacgccatctccaggacggcctcggtggcctcggcaggaggcaccttcggggagcggtcccgcactcctccttcctcagtccccggtcctctgcaccgctccctctctgctgccagaggacctgtccgcgagctccccgcgctgccctggggacggaaaagtttgtttctccaacgcgcaactttcccgctccaggcggcggggaccccgagccggagttttggccaaaaaatcccagagtcctatacctcctgcgcgcccagacctcgggggcgaagggcggctcccccggcgcgccccgatccccgccgcaaagaggacttggtggactagaggtgcaccccgcgggcagcccttggcgccccgctctgcgcccgccggcatgaggactcgtgcgtggcgtttcgaccctccgcctgaactgagactgggtggggaaaggggcagactgctgtctgtgactctgcgggaggtggagcacgaaacacaaaagctgtttgaaccacaaacgccaggctggacacccaacgaatattaatgacctgcagcctccacccacccgcaaacataatattatgtgtacgtgcttaccggttagcttaacagacttgccatcataaattcctttttcactgcagcgccactagatttgt

SEQ ID NO: 107868 - DNA, 22 bp, Homo sapiens
  misc_feature 1..22: note = chr12:66133735-66133757
  misc_feature 1..22: note = Hypo
  source 1..22: mol_type = genomic DNA
aaagatgttcttggccgggcac

SEQ ID NO: 107869 - DNA, 1179 bp, Homo sapiens; identical to SEQ ID NO: 75090
  misc_feature 1..1179: note = chr12:66135064-66136243
  misc_feature 1..1179: note = Hyper
  source 1..1179: mol_type = genomic DNA

SEQ ID NO: 107870 - DNA, 30 bp, Homo sapiens; identical to SEQ ID NO: 75091
  misc_feature 1..30: note = chr12:66188703-66188733
  misc_feature 1..30: note = Hypo
  source 1..30: mol_type = genomic DNA

SEQ ID NO: 107871 - DNA, 33 bp, Homo sapiens; identical to SEQ ID NO: 75092
  misc_feature 1..33: note = chr12:66208320-66208353
  misc_feature 1..33: note = Hypo
  source 1..33: mol_type = genomic DNA

SEQ ID NO: 107872 - DNA, 30 bp, Homo sapiens; identical to SEQ ID NO: 43495
  misc_feature 1..30: note = chr12:66211140-66211170
  misc_feature 1..30: note = Hypo
  source 1..30: mol_type = genomic DNA

SEQ ID NO: 107873 - DNA, 60 bp, Homo sapiens; identical to SEQ ID NO: 75094
  misc_feature 1..60: note = chr12:66216864-66216924
  misc_feature 1..60: note = Hyper
  source 1..60: mol_type = genomic DNA

SEQ ID NO: 107874 - DNA, 148 bp, Homo sapiens; identical to SEQ ID NO: 75095
  misc_feature 1..148: note = chr12:66217502-66217650
  misc_feature 1..148: note = Hyper
  source 1..148: mol_type = genomic DNA

SEQ ID NO: 107875 - DNA, 33 bp, Homo sapiens; identical to SEQ ID NO: 75096
  misc_feature 1..33: note = chr12:66217887-66217920
  misc_feature 1..33: note = Hyper
  source 1..33: mol_type = genomic DNA

SEQ ID NO: 107876 - DNA, 544 bp, Homo sapiens; identical to SEQ ID NO: 75097
  misc_feature 1..544: note = chr12:66218783-66219327
  misc_feature 1..544: note = Hyper
  source 1..544: mol_type = genomic DNA

SEQ ID NO: 107877 - DNA, 506 bp, Homo sapiens; identical to SEQ ID NO: 75098
  misc_feature 1..506: note = chr12:66219688-66220194
  misc_feature 1..506: note = Hyper
  source 1..506: mol_type = genomic DNA

SEQ ID NO: 107878 - DNA, 22 bp, Homo sapiens
  misc_feature 1..22: note = chr12:66242342-66242364
  misc_feature 1..22: note = Hypo
  source 1..22: mol_type = genomic DNA
ttaaaagtttaaggccgggtgc

SEQ ID NO: 107879 - DNA, 28 bp, Homo sapiens
  misc_feature 1..28: note = chr12:66255902-66255930
  misc_feature 1..28: note = Hypo
  source 1..28: mol_type = genomic DNA
gtgtgagccaccacgcctggctgtgcaa

SEQ ID NO: 107880 - DNA, 76 bp, Homo sapiens; identical to SEQ ID NO: 75102
  misc_feature 1..76: note = chr12:66282638-66282714
  misc_feature 1..76: note = Hypo
  source 1..76: mol_type = genomic DNA

SEQ ID NO: 107881 - DNA, 30 bp, Homo sapiens; identical to SEQ ID NO: 75103
  misc_feature 1..30: note = chr12:66317501-66317531
  misc_feature 1..30: note = Hypo
  source 1..30: mol_type = genomic DNA

SEQ ID NO: 107882 - DNA, 22 bp, Homo sapiens
  misc_feature 1..22: note = chr12:66340919-66340941
  misc_feature 1..22: note = Hypo
  source 1..22: mol_type = genomic DNA
ggcagagtcttgctccgtcacc

SEQ ID NO: 107883 - DNA, 22 bp, Homo sapiens
  misc_feature 1..22: note = chr12:66341181-66341203
  misc_feature 1..22: note = Hypo
  source 1..22: mol_type = genomic DNA
acagtttcgttttaacatctgt

SEQ ID NO: 107884 - DNA, 30 bp, Homo sapiens; identical to SEQ ID NO: 75106
  misc_feature 1..30: note = chr12:66343834-66343864
  misc_feature 1..30: note = Hypo
  source 1..30: mol_type = genomic DNA

SEQ ID NO: 107885 - DNA, 37 bp, Homo sapiens; identical to SEQ ID NO: 75107
  misc_feature 1..37: note = chr12:66523437-66523474
  misc_feature 1..37: note = Hypo
  source 1..37: mol_type = genomic DNA

SEQ ID NO: 107886 - DNA, 724 bp, Homo sapiens
  misc_feature 1..724: note = chr12:66582721-66583445
  misc_feature 1..724: note = Hyper
  source 1..724: mol_type = genomic DNA
cctagccgtggggcacggtgggctcctgggagctctgagctctgggctttctccagttcgcactctgcttgtctcggcagctccgtccccaccgcagaggtgtgaaggggcgcaaagccagcgaagggagaacccgggtcgggtaacccccaggcctggccaggcggacgcaggggcatctcgggcgaggcgcgccttgcgtcacgtgggcaccgcccctgcagtgaccggagaacggcgtgttcctagggctctgctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagttcccgccagggagccggccccctcctttcctgggttggatgcagagactccctgggacccagatgccttccctcccttctctttcaaagaattttgggtatcgctgcaaagtcaag

SEQ ID NO: 107887 - DNA, 427 bp, Homo sapiens; identical to SEQ ID NO: 75111
  misc_feature 1..427: note = chr12:66628990-66629417
  misc_feature 1..427: note = Hyper
  source 1..427: mol_type = genomic DNA

SEQ ID NO: 107888 - DNA, 78 bp, Homo sapiens; identical to SEQ ID NO: 75120
  misc_feature 1..78: note = chr12:68759053-68759131
  misc_feature 1..78: note = Hyper
  source 1..78: mol_type = genomic DNA

SEQ ID NO: 107889 - DNA, 78 bp, Homo sapiens; identical to SEQ ID NO: 75121
  misc_feature 1..78: note = chr12:68978219-68978297
  misc_feature 1..78: note = Hypo
  source 1..78: mol_type = genomic DNA

SEQ ID NO: 107890 - DNA, 78 bp, Homo sapiens; identical to SEQ ID NO: 75122
  misc_feature 1..78: note = chr12:68978597-68978675
  misc_feature 1..78: note = Hypo
  source 1..78: mol_type = genomic DNA

SEQ ID NO: 107891 - DNA, 30 bp, Homo sapiens; identical to SEQ ID NO: 75123
  misc_feature 1..30: note = chr12:69128689-69128719
  misc_feature 1..30: note = Hypo
  source 1..30: mol_type = genomic DNA

SEQ ID NO: 107892 - DNA, 39 bp, Homo sapiens; identical to SEQ ID NO: 75124
  misc_feature 1..39: note = chr12:69203803-69203842
  misc_feature 1..39: note = Hypo
  source 1..39: mol_type = genomic DNA

SEQ ID NO: 107893 - DNA, 95 bp, Homo sapiens; identical to SEQ ID NO: 75125
  misc_feature 1..95: note = chr12:69225853-69225948
  misc_feature 1..95: note = Hypo
  source 1..95: mol_type = genomic DNA

SEQ ID NO: 107894 - DNA, 30 bp, Homo sapiens; identical to SEQ ID NO: 75126
  misc_feature 1..30: note = chr12:69326349-69326379
  misc_feature 1..30: note = Hyper
  source 1..30: mol_type = genomic DNA

SEQ ID NO: 107895 - DNA, 868 bp, Homo sapiens; identical to SEQ ID NO: 75127
  misc_feature 1..868: note = chr12:69326653-69327521
  misc_feature 1..868: note = Hyper
  source 1..868: mol_type = genomic DNA

SEQ ID NO: 107896 - DNA, 46 bp, Homo sapiens; identical to SEQ ID NO: 75128
  misc_feature 1..46: note = chr12:69551179-69551225
  misc_feature 1..46: note = Hyper
  source 1..46: mol_type = genomic DNA

SEQ ID NO: 107897 - DNA, 22 bp, Homo sapiens
  misc_feature 1..22: note = chr12:69751028-69751050
  misc_feature 1..22: note = Hypo
  source 1..22: mol_type = genomic DNA
tttttgtttttgagacggagtc

SEQ ID NO: 107898 - DNA, 102 bp, Homo sapiens; identical to SEQ ID NO: 75130
  misc_feature 1..102: note = chr12:69754377-69754479
  misc_feature 1..102: note = Hypo
  source 1..102: mol_type = genomic DNA

SEQ ID NO: 107899 - DNA, 120 bp, Homo sapiens; identical to SEQ ID NO: 75131
  misc_feature 1..120: note = chr12:69754599-69754719
  misc_feature 1..120: note = Hypo
  source 1..120: mol_type = genomic DNA

SEQ ID NO: 107900 - DNA, 30 bp, Homo sapiens; identical to SEQ ID NO: 75132
  misc_feature 1..30: note = chr12:69799375-69799405
  misc_feature 1..30: note = Hypo
  source 1..30: mol_type = genomic DNA

SEQ ID NO: 107901 - DNA, 30 bp, Homo sapiens; identical to SEQ ID NO: 75133
  misc_feature 1..30: note = chr12:69810460-69810490
  misc_feature 1..30: note = Hypo
  source 1..30: mol_type = genomic DNA

SEQ ID NO: 107902 - DNA, 239 bp, Homo sapiens; identical to SEQ ID NO: 75134
  misc_feature 1..239: note = chr12:69964051-69964290
  misc_feature 1..239: note = Hypo
  source 1..239: mol_type = genomic DNA

SEQ ID NO: 107903 - DNA, 43 bp, Homo sapiens; identical to SEQ ID NO: 75135
  misc_feature 1..43: note = chr12:69999350-69999393
  misc_feature 1..43: note = Hypo
  source 1..43: mol_type = genomic DNA

SEQ ID NO: 107904 - DNA, 30 bp, Homo sapiens; identical to SEQ ID NO: 43504
  misc_feature 1..30: note = chr12:70024017-70024047
  misc_feature 1..30: note = Hypo
  source 1..30: mol_type = genomic DNA

SEQ ID NO: 107905 - DNA, 22 bp, Homo sapiens
  misc_feature 1..22: note = chr12:70030627-70030649
  misc_feature 1..22: note = Hypo
  source 1..22: mol_type = genomic DNA
ccgcgcccggccccctcagact

SEQ ID NO: 107906 - DNA, 254 bp, Homo sapiens; identical to SEQ ID NO: 43505
  misc_feature 1..254: note = chr12:70087493-70087747
  misc_feature 1..254: note = Hypo
  source 1..254: mol_type = genomic DNA

SEQ ID NO: 107907 - DNA, 41 bp, Homo sapiens; identical to SEQ ID NO: 75139
  misc_feature 1..41: note = chr12:70173234-70173275
  misc_feature 1..41: note = Hypo
  source 1..41: mol_type = genomic DNA

SEQ ID NO: 107908 - DNA, 16 bp, Homo sapiens
  misc_feature 1..16: note = chr12:70651436-70651452
  misc_feature 1..16: note = Hypo
  source 1..16: mol_type = genomic DNA
gcgcccggccccaact

SEQ ID NO: 107909 - DNA, 173 bp, Homo sapiens; identical to SEQ ID NO: 75141
  misc_feature 1..173: note = chr12:70760956-70761129
  misc_feature 1..173: note = Hyper
  source 1..173: mol_type = genomic DNA

SEQ ID NO: 107910 - DNA, 87 bp, Homo sapiens; identical to SEQ ID NO: 75143
  misc_feature 1..87: note = chr12:70931093-70931180
  misc_feature 1..87: note = Hypo
  source 1..87: mol_type = genomic DNA

SEQ ID NO: 107911 - DNA, 568 bp, Homo sapiens; identical to SEQ ID NO: 75144
  misc_feature 1..568: note = chr12:71003477-71004045
  misc_feature 1..568: note = Hyper
  source 1..568: mol_type = genomic DNA

SEQ ID NO: 107912 - DNA, 308 bp, Homo sapiens
  misc_feature 1..308: note = chr12:71314368-71314676
  misc_feature 1..308: note = Hyper
  source 1..308: mol_type = genomic DNA
agcagtaggaggttgcgggtaaggggaacagaagcgctcagaggcggcaaatgcctggccttctggacgcccagaagccaaggcggagacggcagggtggactccgcgccagcccagcagcccagcagcagcgccgcggctactgagcatgcccagcgccggccctcacgaggcaagggaatttcaaagtgaaattccgcttctccgggtcttagcggcggcttggagcagagtaggctccatcgctggggtggtggttgggggtgggggtgggggtggggaagggggaagtgcgggggagacacttg

SEQ ID NO: 107913 - DNA, 171 bp, Homo sapiens; identical to SEQ ID NO: 75147
  misc_feature 1..171: note = chr12:71403294-71403465
  misc_feature 1..171: note = Hyper
  source 1..171: mol_type = genomic DNA

SEQ ID NO: 107914 - DNA, 137 bp, Homo sapiens; identical to SEQ ID NO: 43507
  misc_feature 1..137: note = chr12:71626492-71626629
  misc_feature 1..137: note = Hypo
  source 1..137: mol_type = genomic DNA

SEQ ID NO: 107915 - DNA, 30 bp, Homo sapiens; identical to SEQ ID NO: 34516
  misc_feature 1..30: note = chr12:71832897-71832927
  misc_feature 1..30: note = Hyper
  source 1..30: mol_type = genomic DNA

SEQ ID NO: 107916 - DNA, 617 bp, Homo sapiens; identical to SEQ ID NO: 75150
  misc_feature 1..617: note = chr12:71833313-71833930
  misc_feature 1..617: note = Hyper
  source 1..617: mol_type = genomic DNA

SEQ ID NO: 107917 - DNA, 152 bp, Homo sapiens; identical to SEQ ID NO: 75151
  misc_feature 1..152: note = chr12:71834137-71834289
  misc_feature 1..152: note = Hyper
  source 1..152: mol_type = genomic DNA

SEQ ID NO: 107918 - DNA, 301 bp, Homo sapiens; identical to SEQ ID NO: 75152
  misc_feature 1..301: note = chr12:71834789-71835090
  misc_feature 1..301: note = Hyper
  source 1..301: mol_type = genomic DNA

SEQ ID NO: 107919 - DNA, 37 bp, Homo sapiens; identical to SEQ ID NO: 43508
  misc_feature 1..37: note = chr12:72054795-72054832
  misc_feature 1..37: note = Hypo
  source 1..37: mol_type = genomic DNA

SEQ ID NO: 107920 - DNA, 18 bp, Homo sapiens
  misc_feature 1..18: note = chr12:72077594-72077612
  misc_feature 1..18: note = Hypo
  source 1..18: mol_type = genomic DNA
gatatgctagataaacgg

SEQ ID NO: 107921 - DNA, 30 bp, Homo sapiens; identical to SEQ ID NO: 75155
  misc_feature 1..30: note = chr12:72165406-72165436
  misc_feature 1..30: note = Hypo
  source 1..30: mol_type = genomic DNA

SEQ ID NO: 107922 - DNA, 30 bp, Homo sapiens; identical to SEQ ID NO: 75156
  misc_feature 1..30: note = chr12:72232195-72232225
  misc_feature 1..30: note = Hypo
  source 1..30: mol_type = genomic DNA

SEQ ID NO: 107923 - DNA, 55 bp, Homo sapiens; identical to SEQ ID NO: 34519
  misc_feature 1..55: note = chr12:72332641-72332696
  misc_feature 1..55: note = Hyper
  source 1..55: mol_type = genomic DNA

SEQ ID NO: 107924 - DNA, 87 bp, Homo sapiens; identical to SEQ ID NO: 75159
  misc_feature 1..87: note = chr12:72634614-72634701
  misc_feature 1..87: note = Hypo
  source 1..87: mol_type = genomic DNA

SEQ ID NO: 107925 - DNA, 160 bp, Homo sapiens; identical to SEQ ID NO: 34520
  misc_feature 1..160: note = chr12:72665266-72665426
  misc_feature 1..160: note = Hyper
  source 1..160: mol_type = genomic DNA

SEQ ID NO: 107926 - DNA, 797 bp, Homo sapiens
  misc_feature 1..797: note = chr12:72665668-72666465
  misc_feature 1..797: note = Hyper
  source 1..797: mol_type = genomic DNA
ggaatgagggagtctcgctgtcgggtctgcaacctcctgccgtttgccgccaccgccgcttaaagtgcccagggtggagaaggcttttccaggacggatctccgtcgtagcttcgcggccctgggacttcctcctgctggttcactctagtctctcccacctcggccatccttttctctccagctgcagggtgtatggctcgggtgcctcccgtgctgtggccgccgtcactgctgctgcgagcacattccacccagaggaccgaacgccgccgctggagtggggggagaaagcgaaagccctaacttccctctctacaccctcgctcttcccaccgctcccgtccttctccctagccgagaaccggttggaaggctcccgcggaaagcgaggcgagagcgcggcgcaggggagggagagccgggagccgcaggcgcgcaggggcgggggcagcatgtgccccgccgccgggtgctcgtccgagaagtagcgcgcgctgggcaagcaagacgctttccaagttgggcgcgtcccagagctcacagcccggtgtccagagtgaggcggggctgatgggggtcgcggaagctgccgtcgcttgtgtccagaacccgtcttaaaagaacccgggccagcatccccagtcgcgcgccctcggcccgcgtgagctctccgatgcctgctctggctgtggcccgggtggcccgcccgcggggggtgccagagggggcgggggaggaggaggaggcggtgtgatggccctggacggcgagctgggggagcaagaggaggagaag

SEQ ID NO: 107927 - DNA, 1157 bp, Homo sapiens
  misc_feature 1..1157: note = chr12:72666525-72667682
  misc_feature 1..1157: note = Hyper
  source 1..1157: mol_type = genomic DNA
gccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaaggtatggagggaggcggtgccccgcgctgccccaccccggcgcgcggctcgaacctctgggcggcctgcgaccccggggacccagctggcttccaatacccgggaagccaggggtggggggaaggaaacgaaagcggagtagggcagtcagaactccggggtctcccagatgcctcggggtctcgctgccgccaacttcgcaaactgactcaccggtgccaaaagatgaatgctgccccctcctctagtcgggacctctcctcttcctgtcagagttccttagccatcgaaacgcagggctctttttctgaagggtagctgataatctgagcgatgccagagtgac

SEQ ID NO: 107928 - DNA, 23 bp, Homo sapiens
  misc_feature 1..23: note = chr12:73732465-73732488
  misc_feature 1..23: note = Hypo
  source 1..23: mol_type = genomic DNA
actgcgcccggccatttactggt

SEQ ID NO: 107929 - DNA, 30 bp, Homo sapiens; identical to SEQ ID NO: 43512
  misc_feature 1..30: note = chr12:74092079-74092109
  misc_feature 1..30: note = Hypo
  source 1..30: mol_type = genomic DNA

SEQ ID NO: 107930 - DNA, 36 bp, Homo sapiens; identical to SEQ ID NO: 75170
  misc_feature 1..36: note = chr12:74930406-74930442
  misc_feature 1..36: note = Hypo
  source 1..36: mol_type = genomic DNA

SEQ ID NO: 107931 - DNA, 30 bp, Homo sapiens; identical to SEQ ID NO: 75172
  misc_feature 1..30: note = chr12:75518961-75518991
  misc_feature 1..30: note = Hypo
  source 1..30: mol_type = genomic DNA

SEQ ID NO: 107932 - DNA, 885 bp, Homo sapiens
  misc_feature 1..885: note = chr12:75601171-75602056
  misc_feature 1..885: note = Hyper
  source 1..885: mol_type = genomic DNA
gccccgccgcgtcctcgatgcccagcctcttggccgccaggtcctcgtcgtcgccggggtcgccgccaatgaggtcgggggtctcgaagatgtccagcgcctcctcggcgtcgcggtgctgccggtaggtcatccagcagcagggctccacgtcggtctcgtcgatgccccagaaggccagctcctcctcgaagagcggcccgcacacgtctgcggggcagtgcagcttgccggtgcggtagtaattgagcacataggcgaagacgcccgggtgccggtcgaagaagaactcgcggccgccaccgggatggtcgctggccctgccgccgcgggaactgcagttgcccgcgccgccctcgaagcagccgcctggcccgggggacagcgggggcgctctcggcggcggcgacagtggaggcggcgacggctgcagcttgtcgcccgccgtggtcaagcagtcgcctgggggctcggaggaggcaagaagggccaggcgtgttccaggcagggtcttgagggtgctgcggtaggtttcgtgccgggtgcccccgacattgaggatcaccctctcgttgttctcgatcttgcccatctctgtgactcagacatgactagggggaggcaaacacagcgccgagttaaagatcttagccgtcaaagacacaccatgacccccaccaccaacccagagcgagtccagggatgcagagttggcagacaggcacggggcaaagaccctccccgggaggggatcagcgtccagcgctgtccccgcctcttgcatcaaacctttcccaggtttccagagaactacagagatagcagtcctagtctttcttgacctttcatgacaccgttttccctgcctcccgctttcctttcttt

SEQ ID NO: 107933 - DNA, 619 bp, Homo sapiens; identical to SEQ ID NO: 34530
  misc_feature 1..619: note = chr12:75602875-75603494
  misc_feature 1..619: note = Hyper
  source 1..619: mol_type = genomic DNA

SEQ ID NO: 107934 - DNA, 426 bp, Homo sapiens; identical to SEQ ID NO: 75178
  misc_feature 1..426: note = chr12:75728077-75728503
  misc_feature 1..426: note = Hyper
  source 1..426: mol_type = genomic DNA

SEQ ID NO: 107935 - DNA, 60 bp, Homo sapiens; identical to SEQ ID NO: 75179
  misc_feature 1..60: note = chr12:76742449-76742509
  misc_feature 1..60: note = Hyper
  source 1..60: mol_type = genomic DNA

SEQ ID NO: 107936 - DNA, 53 bp, Homo sapiens; identical to SEQ ID NO: 75180
  misc_feature 1..53: note = chr12:76807087-76807140
  misc_feature 1..53: note = Hypo
  source 1..53: mol_type = genomic DNA

SEQ ID NO: 107937 - DNA, 29 bp, Homo sapiens
  misc_feature 1..29: note = chr12:76848726-76848755
  misc_feature 1..29: note = Hypo
  source 1..29: mol_type = genomic DNA
agcagaggccgggcgcggtggctcaagcc

SEQ ID NO: 107938 - DNA, 94 bp, Homo sapiens; identical to SEQ ID NO: 75182
  misc_feature 1..94: note = chr12:77085821-77085915
  misc_feature 1..94: note = Hypo
  source 1..94: mol_type = genomic DNA

SEQ ID NO: 107939 - DNA, 30 bp, Homo sapiens; identical to SEQ ID NO: 15677
  misc_feature 1..30: note = chr12:77150018-77150048
  misc_feature 1..30: note = Hypo
  source 1..30: mol_type = genomic DNA

SEQ ID NO: 107940 - DNA, 36 bp, Homo sapiens; identical to SEQ ID NO: 75184
  misc_feature 1..36: note = chr12:77436981-77437017
  misc_feature 1..36: note = Hypo
  source 1..36: mol_type = genomic DNA

SEQ ID NO: 107941 - DNA, 36 bp, Homo sapiens; identical to SEQ ID NO: 75186
  misc_feature 1..36: note = chr12:77718450-77718486
  misc_feature 1..36: note = Hyper
  source 1..36: mol_type = genomic DNA

SEQ ID NO: 107942 - DNA, 342 bp, Homo sapiens; identical to SEQ ID NO: 75187
  misc_feature 1..342: note = chr12:77719271-77719613
  misc_feature 1..342: note = Hyper
  source 1..342: mol_type = genomic DNA

SEQ ID NO: 107943 - DNA, 34 bp, Homo sapiens; identical to SEQ ID NO: 75194
  misc_feature 1..34: note = chr12:79198065-79198099
  misc_feature 1..34: note = Hypo
  source 1..34: mol_type = genomic DNA

SEQ ID NO: 107944 - DNA, 288 bp, Homo sapiens; identical to SEQ ID NO: 75196
  misc_feature 1..288: note = chr12:79257222-79257510
  misc_feature 1..288: note = Hyper
  source 1..288: mol_type = genomic DNA

SEQ ID NO: 107945 - DNA, 383 bp, Homo sapiens; identical to SEQ ID NO: 75197
  misc_feature 1..383: note = chr12:79257714-79258097
  misc_feature 1..383: note = Hyper
  source 1..383: mol_type = genomic DNA

SEQ ID NO: 107946 - DNA, 802 bp, Homo sapiens
  misc_feature 1..802: note = chr12:79258297-79259099
  misc_feature 1..802: note = Hyper
  source 1..802: mol_type = genomic DNA
aacccgcctccaccccgcttcccaggtccctgtccgctgtggggatggagagacactaacagaactgggatgggcgatgttggctgaacggatccacctattattagtgcgcggggattggctccttggcgcagcgtacccgaggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccaggtaaggaagcgggactggcggcgcggccacctcggcggtgcctatctgctcgaatccatcccaaagattttcttctcgatacacttgggttttagtggtgggagtctgagacctagggagggatccccgggtggcctattgtgagaaatatgagactacatgtgcatctcctggaaaagcactttgcacagcgcccgtgatttagagcct

SEQ ID NO: 107947 - DNA, 30 bp, Homo sapiens; identical to SEQ ID NO: 43516
  misc_feature 1..30: note = chr12:79842607-79842637
  misc_feature 1..30: note = Hypo
  source 1..30: mol_type = genomic DNA

SEQ ID NO: 107948 - DNA, 96 bp, Homo sapiens; identical to SEQ ID NO: 43517
  misc_feature 1..96: note = chr12:80488160-80488256
  misc_feature 1..96: note = Hypo
  source 1..96: mol_type = genomic DNA

SEQ ID NO: 107949 - DNA, 348 bp, Homo sapiens
  misc_feature 1..348: note = chr12:81102159-81102507
  misc_feature 1..348: note = Hyper
  source 1..348: mol_type = genomic DNA
gtgacccaagaagaccgggtgcttgcaataggcaggaaatgcgtacccggcccgaggaagcaggaaagccgccccccaccccaccccaaccccggaaccgatgtttctttcctaatctgccgctgccttggttttccctccagcttgagggtgcggatttcctgcgcacctgcagctcccagtggccaagtgtttccgatcattccagggggctcgtgataacggctaaggaaggtaaagtaaaagggctctgggccgcaccagagaaaatccgggaggtggataggatgcttgggccgagagggctcgaagcgagagcagggacgcgccctgcgaaaagggcgctct

SEQ ID NO: 107950 - DNA, 30 bp, Homo sapiens
  misc_feature 1..30: note = chr12:81107995-81108025
  misc_feature 1..30: note = Hyper
  source 1..30: mol_type = genomic DNA
gcgcttgtgttttctcggcttctttagttc

SEQ ID NO: 107951 - DNA, 134 bp, Homo sapiens; identical to SEQ ID NO: 75225
  misc_feature 1..134: note = chr12:81330218-81330352
  misc_feature 1..134: note = Hyper
  source 1..134: mol_type = genomic DNA

SEQ ID NO: 107952 - DNA, 582 bp, Homo sapiens; identical to SEQ ID NO: 75226
  misc_feature 1..582: note = chr12:81330737-81331319
  misc_feature 1..582: note = Hyper
  source 1..582: mol_type = genomic DNA

SEQ ID NO: 107953 - DNA, 246 bp, Homo sapiens; identical to SEQ ID NO: 75227
  misc_feature 1..246: note = chr12:81331631-81331877
  misc_feature 1..246: note = Hyper
  source 1..246: mol_type = genomic DNA

SEQ ID NO: 107954 - DNA, 677 bp, Homo sapiens
  misc_feature 1..677: note = chr12:81471455-81472132
  misc_feature 1..677: note = Hyper
  source 1..677: mol_type = genomic DNA
tgccacctccaccaacgaccttccaaagattaaaccagccgtgtacaaactgctggattgaaaattgagagatgggccgttggcctcctcctaggagtacttgtgtgttgaaatcggaaggacgttctggagtttgagcgcgatttttcccggaaggctgcggggttggaagtgcatgttggggtttggatctcgtgcagcagcgcaactaacctgctgcaacggcgctgtgacacccctgtcccggggcccccactttagcctgttgcttctctggtcgctccaggtcggtttttcccggcgactctagtgtggcttccaaacttctgggctctgggctcacttcggaatttgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccggggagccggtgcggccctcagggctttagtggtcccgggcccgcggggcggtctcgggggccggggatgcagggcactgtcctccggcagtggcagcgagtacaagacccacttcgcagcctcggtgaccgaccccgagaggttctgggg

SEQ ID NO: 107955 - DNA, 37 bp, Homo sapiens; identical to SEQ ID NO: 75235
  misc_feature 1..37: note = chr12:82032738-82032775
  misc_feature 1..37: note = Hypo
  source 1..37: mol_type = genomic DNA

SEQ ID NO: 107956 - DNA, 93 bp, Homo sapiens; identical to SEQ ID NO: 75237
  misc_feature 1..93: note = chr12:82152505-82152598
  misc_feature 1..93: note = Hyper
  source 1..93: mol_type = genomic DNA

SEQ ID NO: 107957 - DNA, 486 bp, Homo sapiens
  misc_feature 1..486: note = chr12:82152992-82153478
  misc_feature 1..486: note = Hyper
  source 1..486: mol_type = genomic DNA
ccatttttctcctcccggcctttctgcaagcctctttgcttgcttcaattggccggaagaaccaacctgctggcagccggtgaggacgctacagcatcttctctcctcacttgcctcgtgcggtggctgctactcctcctcctccgtctcctcccctcctcctccttggcagccaccacctcctcttcctctggaacaagggcttcccctggaagctgctgcagtggtttccaccggcccttaaataaattctgaagtaatcacgtctttgctctcctcctcacgcacacgcgcccgcggatacactcgtctcccccagagccgctcccgggctgccgaggctcgctctgctcccagtgccccctgcgaaggcgagggccagggatgggcaaagtgggaagggggcacacgcttccccgcctgggcttctttcacacaatgggctctacagccttcgcttgtgtcagcctgcgctggtggggatgg

SEQ ID NO: 107958 - DNA, 30 bp, Homo sapiens; identical to SEQ ID NO: 75244
  misc_feature 1..30: note = chr12:84953382-84953412
  misc_feature 1..30: note = Hypo
  source 1..30: mol_type = genomic DNA

SEQ ID NO: 107959 - DNA, 191 bp, Homo sapiens; identical to SEQ ID NO: 11344
  misc_feature 1..191: note = chr12:85305054-85305245
  misc_feature 1..191: note = Hyper
  source 1..191: mol_type = genomic DNA

SEQ ID NO: 107960 - DNA, 323 bp, Homo sapiens; identical to SEQ ID NO: 75246
  misc_feature 1..323: note = chr12:85305657-85305980
  misc_feature 1..323: note = Hyper
  source 1..323: mol_type = genomic DNA

SEQ ID NO: 107961 - DNA, 331 bp, Homo sapiens
  misc_feature 1..331: note = chr12:85306234-85306565
  misc_feature 1..331: note = Hyper
  source 1..331: mol_type = genomic DNA
ctgggtggctaatggcgagccccacctcacccccagttgtgcccttagcgtaggcgcttgccattaccgtcagtgtgtcttgaccaagcgcctcttgctgcttccacgtccgggcagcagcagcagcagtcgcgaaagggtagggtccaggtggctgtgacggaggccgaagaggagctgttggcagagaagcagcttcttgcctaggttgggacccggagctgggttttgggggtcgccgccctgcaggctggcaaggagagactcgtgagcgcctgtgtgtctgccagggaaacagcacgggatacaggcgcgcgggtgcgggtgcgcg

SEQ ID NO: 107962 - DNA, 331 bp, Homo sapiens
  misc_feature 1..331: note = chr12:85306625-85306956
  misc_feature 1..331: note = Hyper
  source 1..331: mol_type = genomic DNA
gcgcccacgtgctcggcccgcccgtgttacggccgcctaccggctgcagaggagaagggtaggctgtgggcggcggcggggcgcggaggggtagccaggagcgcaggctgggctccgcacctccctgccccaaaacccattgatgcagcggccactgcggctgccgagcggcgtcttcccagagcccggggctgtgcccgcccgatgcaggatgcaactgaggaagcccgctccaaagcaaaacaaaacaaattcctccagccatgccgtctttctccaacccactcaagcgaaagaatggacaccagttaccagccgctgacttttgtct

SEQ ID NO: 107963 - DNA, 30 bp, Homo sapiens; identical to SEQ ID NO: 75251
  misc_feature 1..30: note = chr12:85430069-85430099
  misc_feature 1..30: note = Hyper
  source 1..30: mol_type = genomic DNA

SEQ ID NO: 107964 - DNA, 718 bp, Homo sapiens; identical to SEQ ID NO: 75252
  misc_feature 1..718: note = chr12:85667044-85667762
  misc_feature 1..718: note = Hyper
  source 1..718: mol_type = genomic DNA

SEQ ID NO: 107965 - DNA, 42 bp, Homo sapiens; identical to SEQ ID NO: 75253
  misc_feature 1..42: note = chr12:85671757-85671799
  misc_feature 1..42: note = Hyper
  source 1..42: mol_type = genomic DNA

SEQ ID NO: 107966 - DNA, 30 bp, Homo sapiens; identical to SEQ ID NO: 75254
  misc_feature 1..30: note = chr12:85672332-85672362
  misc_feature 1..30: note = Hyper
  source 1..30: mol_type = genomic DNA

SEQ ID NO: 107967 - DNA, 2154 bp, Homo sapiens
  misc_feature 1..2154: note = chr12:85672730-85674884
  misc_feature 1..2154: note = Hyper
  source 1..2154: mol_type = genomic DNA
cgcatttcccccaagcgccgcgggctcctaggaagccaagagtcgtgccaaaagtcacacagaagggctttcaacctagcagtgctgtcctgcctgccctaccatcccctctggtggaaatggaggccttggacctgtccgcgcccaggacgccgcgccgcgagtgcccgcagctccgcgcgctcaccactcactcccagagcgcttttcggagtaactccacagcaactctttaaaattaaaagtaatttctgtaaaaatatgcagacattcctcttcttcataaacccctatttgtaacaatcctcactttggcattagagtaaaagcctttcaaaggcactgatcctaacgggttttcttaaaataatttgggtctaatgataaaatcgtggaccaaagggaagggtggcgaagagggtgtagggaattggttggcattagtataatggcttcattgcctcttgctcggcttctctctcccacccatcgccaccgcgtccacactccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcctttcaagttcttaagacgcctctaaatctttctggtagtgagtggccggcatgggggcggggtggggacgggtggctcaggaaggcgcaggcagtagggagtggaggtttaactgctttgcgatctcaccaagatcttccgaaatgccagtccactgtcacggcggcaatgaatctgggtgtcaggggctcgtctctcctggcatttgtctgaaatggagctgtctgtctgtctatcctaggcctggacgccctctgcccgggtaagtggggaaaatgggggtggggtaggggcggagggggacctggggtggagttagtcgcccgcctattttcatattcattagaactgggaggctgcccgaggaggccagctgagtttcaagatataaaagcaacttcgggtgctccttttccagccgggacgtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcggtgagtcgctagcgccccagccggagccgccgcagcccttccgcaatcgaaaatgcaggatcggtctgatcaggcagggagggagaaaggagaaaagtgggagcgagggacctggaaggtggaggaaggtagtggaaggtgctcgctttatgaagcggtgttactgctgctgcagcctttgggggcggagggcggagggagggagagatccagcaccgggttgcctctgagcgattctcctttcgctgtagggtctggtcgcctacggatccctgagtccttctgtaatattggttcctggagtaaactgatagggcgctaaatagagcgtaattgagtcaagacagaacgcttcctctgcgagcccgccttgcagtccgggcggtaggaactgaaatcgatcacagctcgttagagtacgtcactgtcgtcacgagtagggaaaaaaaaaccggaaaacaaaaacaaaaaacaaaaaaccctttgagctcctttaggtaaagataaatctttttaattttccaagacgtggcgatatattttcaaagtttgaggatccctagatttctagcgtgtgtgaatttgtaatttctgcttttttttgcgtttgcaatacaac

SEQ ID NO: 107968 - DNA, 30 bp, Homo sapiens; identical to SEQ ID NO: 75273
  misc_feature 1..30: note = chr12:88820631-88820661
  misc_feature 1..30: note = Hypo
  source 1..30: mol_type = genomic DNA

SEQ ID NO: 107969 - DNA, 30 bp, Homo sapiens; identical to SEQ ID NO: 75274
  misc_feature 1..30: note = chr12:88861136-88861166
  misc_feature 1..30: note = Hypo
  source 1..30: mol_type = genomic DNA

SEQ ID NO: 107970 - DNA, 249 bp, Homo sapiens; identical to SEQ ID NO: 75275
  misc_feature 1..249: note = chr12:88974430-88974679
  misc_feature 1..249: note = Hyper
  source 1..249: mol_type = genomic DNA

SEQ ID NO: 107971 - DNA, 30 bp, Homo sapiens; identical to SEQ ID NO: 43518
  misc_feature 1..30: note = chr12:89794228-89794258
  misc_feature 1..30: note = Hypo
  source 1..30: mol_type = genomic DNA

SEQ ID NO: 107972 - DNA, 30 bp, Homo sapiens; identical to SEQ ID NO: 75284
  misc_feature 1..30: note = chr12:89953769-89953799
  misc_feature 1..30: note = Hypo
  source 1..30: mol_type = genomic DNA

SEQ ID NO: 107973 - DNA, 30 bp, Homo sapiens; identical to SEQ ID NO: 75286
  misc_feature 1..30: note = chr12:90025918-90025948
  misc_feature 1..30: note = Hypo
  source 1..30: mol_type = genomic DNA

SEQ ID NO: 107974 - DNA, 30 bp, Homo sapiens; identical to SEQ ID NO: 75292
  misc_feature 1..30: note = chr12:90219938-90219968
  misc_feature 1..30: note = Hypo
  source 1..30: mol_type = genomic DNA

SEQ ID NO: 107975 - DNA, 189 bp, Homo sapiens; identical to SEQ ID NO: 75294
  misc_feature 1..189: note = chr12:90313512-90313701
  misc_feature 1..189: note = Hypo
  source 1..189: mol_type = genomic DNA

SEQ ID NO: 107976 - DNA, 36 bp, Homo sapiens; identical to SEQ ID NO: 75299
  misc_feature 1..36: note = chr12:93436029-93436065
  misc_feature 1..36: note = Hypo
  source 1..36: mol_type = genomic DNA

SEQ ID NO: 107977 - DNA, 33 bp, Homo sapiens; identical to SEQ ID NO: 43520
  misc_feature 1..33: note = chr12:93711081-93711114
  misc_feature 1..33: note = Hypo
  source 1..33: mol_type = genomic DNA

SEQ ID NO: 107978 - DNA, 30 bp, Homo sapiens; identical to SEQ ID NO: 43521
  misc_feature 1..30: note = chr12:93797551-93797581
  misc_feature 1..30: note = Hypo
  source 1..30: mol_type = genomic DNA

SEQ ID NO: 107979 - DNA, 938 bp, Homo sapiens
  misc_feature 1..938: note = chr12:93966301-93967239
  misc_feature 1..938: note = Hyper
  source 1..938: mol_type = genomic DNA
agagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccagg

SEQ ID NO: 107980 - DNA, 525 bp, Homo sapiens; identical to SEQ ID NO: 75304
  misc_feature 1..525: note = chr12:93985095-93985620
  misc_feature 1..525: note = Hyper
  source 1..525: mol_type = genomic DNA

SEQ ID NO: 107981 - DNA, 30 bp, Homo sapiens; identical to SEQ ID NO: 75305
  misc_feature 1..30: note = chr12:94019213-94019243
  misc_feature 1..30: note = Hypo
  source 1..30: mol_type = genomic DNA

SEQ ID NO: 107982 - DNA, 30 bp, Homo sapiens; identical to SEQ ID NO: 75306
  misc_feature 1..30: note = chr12:94233462-94233492
  misc_feature 1..30: note = Hypo
  source 1..30: mol_type = genomic DNA

SEQ ID NO: 107983 - DNA, 201 bp, Homo sapiens; identical to SEQ ID NO: 75307
  misc_feature 1..201: note = chr12:94501597-94501798
  misc_feature 1..201: note = Hypo
  source 1..201: mol_type = genomic DNA

SEQ ID NO: 107984 - DNA, 60 bp, Homo sapiens; identical to SEQ ID NO: 75308
  misc_feature 1..60: note = chr12:94541897-94541957
  misc_feature 1..60: note = Hyper
  source 1..60: mol_type = genomic DNA

SEQ ID NO: 107985 - DNA, 904 bp, Homo sapiens
  misc_feature 1..904: note = chr12:94543088-94543992
  misc_feature 1..904: note = Hyper
  source 1..904: mol_type = genomic DNA
gggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacct

SEQ ID NO: 107986 - DNA, 30 bp, Homo sapiens; identical to SEQ ID NO: 75311
  misc_feature 1..30: note = chr12:94544301-94544331
  misc_feature 1..30: note = Hyper
  source 1..30: mol_type = genomic DNA

SEQ ID NO: 107987 - DNA, 90 bp, Homo sapiens; identical to SEQ ID NO: 75312
  misc_feature 1..90: note = chr12:94641622-94641712
  misc_feature 1..90: note = Hypo
  source 1..90: mol_type = genomic DNA

SEQ ID NO: 107988 - DNA, 30 bp, Homo sapiens; identical to SEQ ID NO: 75313
  misc_feature 1..30: note = chr12:94642514-94642544
  misc_feature 1..30: note = Hypo
  source 1..30: mol_type = genomic DNA

SEQ ID NO: 107989 - DNA, 100 bp, Homo sapiens; identical to SEQ ID NO: 75314
  misc_feature 1..100: note = chr12:94891920-94892020
  misc_feature 1..100: note = Hypo
  source 1..100: mol_type = genomic DNA

SEQ ID NO: 107990 - DNA, 83 bp, Homo sapiens; identical to SEQ ID NO: 75315
  misc_feature 1..83: note = chr12:95008472-95008555
  misc_feature 1..83: note = Hypo
  source 1..83: mol_type = genomic DNA

SEQ ID NO: 107991 - DNA, 22 bp, Homo sapiens
  misc_feature 1..22: note = chr12:95008675-95008697
  misc_feature 1..22: note = Hypo
  source 1..22: mol_type = genomic DNA
ttacagacgctgctaccactcc

SEQ ID NO: 107992 - DNA, 1183 bp, Homo sapiens
  misc_feature 1..1183: note = chr12:95266817-95268000
  misc_feature 1..1183: note = Hyper
  source 1..1183: mol_type = genomic DNA
gagggtgggggtgagcgcgggctccctggcacctgccggtaaagcagcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccgggcgcagcccacctcgcaagcgcgggcccagggctccgacgtgccagcgcagccccgaagagtgcgggcccggggtccccgcggcgccccttcccctcctcagtcccccgggggcgaccgcgctccccgccgaggtccgtccccgccgcaccctcactattcccgctgggaggaccccggcgcacgcccccgcccccgcaccccggggcgacggcgcactcaccctccgcatggtgtctgggccgtccgggcggggctcggcgacttgggcgcgagaagggctgggccggcggcgacgctcggccggccgggagctccgcgctgccccctcctgcacacgcctgcgccgcggccgccaagccggcgggggcggggcggggtagcgctggccgcggggtccccggggctctcccgggctgcggcggaggcgcggagccggccaagggcgcactgagctcgcggagctccggggccccggggcctttctgccgccgtcgcagcgtccccgcctcctcgggccgcttcgcccctctcctcttcctcgagttctggccccaccaggagcggagcgagtctccgatgcctgccccgcggcccccagaactgagctggagaagctttggggtgaaagctgggcccaccctacagggaccccaagtttgcggagcaagagtggattggcggagagcgcagatggcaattctcacccgccttaaaagtaccaccttaaaattctccccatgggatgggaaggtggcccgctaatgtccgttcctactcttcgttttctttttaatttttcagacag

SEQ ID NO: 107993 - DNA, 34 bp, Homo sapiens; identical to SEQ ID NO: 75321
  misc_feature 1..34: note = chr12:95467953-95467987
  misc_feature 1..34: note = Hypo
  source 1..34: mol_type = genomic DNA

SEQ ID NO: 107994 - DNA, 40 bp, Homo sapiens; identical to SEQ ID NO: 75322
  misc_feature 1..40: note = chr12:95826267-95826307
  misc_feature 1..40: note = Hypo
  source 1..40: mol_type = genomic DNA

SEQ ID NO: 107995 - DNA, 1149 bp, Homo sapiens
  misc_feature 1..1149: note = chr12:95941843-95942992
  misc_feature 1..1149: note = Hyper
  source 1..1149: mol_type = genomic DNA
ggcattctttcccatcgaaggccatcgggaatggctttaggaagctgattttcaagctttaagcggcagcaggtgccggcagcgcggggaccgatcgatggagagaaggcgggcaagacgccgggaagcgcattcctcctcaaccgagtgccacaaccgccctcccgaagtgccccggggcttcgagcatcacctcgcggtaatccgggagggtggagggatgcggctggacccgggcgttgcgtgctccacacagcgcccagcccgtgccagccccgcgcccacctctccacgacgctcgtgccgggatcagcgcgaagccccttccagtccccgaagccctcgcccgcgcccgttctcccccagctcgccccctccagcccgctgcgccttgccgcagcatctccgggcactctgaggctgccgccgggacagggtcggagcgccgcagaacccaccgaaacttcccaggggggcaattcaaaattcgccggacgcgtcgccgccgcgcgcccctcggctcattcccttccgcgcgcccgcagccccaggctctccctctctcaggaccccccagcgccctgcgcggcgagaataggcccccaggtgcctcccggccccgggggctgccgtcgcacgtccgctcccgcaggggtcctcactccgccaatcgccgcggccgcgcgccctcgcgcacactcaccagcccgagccggggcggccatcttagcgctcaccccggccccccgccccccggttcggcggccgcgacgacccggtgcggcggctacgacagccgtgacgcgcagcaggccccgccccctcccacagccccacccctgcgccggctcttcgcgggcaccgagaacctgccggtggccgccttccgcgcctcgtgggggggtcggggccacggacggtccccggcgccgcaagtgggtctgcgcgaacaacaagcactgcctccccgggcgggcttcgcacctgtagtgccgtcgggacacgggagggtaaacccagcgtgtcctgtgtgcctgtgagccgcagaatcatccacggacgtcgttagtccttcctggaatttctgcgatttacacaacgtcgaattgtttggcagaaacgcgtggcaaactccgttatctttaaaac

SEQ ID NO: 107996 - DNA, 84 bp, Homo sapiens; identical to SEQ ID NO: 75324
  misc_feature 1..84: note = chr12:96185037-96185121
  misc_feature 1..84: note = Hyper
  source 1..84: mol_type = genomic DNA

SEQ ID NO: 107997 - DNA, 30 bp, Homo sapiens; identical to SEQ ID NO: 75325
  misc_feature 1..30: note = chr12:96817042-96817072
  misc_feature 1..30: note = Hypo
  source 1..30: mol_type = genomic DNA

SEQ ID NO: 107998 - DNA, 15 bp, Homo sapiens
  misc_feature 1..15: note = chr12:96844259-96844274
  misc_feature 1..15: note = Hypo
  source 1..15: mol_type = genomic DNA
cgtctcaaaaaaaaa

SEQ ID NO: 107999 - DNA, 20 bp, Homo sapiens
  misc_feature 1..20: note = chr12:96881018-96881038
  misc_feature 1..20: note = Hypo
  source 1..20: mol_type = genomic DNA
agccacgacacccagccaat

SEQ ID NO: 108000 - DNA, 746 bp, Homo sapiens; identical to SEQ ID NO: 75328
  misc_feature 1..746: note = chr12:96883069-96883815
  misc_feature 1..746: note = Hyper
  source 1..746: mol_type = genomic DNA

SEQ ID NO: 108001 - DNA, 30 bp, Homo sapiens; identical to SEQ ID NO: 43525
  misc_feature 1..30: note = chr12:97073402-97073432
  misc_feature 1..30: note = Hypo
  source 1..30: mol_type = genomic DNA

SEQ ID NO: 108002 - DNA, 56 bp, Homo sapiens
  misc_feature 1..56: note = chr12:97379987-97380043
  misc_feature 1..56: note = Hyper
  source 1..56: mol_type = genomic DNA
agtcccgcctggcagcgcaggccgtgcactccccgcgcttccgggaacctgtttgc

SEQ ID NO: 108003 - DNA, 212 bp, Homo sapiens; identical to SEQ ID NO: 75331
  misc_feature 1..212: note = chr12:98763870-98764082
  misc_feature 1..212: note = Hypo
  source 1..212: mol_type = genomic DNA

SEQ ID NO: 108004 - DNA, 87 bp, Homo sapiens; identical to SEQ ID NO: 75332
  misc_feature 1..87: note = chr12:98849530-98849617
  misc_feature 1..87: note = Hypo
  source 1..87: mol_type = genomic DNA

SEQ ID NO: 108005 - DNA, 143 bp, Homo sapiens; identical to SEQ ID NO: 75333
  misc_feature 1..143: note = chr12:98895762-98895905
  misc_feature 1..143: note = Hypo
  source 1..143: mol_type = genomic DNA

SEQ ID NO: 108006 - DNA, 98 bp, Homo sapiens; identical to SEQ ID NO: 75334
  misc_feature 1..98: note = chr12:98896397-98896495
  misc_feature 1..98: note = Hypo
  source 1..98: mol_type = genomic DNA

SEQ ID NO: 108007 - DNA, 38 bp, Homo sapiens; identical to SEQ ID NO: 43527
  misc_feature 1..38: note = chr12:98947863-98947901
  misc_feature 1..38: note = Hypo
  source 1..38: mol_type = genomic DNA

SEQ ID NO: 108008 - DNA, 42 bp, Homo sapiens; identical to SEQ ID NO: 15681
  misc_feature 1..42: note = chr12:98948376-98948418
  misc_feature 1..42: note = Hypo
  source 1..42: mol_type = genomic DNA

SEQ ID NO: 108009 - DNA, 30 bp, Homo sapiens; identical to SEQ ID NO: 75337
  misc_feature 1..30: note = chr12:98951496-98951526
  misc_feature 1..30: note = Hypo
  source 1..30: mol_type = genomic DNA

SEQ ID NO: 108010 - DNA, 43 bp, Homo sapiens; identical to SEQ ID NO: 75338
  misc_feature 1..43: note = chr12:98986165-98986208
  misc_feature 1..43: note = Hypo
  source 1..43: mol_type = genomic DNA

SEQ ID NO: 108011 - DNA, 81 bp, Homo sapiens; identical to SEQ ID NO: 75340
  misc_feature 1..81: note = chr12:99287423-99287504
  misc_feature 1..81: note = Hyper
  source 1..81: mol_type = genomic DNA

SEQ ID NO: 108012 - DNA, 1199 bp, Homo sapiens
  misc_feature 1..1199: note = chr12:99288150-99289349
  misc_feature 1..1199: note = Hyper
  source 1..1199: mol_type = genomic DNA
aaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggcttcctccgcctctgccccggctgcggcaccacttcttggagccacgtctcggcgagcgggggccgcggagcgagggggccgctgtgccgctactcacccgagccgctcgggctggccgcgagccgggatccgcgagggctggcgggctctggcccccgaggacgcagacatgtggcttgaacctccgctcccctagccgttgcctctgtgcatctttctgggcgcccccagcgaatgcgagcggcgaggcgagggcgagcgcgccgaggaagggcgggagaggcgcggagcttggccgcgccgcgctgcgccgagcgccgggctctccccgcgagctccccgggcccgcgcgcgcgccccccactgcccccgccccccgcgcggcgcgtgccccccaccccccgccgcgcgccctcgcacccgcccggctccacgcggcgcgcgcctgccctggcggcagcggcggcggcggcggcgcgtcctcccccgaacgccgtctccagggctgctggctgcgctctccattgttccgcggctgctgcccggggtgggcggcgaggcgggggggaggtgtcggcttggccgccggggagggcttaccgctcgggcggaccctcactgcgagagcgatgcgggcccaggcgcggcgcgcgggggctgcagggcgcctagcactgggggttgccggcgcgcgggggcctcctcctggctcccaggcactcgctgctgctgggcgcccctcgcatcctcggttactatggatatctcgctcctccgccgccccctccgcgcactccgggaggccgccggggcggtagcagcggcgcggctccgcgggtgcccaggtgaccggctcggcagcggcagagcagtggcagcagccgccactgccgctgttactgcggtcgccgccgctggagagaggaggacgaggagggcaaggggcagaagcaggtcctgctctgtctgccccagaggccacctcgggtttcttctcactaaccaagcgacttcgtgtttacctcgcaggagacgcctc

SEQ ID NO: 108013 - DNA, 30 bp, Homo sapiens; identical to SEQ ID NO: 75346
  misc_feature 1..30: note = chr12:99809435-99809465
  misc_feature 1..30: note = Hypo
  source 1..30: mol_type = genomic DNA

SEQ ID NO: 108014 - DNA, 33 bp, Homo sapiens; identical to SEQ ID NO: 73609
  misc_feature 1..33: note = chr12:100595448-100595481
  misc_feature 1..33: note = Hypo
  source 1..33: mol_type = genomic DNA

SEQ ID NO: 108015 - DNA, 26 bp, Homo sapiens
  misc_feature 1..26: note = chr12:100969543-100969569
  misc_feature 1..26: note = Hypo
  source 1..26: mol_type = genomic DNA
ccgcgcctggccgttatctctatttt

SEQ ID NO: 108016 - DNA, 151 bp, Homo sapiens; identical to SEQ ID NO: 73613
  misc_feature 1..151: note = chr12:101025396-101025547
  misc_feature 1..151: note = Hypo
  source 1..151: mol_type = genomic DNA

SEQ ID NO: 108017 - DNA, 30 bp, Homo sapiens; identical to SEQ ID NO: 73614
  misc_feature 1..30: note = chr12:101109113-101109143
  misc_feature 1..30: note = Hypo
  source 1..30: mol_type = genomic DNA

SEQ ID NO: 108018 - DNA, 858 bp, Homo sapiens; identical to SEQ ID NO: 73615
  misc_feature 1..858: note = chr12:101110839-101111697
  misc_feature 1..858: note = Hyper
  source 1..858: mol_type = genomic DNA

SEQ ID NO: 108019 - DNA, 21 bp, Homo sapiens
  misc_feature 1..21: note = chr12:101254680-101254701
  misc_feature 1..21: note = Hypo
  source 1..21: mol_type = genomic DNA
cttcaagaatggggccgcgga

SEQ ID NO: 108020 - DNA, 30 bp, Homo sapiens; identical to SEQ ID NO: 43532
  misc_feature 1..30: note = chr12:102158693-102158723
  misc_feature 1..30: note = Hypo
  source 1..30: mol_type = genomic DNA

SEQ ID NO: 108021 - DNA, 91 bp, Homo sapiens; identical to SEQ ID NO: 73624
  misc_feature 1..91: note = chr12:103100245-103100336
  misc_feature 1..91: note = Hypo
  source 1..91: mol_type = genomic DNA

SEQ ID NO: 108022 - DNA, 361 bp, Homo sapiens; identical to SEQ ID NO: 73625
  misc_feature 1..361: note = chr12:103218204-103218565
  misc_feature 1..361: note = Hyper
  source 1..361: mol_type = genomic DNA

SEQ ID NO: 108023 - DNA, 130 bp, Homo sapiens; identical to SEQ ID NO: 73626
  misc_feature 1..130: note = chr12:103311160-103311290
  misc_feature 1..130: note = Hyper
  source 1..130: mol_type = genomic DNA

SEQ ID NO: 108024 - DNA, 115 bp, Homo sapiens; identical to SEQ ID NO: 73627
  misc_feature 1..115: note = chr12:103344593-103344708
  misc_feature 1..115: note = Hyper
  source 1..115: mol_type = genomic DNA

SEQ ID NO: 108025 - DNA, 424 bp, Homo sapiens
  misc_feature 1..424: note = chr12:103350198-103350622
  misc_feature 1..424: note = Hyper
  source 1..424: mol_type = genomic DNA
agcgacggctgcaagcgcctccccctccctctcggcgccagcacgcggccccgccgggctccgctcccagtcgcctgccaccgggccgccgggcacacgcctggggcgggatggtggctgcgccaaggccgccgaggtgcccgcggcggcgccgaagaaccaggaatccccaccagtgccctaagcgccatcactcaacccccgccccgcatctttcttctccgagggtctgggagtatcccagagcactcccttctttatgatatccgctaagctggtccggaaataatctttatggggagggggtggcggtagggggcgatggtacagggggccagaggtcatcctagggggacgtccctgccatatacacccacctacaggacggctcacaaccactcctcggtgtcgcttccccgcggcc

SEQ ID NO: 108026 - DNA, 1421 bp, Homo sapiens
  misc_feature 1..1421: note = chr12:103351416-103352837
  misc_feature 1..1421: note = Hyper
  source 1..1421: mol_type = genomic DNA
gtcccattgaaaaggcggacgcactccggcagcccagcactctctcacttctggccagggaacgtggaaggcgcaccgacagggatccggccagggagggcgagtgaaagaaggaaatcagaaaggaagggagttaacaaaataataaaaacagcctgagccacggctggagagaccgagacccggcgcaagagagcgcagccttagtaggagaggaacgcgagacgcggcagagcgcgttcagcactgacttttgctgctgcttctgcttttttttttcttagaaacaagaaggcgccagcggcagcctcacacgcgagcgccacgcgaggctcccgaagccaacccgcgaagggaggaggggagggaggaggaggcggcgtgcagggaggagaaaaagcattttcactttttttgctcccactctaagaagtctcccggggattttgtatatattttttaacttccgtcagggctcccgcttcatatttccttttctttccctctctgttcctgcacccaagttctctctgtgtccccctcgcgggccccgcacctcgcgtcccggatcgctctgattccgcgactccttggccgccgctgcgcatggaaagctctgccaagatggagagcggcggcgccggccagcagccccagccgcagccccagcagcccttcctgccgcccgcagcctgtttctttgccacggccgcagccgcggcggccgcagccgccgcagcggcagcgcagagcgcgcagcagcagcagcagcagcagcagcagcagcagcaggcgccgcagctgagaccggcggccgacggccagccctcagggggcggtcacaagtcagcgcccaagcaagtcaagcgacagcgctcgtcttcgcccgaactgatgcgctgcaaacgccggctcaacttcagcggctttggctacagcctgccgcagcagcagccggccgccgtggcgcgccgcaacgagcgcgagcgcaaccgcgtcaagttggtcaacctgggctttgccacccttcgggagcacgtccccaacggcgcggccaacaagaagatgagtaaggtggagacactgcgctcggcggtcgagtacatccgcgcgctgcagcagctgctggacgagcatgacgcggtgagcgccgccttccaggcaggcgtcctgtcgcccaccatctcccccaactactccaacgacttgaactccatggccggctcgccggtctcatcctactcgtcggacgagggctcttacgacccgctcagccccgaggagcaggagcttctcgacttcaccaactggttctgaggggctcggcctggtcaggccctggtgcgaatggactttggaagcaggtaggttgcattttggggtgggcaggggggtattcttgccttcgtcctccctctgag

SEQ ID NO: 108027 - DNA, 312 bp, Homo sapiens; identical to SEQ ID NO: 73635
  misc_feature 1..312: note = chr12:103358661-103358973
  misc_feature 1..312: note = Hyper
  source 1..312: mol_type = genomic DNA

SEQ ID NO: 108028 - DNA, 485 bp, Homo sapiens
  misc_feature 1..485: note = chr12:103359233-103359718
  misc_feature 1..485: note = Hyper
  source 1..485: mol_type = genomic DNA
gagacaggagtgggacgcgctcccagaacgtcccgcgtgcgcccccctctaggcagccagcgggcggccgcttacaaagccgcctttgatgctctggctaccagggctattttggggacgagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttgcactaccgggctcagcgcagccagccccaccgcctccggactcgaccccaccatagccccgccgtccgaatcgtctctgaaccaaactacttctgcctgcctttctttggatctgtctttctctgtcatctgagtcactttctctctcgcctctcttttctt

SEQ ID NO: 108029 - DNA, 860 bp, Homo sapiens
  misc_feature 1..860: note = chr12:103889165-103890025
  misc_feature 1..860: note = Hyper
  source 1..860: mol_type = genomic DNA
cgcccccaaccgctccgcccggcccctcccccgctccctcccccacccctcccccttcctgtattagcatgcgggcggcggcgagccggccgggtggggagggcggcggtggcatcgctgcgcggggcgcattgtgggccgcgctcgcctccgcgggggaccatctgctcgctgtcaatgcatcacctgctcgtctgggccgtcgccggggcaacggggggcgggggattaaggagcgtgtgcgtctcggtccgggccgaggcggcgaggtgggggttggggcgggggaggagagctccttggccccccacccccctgccccgagacgggtcgacccgctcgggggccggcgaccaccgcgacgggttccgccgcttgcctccgctccttggcctttgctgccgtgctgcctcttctcacgggcgcggctggagtcccggggagcagcagagagcaaacggtccggctctacctcaccctgccagggggcgagtcccgcgctccctgcgtctacctggagctgcagggtccctatcccggggcgccgcccgcagcctcctccgcgggagctggagcactctgctgggtcctggggacgcggcgcagcgtggttccaagcgctccgcagtcgccgggcaaccacaatggggctgccttgccgtgagaccctcccccgcgactgccaccaaagtcacagaaaactttcacacctctcatctgacactgtggcctgtgcacgactccaagcactggggaagccttcgacatcagaatatgaatggcacctgttcttccgggggcggcaagggggatcccgatgtttatcaaaatgggttgattttccacggagggggtacttc

SEQ ID NO: 108030 - DNA, 30 bp, Homo sapiens; identical to SEQ ID NO: 73644
  misc_feature 1..30: note = chr12:103897121-103897151
  misc_feature 1..30: note = Hypo
  source 1..30: mol_type = genomic DNA

SEQ ID NO: 108031 - DNA, 207 bp, Homo sapiens; identical to SEQ ID NO: 73645
  misc_feature 1..207: note = chr12:103922840-103923047
  misc_feature 1..207: note = Hypo
  source 1..207: mol_type = genomic DNA

SEQ ID NO: 108032 - DNA, 175 bp, Homo sapiens; identical to SEQ ID NO: 73646
  misc_feature 1..175: note = chr12:104322966-104323141
  misc_feature 1..175: note = Hyper
  source 1..175: mol_type = genomic DNA

SEQ ID NO: 108033 - DNA, 18 bp, Homo sapiens
  misc_feature 1..18: note = chr12:104354143-104354161
  misc_feature 1..18: note = Hypo
  source 1..18: mol_type = genomic DNA
acccggccaatctgtacc

SEQ ID NO: 108034 - DNA, 30 bp, Homo sapiens; identical to SEQ ID NO: 73648
  misc_feature 1..30: note = chr12:104539506-104539536
  misc_feature 1..30: note = Hypo
  source 1..30: mol_type = genomic DNA

SEQ ID NO: 108035 - DNA, 823 bp, Homo sapiens
  misc_feature 1..823: note = chr12:104609336-104610159
  misc_feature 1..823: note = Hyper
  source 1..823: mol_type = genomic DNA
ggattttgggtggtgcgctcttttctcctttccatttctgcattttccaatttacctttagcgaccgttctttcctgttaaaaaaaaaaaattcacgaccttgaagaagatacacgggctatgacttcgctgttgtcaccgagcgccccgcccaccgcgttctccgacccgcggccggcagggggctcgcggcctccgccaggcgtccttcggctccgtcagttcccacagggccttgtgcgacatgggctgcgccgagggcaaggcagtggcggcggccgccccaacggagctgcagacgaaaggcaagaacggcgatggccgccgtaggtcaggtacgaccgagggcgaaggcctggtccccaggtcgacgggccgaagcgggccttccggccggggttggggataaagtgccccggagccctggccttgaagcccctcactggagtcagtgactgaccgcgcgccacgctggagaccccagaaacgctcccccaggtcaccccgggagacggaggccggcggccggccgagggctgccccgcccgctggctgtgagagaggtgggaggtggaaggaggagcgggcccgccgcgaggacctgcccggaaacctgtcggaaaccgaaccgagatctcggcagcgacccgcctgatttcgctcagggcccgttagggcgtcctcttcctacaagcaccgtgtttccaatgaaaggttacgggggaagcgaccaaaccgacagccgagtccgggggtgccccttcacctctccagaagcccccggcccactcccagcatcctcctccatcgagaatcttgtccg

SEQ ID NO: 108036 - DNA, 158 bp, Homo sapiens; identical to SEQ ID NO: 73651
  misc_feature 1..158: note = chr12:104671514-104671672
  misc_feature 1..158: note = Hypo
  source 1..158: mol_type = genomic DNA

SEQ ID NO: 108037 - DNA, 30 bp, Homo sapiens; identical to SEQ ID NO: 15682
  misc_feature 1..30: note = chr12:104690709-104690739
  misc_feature 1..30: note = Hypo
  source 1..30: mol_type = genomic DNA

SEQ ID NO: 108038 - DNA, 84 bp, Homo sapiens; identical to SEQ ID NO: 73653
  misc_feature 1..84: note = chr12:104695390-104695474
  misc_feature 1..84: note = Hypo
  source 1..84: mol_type = genomic DNA

SEQ ID NO: 108039 - DNA, 102 bp, Homo sapiens; identical to SEQ ID NO: 43535
  misc_feature 1..102: note = chr12:104696536-104696638
  misc_feature 1..102: note = Hypo
  source 1..102: mol_type = genomic DNA

SEQ ID NO: 108040 - DNA, 30 bp, Homo sapiens; identical to SEQ ID NO: 43536
  misc_feature 1..30: note = chr12:104698273-104698303
  misc_feature 1..30: note = Hypo
  source 1..30: mol_type = genomic DNA

SEQ ID NO: 108041 - DNA, 1301 bp, Homo sapiens
  misc_feature 1..1301: note = chr12:104850244-104851545
  misc_feature 1..1301: note = Hyper
  source 1..1301: mol_type = genomic DNA
aaagaaaaacgaaaccgcccagttctgagcgtcggaaaatgggcactcgctccctgggggtttggggcaacttccccgctacgtcgcccagggattttaaataattgccagccaccagaaaccccctaacccttaattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggccggggactgagggcttttgggaccctgcgggagcgcggcgcgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccaggtagggggcgcgttagcgtggttttgttggatattttcttctctctcgcgctctagctcgctccgcctgatttctgcctcttccaaccctacctctccgccttcggcctcttcggggctcctggctgcccagagctcctggctgcccagatctacccgggtcaccgcgtcgggatggggaggagaagggaaggtgtgcttcgccctcttcttcctaccggctccgggctggaggatgg

SEQ ID NO: 108042 - DNA, 939 bp, Homo sapiens
  misc_feature 1..939: note = chr12:104851893-104852832
  misc_feature 1..939: note = Hyper
  source 1..939: mol_type = genomic DNA
ggtgtggagagtggtcgggtgcccagcgttgcccctccaccacgcgccggccgtttgcccccggggtccgggtccgcagtgaccttgcggctggtgccccggggcctgctccagcccccagccctgagctggaaactccgagctcctgggtcacgccttgaccactgcagttttggaggaaactttggccaggtcctgggctgaccgtccgtttgcatcccccacttctgggatccgagcaacgggaatcccccgggcggcgtgggaatgaaccccattcctccggtcccttgtggctcaggcaaagttccacgtccgaaatctggactgggggagggacgaggctcgtcgcttcctaggggtgcgagggaaagtttgggttctggagagggaggggcgccctcgagcgcggcggccgggggtgagcagctcggctgcgaagcccaacaggtagaacgttccgagaagccttccgggtaacgcgggtctccccgccaagccgtggctcccctgctcccttttaccctcccttagcagccccctgccgggccacgttggctcagaaatccattttctacgcctccgagttgcctttctcagcgtagtcacagcaataatttgcttttctaattgcaaggaggagggaggtggaaacgcatttccttccagggaagtggggttggtgtttttcatttttgcctcccgccttctcctttcactgtgtatctaacactttaaacagacgcagtcccgaattcatcaagcctgcgtttgggtcgatggcagaggaataaagctgttctttccatcaaacaggcagggctgcaggctgcagattccttgacagcgcagggacagacggcccctttgccccactcggtctggagcagttgttaaggcagccacactgccaaggatatggtccgactctaccacatg

SEQ ID NO: 108043 - DNA, 30 bp, Homo sapiens; identical to SEQ ID NO: 73662
  misc_feature 1..30: note = chr12:104858624-104858654
  misc_feature 1..30: note = Hypo
  source 1..30: mol_type = genomic DNA

SEQ ID NO: 108044 - DNA, 39 bp, Homo sapiens; identical to SEQ ID NO: 73663
  misc_feature 1..39: note = chr12:104975776-104975815
  misc_feature 1..39: note = Hypo
  source 1..39: mol_type = genomic DNA

SEQ ID NO: 108045 - DNA, 76 bp, Homo sapiens; identical to SEQ ID NO: 73664
  misc_feature 1..76: note = chr12:104983800-104983876
  misc_feature 1..76: note = Hypo
  source 1..76: mol_type = genomic DNA

SEQ ID NO: 108046 - DNA, 78 bp, Homo sapiens; identical to SEQ ID NO: 43538
  misc_feature 1..78: note = chr12:105018625-105018703
  misc_feature 1..78: note = Hypo
  source 1..78: mol_type = genomic DNA

SEQ ID NO: 108047 - DNA, 39 bp, Homo sapiens; identical to SEQ ID NO: 73666
  misc_feature 1..39: note = chr12:105025106-105025145
  misc_feature 1..39: note = Hypo
  source 1..39: mol_type = genomic DNA

SEQ ID NO: 108048 - DNA, 96 bp, Homo sapiens; identical to SEQ ID NO: 73667
  misc_feature 1..96: note = chr12:105029202-105029298
  misc_feature 1..96: note = Hypo
  source 1..96: mol_type = genomic DNA

SEQ ID NO: 108049 - DNA, 96 bp, Homo sapiens; identical to SEQ ID NO: 73668
  misc_feature 1..96: note = chr12:105056873-105056969
  misc_feature 1..96: note = Hypo
  source 1..96: mol_type = genomic DNA

SEQ ID NO: 108050 - DNA, 153 bp, Homo sapiens; identical to SEQ ID NO: 73669
  misc_feature 1..153: note = chr12:105069312-105069465
  misc_feature 1..153: note = Hypo
  source 1..153: mol_type = genomic DNA

SEQ ID NO: 108051 - DNA, 88 bp, Homo sapiens; identical to SEQ ID NO: 73670
  misc_feature 1..88: note = chr12:105100669-105100757
  misc_feature 1..88: note = Hypo
  source 1..88: mol_type = genomic DNA

SEQ ID NO: 108052 - DNA, 30 bp, Homo sapiens; identical to SEQ ID NO: 73671
  misc_feature 1..30: note = chr12:105103480-105103510
  misc_feature 1..30: note = Hypo
  source 1..30: mol_type = genomic DNA

SEQ ID NO: 108053 - DNA, 42 bp, Homo sapiens; identical to SEQ ID NO: 73672
  misc_feature 1..42: note = chr12:105104150-105104192
  misc_feature 1..42: note = Hypo
  source 1..42: mol_type = genomic DNA

SEQ ID NO: 108054 - DNA, 119 bp, Homo sapiens; identical to SEQ ID NO: 73673
  misc_feature 1..119: note = chr12:105140973-105141092
  misc_feature 1..119: note = Hypo
  source 1..119: mol_type = genomic DNA

SEQ ID NO: 108055 - DNA, 30 bp, Homo sapiens; identical to SEQ ID NO: 73674
  misc_feature 1..30: note = chr12:105147152-105147182
  misc_feature 1..30: note = Hypo
  source 1..30: mol_type = genomic DNA

SEQ ID NO: 108056 - DNA, 30 bp, Homo sapiens; identical to SEQ ID NO: 73675
  misc_feature 1..30: note = chr12:105150821-105150851
  misc_feature 1..30: note = Hypo
  source 1..30: mol_type = genomic DNA

SEQ ID NO: 108057 - DNA, 30 bp, Homo sapiens; identical to SEQ ID NO: 73676
  misc_feature 1..30: note = chr12:105392811-105392841
  misc_feature 1..30: note = Hypo
  source 1..30: mol_type = genomic DNA

SEQ ID NO: 108058 - DNA, 30 bp, Homo sapiens; identical to SEQ ID NO: 73677
  misc_feature 1..30: note = chr12:105393128-105393158
  misc_feature 1..30: note = Hypo
  source 1..30: mol_type = genomic DNA

SEQ ID NO: 108059 - DNA, 333 bp, Homo sapiens; identical to SEQ ID NO: 73678
  misc_feature 1..333: note = chr12:105478020-105478353
  misc_feature 1..333: note = Hyper
  source 1..333: mol_type = genomic DNA

SEQ ID NO: 108060 - DNA, 30 bp, Homo sapiens; identical to SEQ ID NO: 73679
  misc_feature 1..30: note = chr12:105673102-105673132
  misc_feature 1..30: note = Hypo
  source 1..30: mol_type = genomic DNA

SEQ ID NO: 108061 - DNA, 189 bp, Homo sapiens; identical to SEQ ID NO: 73682
  misc_feature 1..189: note = chr12:106532217-106532406
  misc_feature 1..189: note = Hyper
  source 1..189: mol_type = genomic DNA

SEQ ID NO: 108062 - DNA, 30 bp, Homo sapiens; identical to SEQ ID NO: 73683
  misc_feature 1..30: note = chr12:106533379-106533409
  misc_feature 1..30: note = Hyper
  source 1..30: mol_type = genomic DNA

SEQ ID NO: 108063 - DNA, 696 bp, Homo sapiens; identical to SEQ ID NO: 73685
  misc_feature 1..696: note = chr12:106974297-106974993
  misc_feature 1..696: note = Hyper
  source 1..696: mol_type = genomic DNA

SEQ ID NO: 108064 - DNA, 481 bp, Homo sapiens; identical to SEQ ID NO: 73686
  misc_feature 1..481: note = chr12:106975246-106975727
  misc_feature 1..481: note = Hyper
  source 1..481: mol_type = genomic DNA

SEQ ID NO: 108065 - DNA, 484 bp, Homo sapiens
  misc_feature 1..484: note = chr12:106976403-106976887
  misc_feature 1..484: note = Hyper
  source 1..484: mol_type = genomic DNA
cccggcctgccagcacggcgcggggcccgatggtggggaagggccgggagggggagggggccacatctaagccaattttgatttcgcctataatgagtgccgggcgaaggctggagaaggcctctggaactttaaataagaaaaacgttgctaatgctataatagaagggggaagtcggagggctgggattgcgtcgctctgagccccccttttcggaggcggcttttcttattcaaaacaggcccacaatgggcttcacagtgcgcctcgccacggccccatctgacgagcggccattcatcaggccggctggcctatcaatgacattgctcccatcggggctcctataaaatgatgctttttcccatgaaacatccgcaaacattttgacgggtttggctttgcccggctggattactgagtgtccccttgctcgctcgctttttctctctcccccttctccgagctcgctcccttctctcc

SEQ ID NO: 108066 - DNA, 459 bp, Homo sapiens; identical to SEQ ID NO: 73689
  misc_feature 1..459: note = chr12:106977393-106977852
  misc_feature 1..459: note = Hyper
  source 1..459: mol_type = genomic DNA

SEQ ID NO: 108067 - DNA, 72 bp, Homo sapiens; identical to SEQ ID NO: 73690
  misc_feature 1..72: note = chr12:106978702-106978774
  misc_feature 1..72: note = Hyper
  source 1..72: mol_type = genomic DNA

SEQ ID NO: 108068 - DNA, 2619 bp, Homo sapiens
  misc_feature 1..2619: note = chr12:106979033-106981652
  misc_feature 1..2619: note = Hyper
  source 1..2619: mol_type = genomic DNA
gctgtggattcgtggcgttttctgttctcgatgcaactggtgctcgtgggggcaccgggtcctcttcacctcaactgcaaacactccagagacgttctgaaatgaaatcctttccccatccacttctctcccttttgtatatccgagacatccctaggtcaccaccctgaacgcaaaatcaaaagttttggtacacgacagtgtgaagaaatgacactagacgcaccaggtgacatttcactccgacttgcaaaaccgacgacaagggaagtgcggctcggcgtggtccagtccagaagccttccctcacctcccttccagagaatttaatccaattagcctttcttctgagtttcccttgttatgtaaagggtcttttctcctggcttgcagagacgcgcgctccatggagcagttcgattctgctccttttgtataagatcgcgcgcgatcagaaccaggaatattgctgttattatatcattccgaaaggactggaacaaccgactcacagcaagtgctggggcgaagtaggaaacgtccaggataagagaggccggcgagcggggccaccgtcccttactcttaaaaggaaaatccccgcgaagtgcctcgggcccgggagaacagttttgcaggggccagggctctagtggcctgctttggggccacttcagcatgacctgcggaaacgcgcccctttgttccgcacactgagccagtaatatattcctcgggtttccccaaaatactcaacaagtgtggagctaagacaatggcccggtcgggggaagctgggcagccggcgcgcgcctcctgggccctaggcgctctcgctgccgagcccgacaaagcaaagcccctctcggaggcaaagccccagcttgccgcgcgccgcggtgctccggcaggaggcaaaggcgacaggcgcgcgcaggggcagtcgacgcaccttctggccggtgcgcggtttgcagtaagcgcaggcgcgcgtcccgctcggcccgcgctacagccccacgccgcgcaaaagtgggtgctgagccccgcgtggcctgcgctccccacgcgggccaccggcagctacgtgtttgtggccgccgggtccaatcagggctgctctgcccgggtgatcgttgctcagttactcaagttatccggaaattcgagaacgatgggggaaagtgggtagaattttaggccaccgagaacttgtgcaaagtgggccgggccgggtcggtcgcctacgcaacagaaggatcatttcttttaaaacgggatggcgcgttagagagggccactgccaagctggagctggaaacttctgcctccatccactttccgctcccatctccagaacccagagctgaggcggccaaagtacttcctggagccggatttgagttccccgggccgcatcggtgggagggcacgctagtttacaggcccccagctcagcacaaattctttctaaaattctaccaccaaattaattatatgcctttgtgggcccggggtagggatgtccagtggccttggcgccgtgcccacaaggcaaagtgcgtcctggagggaacagggcccgagcctcctccattcttgcccaggcacagccctggggaaggagccactgtctgcgggcttgggagagcaaggagccggaggtccgagccttgctccagcgcccaaaccagacagtctcgccctccccgggcgtgtgtgtgtgcgcgcgcgcgggcgaacggggcatgtgcgcccccatctctgccacctgctaagcgccggcgtctggatttggcagcggggtcaagtgagagccgcatggtaccagggttccgagtccccgaggctgcagcccttgatggcgcggaggctgcacgcaggctgggtcctcggagtcccggattcagcacgcgactctgtgcggcagcctgggacagcgcgctttcctacccggcctgcaggtcccagagactcggaaaagtttgcaggggccgcccggcgcctcgggcctgggatttccaaagccgctcccgcccccgtccccagcgcgtcaccatggagactgctggaagttggtggtggaaaacagacctggcgcaaagcaaaatattatgagtgcagttggggtgacttcagggggcggggggaccggagggcaggagcgggagccagaggcagaggccgacaacaaagggcccagtgcgaggaagagagaggagtttgcacggggcctccccgccgctgtgtgagtgctggaccatcctgcttcccagaggctccgaggtctctaatttctctccagcagctataccttttctcagcccgccttggagcccttgctccctccctcctctccgggttctcttccagcctcccccctcacccgtccggaggttaggcgccagctgggcagtgcgcccgcctccccaggagccacaggctcaccaacgtgaaaggttctggcttttcttccccacgacccgtgggtcgcccagggtgagtttctcaccccctatctcaaacccgatctgaaagggtgatgggttagaataaggtgggaacggaacgggaagagaagggagcgtctggccagaaatcttgcgagtggggatgggt

SEQ ID NO: 108069 - DNA, 200 bp, Homo sapiens; identical to SEQ ID NO: 43542
  misc_feature 1..200: note = chr12:107138858-107139058
  misc_feature 1..200: note = Hypo
  source 1..200: mol_type = genomic DNA

SEQ ID NO: 108070 - DNA, 47 bp, Homo sapiens; identical to SEQ ID NO: 73696
  misc_feature 1..47: note = chr12:107297268-107297315
  misc_feature 1..47: note = Hyper
  source 1..47: mol_type = genomic DNA

SEQ ID NO: 108071 - DNA, 30 bp, Homo sapiens; identical to SEQ ID NO: 73698
  misc_feature 1..30: note = chr12:107432746-107432776
  misc_feature 1..30: note = Hypo
  source 1..30: mol_type = genomic DNA

SEQ ID NO: 108072 - DNA, 146 bp, Homo sapiens; identical to SEQ ID NO: 34616
  misc_feature 1..146: note = chr12:107486450-107486596
  misc_feature 1..146: note = Hyper
  source 1..146: mol_type = genomic DNA

SEQ ID NO: 108073 - DNA, 645 bp, Homo sapiens; identical to SEQ ID NO: 73700
  misc_feature 1..645: note = chr12:107487210-107487855
  misc_feature 1..645: note = Hyper
  source 1..645: mol_type = genomic DNA

SEQ ID NO: 108074 - DNA, 387 bp, Homo sapiens; identical to SEQ ID NO: 73701
  misc_feature 1..387: note = chr12:107711950-107712337
  misc_feature 1..387: note = Hyper
  source 1..387: mol_type = genomic DNA

SEQ ID NO: 108075 - DNA, 222 bp, Homo sapiens; identical to SEQ ID NO: 73702
  misc_feature 1..222: note = chr12:107713205-107713427
  misc_feature 1..222: note = Hyper
  source 1..222: mol_type = genomic DNA

SEQ ID NO: 108076 - DNA, 40 bp, Homo sapiens; identical to SEQ ID NO: 73703
  misc_feature 1..40: note = chr12:107714075-107714115
  misc_feature 1..40: note = Hyper
  source 1..40: mol_type = genomic DNA

SEQ ID NO: 108077 - DNA, 657 bp, Homo sapiens; identical to SEQ ID NO: 73704
  misc_feature 1..657: note = chr12:107714660-107715317
  misc_feature 1..657: note = Hyper
  source 1..657: mol_type = genomic DNA

SEQ ID NO: 108078 - DNA, 682 bp, Homo sapiens
  misc_feature 1..682: note = chr12:108168922-108169604
  misc_feature 1..682: note = Hyper
  source 1..682: mol_type = genomic DNA
tctaagattctgtttcgtcttcttctattgagagattgacctcttgagtgatttgtgtgctttccggcaaatgatggagacgcgtaaaccggcggaacggctggccttgccatactcgctgcgcaccgcgcccctgggcgttccggggaccctgcccggactcccgcggagggaccccctcagggtcgccctgcgtctggacgccgcgtgctgggagtgggcgcgcagcggctgcgcacggggatggcagtacttgcccgtgccgctggacagcgccttcgagcccgccttcctccgcaagcgcaacgagcgcgagcggcagcgggtgcgctgcgtgaacgagggctatgcgcgcctccgagaccacctgccccgggagctggcagacaagcgcctcagcaaagtggagacgctccgcgctgccatcgactacatcaagcacctgcaggagctgctggagcgccaggcctgggggctcgagggcgcggccggcgccgtcccccagcgcagggcggaatgcaacagcgacggggagtccaaggcctcttcggcgccttcgcccagcagcgagcccgaggaggggggcagctagcgagcgcccgaactggccaggacccccgcgcccgccgcacagcgcgcagccgggcgctcaacctaaggtcctcttcgaaggtggtttgca

SEQ ID NO: 108079 - DNA, 30 bp, Homo sapiens; identical to SEQ ID NO: 73709
  misc_feature 1..30: note = chr12:108199937-108199967
  misc_feature 1..30: note = Hypo
  source 1..30: mol_type = genomic DNA

SEQ ID NO: 108080 - DNA, 447 bp, Homo sapiens
  misc_feature 1..447: note = chr12:108237347-108237794
  misc_feature 1..447: note = Hyper
  source 1..447: mol_type = genomic DNA
gtgctaccaggaatccgagtagaagtggtcagggatggagcccagggccacctcatccttcttcctcctggagccaaacagcttcttcatcgcggcagcttcggagaagcctcagctaccctgcagctccccttcgccttttcgcggaatccggagtccagtcacaattagctaagcccggggcaccaaagcctttagcagcgaaaccgccgcttccgacctctcggacctagtgagccaggcagagcctttaggcccacgcctgggcaccacagccagcccgaggcccaggaagccgctcccaggctgcgcgcggctggcgctgggcttccagtgccggactgccagaacaggctgggagcgctggggtcttggcgctctgcagccaccagagatctggccgagtgggtctggttacccccacccctgtgccgccacagcccggca

SEQ ID NO: 108081 - DNA, 536 bp, Homo sapiens
  misc_feature 1..536: note = chr12:108238125-108238661
  misc_feature 1..536: note = Hyper
  source 1..536: mol_type = genomic DNA
gcccccagctctgtgcgcccgctgaggaggagacagccagcagcgtggtcaggcaggctctcgcgctgaggaggcagtgcactcaggatactgaggccgcccagagcacgccccgccaacccacctaggcgcctgagctgcagcctctgcgccgtctctgccgcggtccggcaggccgcctggattggccgccgccgctgctgccaccacggtgtccacccaacgactctaatgtgggaagtctggcggtggagggtgtcgcgggctctccggcagacccgtagctggtggtggagctgagggccctggggcatggcgggcagggacttgaggcccgcaggaggagggggccgtgccgatgctggctgtgccggggctgcctgagaacccgcggaggctggggggcgaagacgcgcggcacaggtgcgcaggaacgcggtggtggcagggtcccagactgcccagcctaggacgggcgggataccggactgtagagcagacgaagggcggggtctcagctacggagctatggaccc

SEQ ID NO: 108082 - DNA, 433 bp, Homo sapiens; identical to SEQ ID NO: 34625
  misc_feature 1..433: note = chr12:108297323-108297756
  misc_feature 1..433: note = Hyper
  source 1..433: mol_type = genomic DNA

SEQ ID NO: 108083 - DNA, 231 bp, Homo sapiens; identical to SEQ ID NO: 73715
  misc_feature 1..231: note = chr12:108523208-108523439
  misc_feature 1..231: note = Hyper
  source 1..231: mol_type = genomic DNA

SEQ ID NO: 108084 - DNA, 36 bp, Homo sapiens; identical to SEQ ID NO: 73716
  misc_feature 1..36: note = chr12:108523736-108523772
  misc_feature 1..36: note = Hyper
  source 1..36: mol_type = genomic DNA

SEQ ID NO: 108085 - DNA, 22 bp, Homo sapiens
  misc_feature 1..22: note = chr12:108569903-108569925
  misc_feature 1..22: note = Hypo
  source 1..22: mol_type = genomic DNA
ccacgcccggcctattgttata

SEQ ID NO: 108086 - DNA, 76 bp, Homo sapiens; identical to SEQ ID NO: 73719
  misc_feature 1..76: note = chr12:108603987-108604063
  misc_feature 1..76: note = Hypo
  source 1..76: mol_type = genomic DNA

SEQ ID NO: 108087 - DNA, 55 bp, Homo sapiens; identical to SEQ ID NO: 73721
  misc_feature 1..55: note = chr12:108871619-108871674
  misc_feature 1..55: note = Hypo
  source 1..55: mol_type = genomic DNA

SEQ ID NO: 108088 - DNA, 97 bp, Homo sapiens; identical to SEQ ID NO: 73722
  misc_feature 1..97: note = chr12:108891814-108891911
  misc_feature 1..97: note = Hypo
  source 1..97: mol_type = genomic DNA

SEQ ID NO: 108089 - DNA, 161 bp, Homo sapiens; identical to SEQ ID NO: 73723
  misc_feature 1..161: note = chr12:108898965-108899126
  misc_feature 1..161: note = Hypo
  source 1..161: mol_type = genomic DNA

SEQ ID NO: 108090 - DNA, 30 bp, Homo sapiens; identical to SEQ ID NO: 73724
  misc_feature 1..30: note = chr12:108926148-108926178
  misc_feature 1..30: note = Hypo
  source 1..30: mol_type = genomic DNA

SEQ ID NO: 108091 - DNA, 193 bp, Homo sapiens; identical to SEQ ID NO: 73725
  misc_feature 1..193: note = chr12:108982619-108982812
  misc_feature 1..193: note = Hypo
  source 1..193: mol_type = genomic DNA

SEQ ID NO: 108092 - DNA, 30 bp, Homo sapiens
  misc_feature 1..30: note = chr12:109162468-109162498
  misc_feature 1..30: note = Hyper
  source 1..30: mol_type = genomic DNA
ggccggcagacactccgggcctgcagcggg

SEQ ID NO: 108093 - DNA, 30 bp, Homo sapiens; identical to SEQ ID NO: 73727
  misc_feature 1..30: note = chr12:109162732-109162762
  misc_feature 1..30: note = Hyper
  source 1..30: mol_type = genomic DNA

SEQ ID NO: 108094 - DNA, 58 bp, Homo sapiens; identical to SEQ ID NO: 43544
  misc_feature 1..58: note = chr12:109208616-109208674
  misc_feature 1..58: note = Hypo
  source 1..58: mol_type = genomic DNA

SEQ ID NO: 108095 - DNA, 30 bp, Homo sapiens; identical to SEQ ID NO: 73729
  misc_feature 1..30: note = chr12:109305521-109305551
  misc_feature 1..30: note = Hypo
  source 1..30: mol_type = genomic DNA

SEQ ID NO: 108096 - DNA, 191 bp, Homo sapiens; identical to SEQ ID NO: 73730
  misc_feature 1..191: note = chr12:109343498-109343689
  misc_feature 1..191: note = Hypo
  source 1..191: mol_type = genomic DNA

SEQ ID NO: 108097 - DNA, 30 bp, Homo sapiens; identical to SEQ ID NO: 43546
  misc_feature 1..30: note = chr12:109719635-109719665
  misc_feature 1..30: note = Hypo
  source 1..30: mol_type = genomic DNA

SEQ ID NO: 108098 - DNA, 30 bp, Homo sapiens; identical to SEQ ID NO: 34627
  misc_feature 1..30: note = chr12:109746889-109746919
  misc_feature 1..30: note = Hyper
  source 1..30: mol_type = genomic DNA

SEQ ID NO: 108099 - DNA, 36 bp, Homo sapiens; identical to SEQ ID NO: 73733
  misc_feature 1..36: note = chr12:109873504-109873540
  misc_feature 1..36: note = Hypo
  source 1..36: mol_type = genomic DNA

SEQ ID NO: 108100 - DNA, 36 bp, Homo sapiens; identical to SEQ ID NO: 73734
  misc_feature 1..36: note = chr12:109886472-109886508
  misc_feature 1..36: note = Hypo
  source 1..36: mol_type = genomic DNA

SEQ ID NO: 108101 - DNA, 30 bp, Homo sapiens; identical to SEQ ID NO: 73735
  misc_feature 1..30: note = chr12:109970653-109970683
  misc_feature 1..30: note = Hypo
  source 1..30: mol_type = genomic DNA

SEQ ID NO: 108102 - DNA, 78 bp, Homo sapiens; identical to SEQ ID NO: 73736
  misc_feature 1..78: note = chr12:110030802-110030880
  misc_feature 1..78: note = Hypo
  source 1..78: mol_type = genomic DNA

SEQ ID NO: 108103 - DNA, 30 bp, Homo sapiens; identical to SEQ ID NO: 73737
  misc_feature 1..30: note = chr12:110039080-110039110
  misc_feature 1..30: note = Hypo
  source 1..30: mol_type = genomic DNA

SEQ ID NO: 108104 - DNA, 156 bp, Homo sapiens; identical to SEQ ID NO: 73738
  misc_feature 1..156: note = chr12:110240870-110241026
  misc_feature 1..156: note = Hypo
  source 1..156: mol_type = genomic DNA

SEQ ID NO: 108105 - DNA, 228 bp, Homo sapiens; identical to SEQ ID NO: 73739
  misc_feature 1..228: note = chr12:110258634-110258862
  misc_feature 1..228: note = Hypo
  source 1..228: mol_type = genomic DNA

SEQ ID NO: 108106 - DNA, 136 bp, Homo sapiens; identical to SEQ ID NO: 73740
  misc_feature 1..136: note = chr12:110271059-110271195
  misc_feature 1..136: note = Hyper
  source 1..136: mol_type = genomic DNA

SEQ ID NO: 108107 - DNA, 30 bp, Homo sapiens; identical to SEQ ID NO: 73741
  misc_feature 1..30: note = chr12:110271432-110271462
  misc_feature 1..30: note = Hyper
  source 1..30: mol_type = genomic DNA

SEQ ID NO: 108108 - DNA, 30 bp, Homo sapiens; identical to SEQ ID NO: 73742
  misc_feature 1..30: note = chr12:110299819-110299849
  misc_feature 1..30: note = Hypo
  source 1..30: mol_type = genomic DNA

SEQ ID NO: 108109 - DNA, 40 bp, Homo sapiens; identical to SEQ ID NO: 73743
  misc_feature 1..40: note = chr12:110353414-110353454
  misc_feature 1..40: note = Hypo
  source 1..40: mol_type = genomic DNA

SEQ ID NO: 108110 - DNA, 153 bp, Homo sapiens; identical to SEQ ID NO: 73744
  misc_feature 1..153: note = chr12:110367786-110367939
  misc_feature 1..153: note = Hypo
  source 1..153: mol_type = genomic DNA

SEQ ID NO: 108111 - DNA, 17 bp, Homo sapiens
  misc_feature 1..17: note = chr12:110506948-110506965
  misc_feature 1..17: note = Hypo
  source 1..17: mol_type = genomic DNA
aaaatcatggctcatcg

SEQ ID NO: 108112 - DNA, 98 bp, Homo sapiens; identical to SEQ ID NO: 73746
  misc_feature 1..98: note = chr12:110563148-110563246
  misc_feature 1..98: note = Hypo
  source 1..98: mol_type = genomic DNA

SEQ ID NO: 108113 - DNA, 34 bp, Homo sapiens; identical to SEQ ID NO: 73747
  misc_feature 1..34: note = chr12:110563785-110563819
  misc_feature 1..34: note = Hypo
  source 1..34: mol_type = genomic DNA

SEQ ID NO: 108114 - DNA, 468 bp, Homo sapiens; identical to SEQ ID NO: 73748
  misc_feature 1..468: note = chr12:110717498-110717966
  misc_feature 1..468: note = Hypo
  source 1..468: mol_type = genomic DNA

SEQ ID NO: 108115 - DNA, 181 bp, Homo sapiens; identical to SEQ ID NO: 73749
  misc_feature 1..181: note = chr12:110782679-110782860
  misc_feature 1..181: note = Hypo
  source 1..181: mol_type = genomic DNA

SEQ ID NO: 108116 - DNA, 179 bp, Homo sapiens; identical to SEQ ID NO: 73750
  misc_feature 1..179: note = chr12:110784092-110784271
  misc_feature 1..179: note = Hypo
  source 1..179: mol_type = genomic DNA

SEQ ID NO: 108117 - DNA, 29 bp, Homo sapiens
  misc_feature 1..29: note = chr12:110840419-110840448
  misc_feature 1..29: note = Hypo
  source 1..29: mol_type = genomic DNA
tgagccactacgcccggccaataaaggat

SEQ ID NO: 108118 - DNA, 153 bp, Homo sapiens; identical to SEQ ID NO: 73752
  misc_feature 1..153: note = chr12:110886947-110887100
  misc_feature 1..153: note = Hypo
  source 1..153: mol_type = genomic DNA

SEQ ID NO: 108119 - DNA, 39 bp, Homo sapiens; identical to SEQ ID NO: 43552
  misc_feature 1..39: note = chr12:110908132-110908171
  misc_feature 1..39: note = Hypo
  source 1..39: mol_type = genomic DNA

SEQ ID NO: 108120 - DNA, 205 bp, Homo sapiens; identical to SEQ ID NO: 73754
  misc_feature 1..205: note = chr12:111127155-111127360
  misc_feature 1..205: note = Hyper
  source 1..205: mol_type = genomic DNA

SEQ ID NO: 108121 - DNA, 23 bp, Homo sapiens
  misc_feature 1..23: note = chr12:111153712-111153735
  misc_feature 1..23: note = Hypo
  source 1..23: mol_type = genomic DNA
accgtgcccggccagtatgctac

SEQ ID NO: 108122 - DNA, 430 bp, Homo sapiens; identical to SEQ ID NO: 73756
  misc_feature 1..430: note = chr12:111284604-111285034
  misc_feature 1..430: note = Hyper
  source 1..430: mol_type = genomic DNA

SEQ ID NO: 108123 - DNA, 30 bp, Homo sapiens; identical to SEQ ID NO: 15686
  misc_feature 1..30: note = chr12:111296630-111296660
  misc_feature 1..30: note = Hypo
  source 1..30: mol_type = genomic DNA

SEQ ID NO: 108124 - DNA, 30 bp, Homo sapiens; identical to SEQ ID NO: 43555
  misc_feature 1..30: note = chr12:111355976-111356006
  misc_feature 1..30: note = Hypo
  source 1..30: mol_type = genomic DNA

SEQ ID NO: 108125 - DNA, 30 bp, Homo sapiens; identical to SEQ ID NO: 73759
  misc_feature 1..30: note = chr12:111358838-111358868
  misc_feature 1..30: note = Hypo
  source 1..30: mol_type = genomic DNA

SEQ ID NO: 108126 - DNA, 352 bp, Homo sapiens; identical to SEQ ID NO: 73760
  misc_feature 1..352: note = chr12:111369069-111369421
  misc_feature 1..352: note = Hypo
  source 1..352: mol_type = genomic DNA

SEQ ID NO: 108127 - DNA, 127 bp, Homo sapiens; identical to SEQ ID NO: 73761
  misc_feature 1..127: note = chr12:111375004-111375131
  misc_feature 1..127: note = Hyper
  source 1..127: mol_type = genomic DNA

SEQ ID NO: 108128 - DNA, 1346 bp, Homo sapiens
  misc_feature 1..1346: note = chr12:111471165-111472511
  misc_feature 1..1346: note = Hyper
  source 1..1346: mol_type = genomic DNA
tggtgacatttcccacgactcagtggcgcccccgggcggctcccaccctccctccggccggcgcgtctacgcagccccaagtgctggctgcgaccctcggatcccaagcatatctggcgatggagcggcggcagcccgaggcacgtgttgtgtgtgctccgattgcaaaagaaaaaaaaatgcatttcaaactattaacttttttttaagcgtgcaatgccgggagctgggggtagacaggtgcaagcgggggtaggcgccccgcgcgcccgcctcccgcagcgccccctcccaaacttccctttgcattgatcagcacgttacgtcagtattgataagtttgcaaaaagccaaagtcaagtgcaatcgcgcggcacaccgaccccggacttgggggggagatgcagcgagcgctccgcgggcccgggagccggcggcaggcagggcagcggcggcgccggcgcctctcggagaggctgcctccccccaacccctcccctcccaccccatccccggctgcctcccccgggcgggcgccgagctccccgcccggcgcgctccgcccgcgccctccgggggtcgggggggcgcacggctcccgggcccgttggcggcggcggcggcggcggcgcggcggcggcgaggggcagcgggtggcaggaggccggagggcgcccgaggggccccgggccgcggcgctcagggcccgggcggccggcggcggccccggggctggggggagtccagcccggatattgagtgcagccattgagaaaagccaaactcttgtgtgtgcgcgtctcgatagcccccaagatggccgccaatgtgggatcgatgtttcaatattggaagcgatttgatctacggcgactccaggttagtgcgggcagcgccggccgcgcggccgtgaggagcccccgggcgcgccctgggcgcattggggaggtccccgggcgggcaggcggacgccctggggcggcgggcggcggctgccggggctcgccggggctcggccgcccgctgcccatcgataggtattaggaattgatctcgccgctgctctttgttcggttcagtcatcgattagctgccgcgaccatggagaagcgctagtgagccctcggtcggcggagcggccgagcggccaggcggccgggcgaggagcggggaaggcaggggctacggcctcgggcagggggctgctggcgggaacccccggcggtcccccctgagccgcactttgcgcgcctcccaacttcgcggcgcccggggaggccgcggagcgcgccgcttgccagtccgcacccggctggggctccggcgagggagggagggagctggcg

SEQ ID NO: 108129 - DNA, 446 bp, Homo sapiens
  misc_feature 1..446: note = chr12:111472571-111473017
  misc_feature 1..446: note = Hyper
  source 1..446: mol_type = genomic DNA
ggcgaggaggcggctccgcgccccgccgctcgccggcacctcagccttcgccgcccgcctggctgcgcagcccggacgcgccgccacccgggggccgccgccgccgccgccagagccgccgccgccggactggccgcaagcgccggcagacctcttctcctcgggccggggtcttggggttcgtcttgcttcttgcctttacccccccgccccttccatccccttcccaagtctagatgcagacgggcggtggaggtgggcccgggcgctcgcaagtttgcgctcctgcctccagggcggtggagagccgggagcggcgcagagcaggtgactcccagccctcgggcccaagggaacttttaaatgagagatttccttgcttgttctgcctcctgcgtttctccccgctgctcccctcgtctcctctctcccgtctctgcttttct

SEQ ID NO: 108130 - DNA, 90 bp, Homo sapiens; identical to SEQ ID NO: 73768
  misc_feature 1..90: note = chr12:111535426-111535516
  misc_feature 1..90: note = Hypo
  source 1..90: mol_type = genomic DNA

SEQ ID NO: 108131 - DNA, 30 bp, Homo sapiens; identical to SEQ ID NO: 73769
  misc_feature 1..30: note = chr12:111590629-111590659
  misc_feature 1..30: note = Hypo
  source 1..30: mol_type = genomic DNA

SEQ ID NO: 108132 - DNA, 246 bp, Homo sapiens
  misc_feature 1..246: note = chr12:111664495-111664741
  misc_feature 1..246: note = Hypo
  source 1..246: mol_type = genomic DNA
ttgatctttttgacacgaattgctttttggccttgtgcgaatgttgtaagctttccgcctgcagaggaatgggctggcgtctgggccgggctgggaagagtgatcgctccagccgcgtggcagtaacattcccgcacatttaacaacaattagtctgtgccgacgccatggtaggctttcgtgtatgaaaatttacaaggcttttaatggactgcattatggaaggccgtgcggggccagtcggtg

SEQ ID NO: 108133 - DNA, 30 bp, Homo sapiens; identical to SEQ ID NO: 73770
  misc_feature 1..30: note = chr12:111692613-111692643
  misc_feature 1..30: note = Hypo
  source 1..30: mol_type = genomic DNA

SEQ ID NO: 108134 - DNA, 30 bp, Homo sapiens; identical to SEQ ID NO: 73771
  misc_feature 1..30: note = chr12:111706217-111706247
  misc_feature 1..30: note = Hypo
  source 1..30: mol_type = genomic DNA

SEQ ID NO: 108135 - DNA, 54 bp, Homo sapiens; identical to SEQ ID NO: 73772
  misc_feature 1..54: note = chr12:111725510-111725564
  misc_feature 1..54: note = Hypo
  source 1..54: mol_type = genomic DNA

SEQ ID NO: 108136 - DNA, 30 bp, Homo sapiens; identical to SEQ ID NO: 73773
  misc_feature 1..30: note = chr12:111760419-111760449
  misc_feature 1..30: note = Hypo
  source 1..30: mol_type = genomic DNA

SEQ ID NO: 108137 - DNA, 17 bp, Homo sapiens
  misc_feature 1..17: note = chr12:111763135-111763152
  misc_feature 1..17: note = Hypo
  source 1..17: mol_type = genomic DNA
accgctgccacttacca

SEQ ID NO: 108138 - DNA, 30 bp, Homo sapiens; identical to SEQ ID NO: 73775
  misc_feature 1..30: note = chr12:111783547-111783577
  misc_feature 1..30: note = Hypo
  source 1..30: mol_type = genomic DNA

SEQ ID NO: 108139 - DNA, 80 bp, Homo sapiens; identical to SEQ ID NO: 73776
  misc_feature 1..80: note = chr12:111844610-111844690
  misc_feature 1..80: note = Hyper
  source 1..80: mol_type = genomic DNA

SEQ ID NO: 108140 - DNA, 133 bp, Homo sapiens; identical to SEQ ID NO: 73777
  misc_feature 1..133: note = chr12:111872804-111872937
  misc_feature 1..133: note = Hyper
  source 1..133: mol_type = genomic DNA

SEQ ID NO: 108141 - DNA, 30 bp, Homo sapiens; identical to SEQ ID NO: 73778
  misc_feature 1..30: note = chr12:112083284-112083314
  misc_feature 1..30: note = Hypo
  source 1..30: mol_type = genomic DNA

SEQ ID NO: 108142 - DNA, 37 bp, Homo sapiens; identical to SEQ ID NO: 73779
  misc_feature 1..37: note = chr12:112149584-112149621
  misc_feature 1..37: note = Hypo
  source 1..37: mol_type = genomic DNA

SEQ ID NO: 108143 - DNA, 91 bp, Homo sapiens; identical to SEQ ID NO: 73780
  misc_feature 1..91: note = chr12:112196381-112196472
  misc_feature 1..91: note = Hypo
  source 1..91: mol_type = genomic DNA

SEQ ID NO: 108144 - DNA, 34 bp, Homo sapiens; identical to SEQ ID NO: 73781
  misc_feature 1..34: note = chr12:112204378-112204412
  misc_feature 1..34: note = Hyper
  source 1..34: mol_type = genomic DNA

SEQ ID NO: 108145 - DNA, 73 bp, Homo sapiens; identical to SEQ ID NO: 73782
  misc_feature 1..73: note = chr12:112204919-112204992
  misc_feature 1..73: note = Hyper
  source 1..73: mol_type = genomic DNA

SEQ ID NO: 108146 - DNA, 19 bp, Homo sapiens
  misc_feature 1..19: note = chr12:112281623-112281642
  misc_feature 1..19: note = Hypo
  source 1..19: mol_type = genomic DNA
tgtttgtttttgagacgga

SEQ ID NO: 108147 - DNA, 30 bp, Homo sapiens; identical to SEQ ID NO: 73784
  misc_feature 1..30: note = chr12:112591860-112591890
  misc_feature 1..30: note = Hypo
  source 1..30: mol_type = genomic DNA

SEQ ID NO: 108148 - DNA, 351 bp, Homo sapiens; identical to SEQ ID NO: 73785
  misc_feature 1..351: note = chr12:112605505-112605856
  misc_feature 1..351: note = Hypo
  source 1..351: mol_type = genomic DNA

SEQ ID NO: 108149 - DNA, 91 bp, Homo sapiens; identical to SEQ ID NO: 43561
  misc_feature 1..91: note = chr12:112610355-112610446
  misc_feature 1..91: note = Hypo
  source 1..91: mol_type = genomic DNA

SEQ ID NO: 108150 - DNA, 160 bp, Homo sapiens; identical to SEQ ID NO: 73787
  misc_feature 1..160: note = chr12:112628549-112628709
  misc_feature 1..160: note = Hypo
  source 1..160: mol_type = genomic DNA

SEQ ID NO: 108151 - DNA, 91 bp, Homo sapiens; identical to SEQ ID NO: 73788
  misc_feature 1..91: note = chr12:112630855-112630946
  misc_feature 1..91: note = Hypo
  source 1..91: mol_type = genomic DNA

SEQ ID NO: 108152 - DNA, 30 bp, Homo sapiens; identical to SEQ ID NO: 43564
  misc_feature 1..30: note = chr12:112820695-112820725
  misc_feature 1..30: note = Hypo
  source 1..30: mol_type = genomic DNA

SEQ ID NO: 108153 - DNA, 157 bp, Homo sapiens; identical to SEQ ID NO: 73790
  misc_feature 1..157: note = chr12:112825977-112826134
  misc_feature 1..157: note = Hypo
  source 1..157: mol_type = genomic DNA

SEQ ID NO: 108154 - DNA, 146 bp, Homo sapiens; identical to SEQ ID NO: 73791
  misc_feature 1..146: note = chr12:112919565-112919711
  misc_feature 1..146: note = Hypo
  source 1..146: mol_type = genomic DNA

SEQ ID NO: 108155 - DNA, 513 bp, Homo sapiens
  misc_feature 1..513: note = chr12:113012954-113013467
  misc_feature 1..513: note = Hyper
  source 1..513: mol_type = genomic DNA
ggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggtaaggcgggcgggggctgcgggccaccaggtcctgccctcccaagctgcagcacgcgctggctggggggtcgtgggggctcccgtgggggcgcggccggacgcgggacgctgcctccgggaatggggctgctggagcgggaggatgcgctagaaccgggggtggggcgacgagggacttgggggcggggagacccgcgcaggacccgtgctatcctttgggattttgaggggcgggtccggcaaggccccccaaagtggctgctcctgcgagtctccgagaggggaacaggtggtcgcggggtggctgcggcgaaggtagctcctctccggtagccacggggt

SEQ ID NO: 108156 - DNA, 30 bp, Homo sapiens; identical to SEQ ID NO: 73794
  misc_feature 1..30: note = chr12:113229160-113229190
  misc_feature 1..30: note = Hyper
  source 1..30: mol_type = genomic DNA

SEQ ID NO: 108157 - DNA, 74 bp, Homo sapiens; identical to SEQ ID NO: 73795
  misc_feature 1..74: note = chr12:113229420-113229494
  misc_feature 1..74: note = Hyper
  source 1..74: mol_type = genomic DNA

SEQ ID NO: 108158 - DNA, 821 bp, Homo sapiens
  misc_feature 1..821: note = chr12:113494306-113495127
  misc_feature 1..821: note = Hyper
  source 1..821: mol_type = genomic DNA
gacaaagattcaagccggtgactcctaaacatcccactccctgcctcacgctctgcttggggtcagaaggccccttggggtctcgggagggcctggccgaggatttggggcgccccgagactcgcgtgtcagcgccggtggcgctcagggccgagatctgtctcctccccttcctcctcctccgccccctcccctctccctcccggagcacggccgaggcctcctcccacccgcgagatcccggcggccgccagccggctcctgcgtccgtccgtcggccgggcagtctgtccacgcgcggaaagctcggcgcggcggccgaggggcctgggagggaacgggcgcggaggcgggaccgcggctccctcccactccggggggagcccaggaggcggcggtgctggagcgcgagccggagccggagccggagacgaagagaggcggtgagaacgcgggtgcttagggaccccacccccggctcccgctgggggcccgcgagcggctcggggacgtctgggctggggaagcggggctgttacccccagggcgggaggcagagacgatccagctcctggcttcgccccctccgcgacgcgacccccgaggggccctgggccgcgcctgcagcgccgcgcatccccgtgcttcccggcgcaccccagcgcacccggcatccccccggcagggcgagggccccgggggaagggaaggctccgggagccaaggagggcgccccccaggcggagagtctcggaaaaccgcgcccccggcccctgccttccctccaggcctgccccaagggaaagcgggcggggcgaccc

SEQ ID NO: 108159 - DNA, 632 bp, Homo sapiens; identical to SEQ ID NO: 73799
  misc_feature 1..632: note = chr12:113541503-113542135
  misc_feature 1..632: note = Hyper
  source 1..632: mol_type = genomic DNA

SEQ ID NO: 108160 - DNA, 385 bp, Homo sapiens; identical to SEQ ID NO: 73800
  misc_feature 1..385: note = chr12:113592078-113592463
  misc_feature 1..385: note = Hyper
  source 1..385: mol_type = genomic DNA

SEQ ID NO: 108161 - DNA, 36 bp, Homo sapiens; identical to SEQ ID NO: 43567
  misc_feature 1..36: note = chr12:113677751-113677787
  misc_feature 1..36: note = Hypo
  source 1..36: mol_type = genomic DNA

SEQ ID NO: 108162 - DNA, 30 bp, Homo sapiens; identical to SEQ ID NO: 73802
  misc_feature 1..30: note = chr12:113690294-113690324
  misc_feature 1..30: note = Hypo
  source 1..30: mol_type = genomic DNA

SEQ ID NO: 108163 - DNA, 155 bp, Homo sapiens; identical to SEQ ID NO: 73803
  misc_feature 1..155: note = chr12:113725857-113726012
  misc_feature 1..155: note = Hypo
  source 1..155: mol_type = genomic DNA

SEQ ID NO: 108164 - DNA, 36 bp, Homo sapiens; identical to SEQ ID NO: 43569
  misc_feature 1..36: note = chr12:113795723-113795759
  misc_feature 1..36: note = Hypo
  source 1..36: mol_type = genomic DNA

SEQ ID NO: 108165 - DNA, 30 bp, Homo sapiens; identical to SEQ ID NO: 73805
  misc_feature 1..30: note = chr12:113835162-113835192
  misc_feature 1..30: note = Hypo
  source 1..30: mol_type = genomic DNA

SEQ ID NO: 108166 - DNA, 149 bp, Homo sapiens; identical to SEQ ID NO: 73806
  misc_feature 1..149: note = chr12:113849535-113849684
  misc_feature 1..149: note = Hypo
  source 1..149: mol_type = genomic DNA

SEQ ID NO: 108167 - DNA, 2188 bp, Homo sapiens
  misc_feature 1..2188: note = chr12:113900165-113902353
  misc_feature 1..2188: note = Hyper
  source 1..2188: mol_type = genomic DNA
gcccagcaatcctggcgccccacccagggggagagcaggatgtgtgcgtgttcgagtccggcctgctccctcgggctcaacataaacgtcaaagtaaggaagagcgggagctggacccggctggccacttcctgacccacagccctattcctagagaagctgaccttgagcctcaagattggccaccagggagcgccagcgtgcaggtggctcggtctccctctcggtggctcccggttcacgcgagttcctcgctcgctctccgtcttctccctctggctgacgctgtctctccatctcctcctcatcttgccccctttcctctccctctctttcaatctctctccttttcttatcatctttttttttaaagacggggaaagcacagcgagaaataagattacaaaatgccactcggattgcagagagagggaaaaacaccgtctccgccccttggcctcaccctctctcagtccaaagaggtggcggtggctgggtgggtgggtgggggcccggggaaagtctagagcgtgctcgaaatctcttgaccctccggagtattgactttggtcccaagaaattgctcgcggttgctgggagagtactggcggtgggctgaggctcctggagagcccgcggggtggagatgggggtcggccccccctcggcgcccagccgaggagcagctgccagttgagtgcggacccgagagagaacccccgagggacacccacgtctcccaccgcgtctgcgtcgggcgttttggtttcaggaggctgcttcggggcggggcccccgggggccgagcgcggggggcggcccggcggccttaccacacggcggcttcgttgagctcggggttgggatgcgacaggggtccgctgtagccgctggtgccgctcattgggaagggcgggctgggcccgccgctgaatacctcgccgggcatggggtgcagcgtgcccggcaggcctggctcggggctcggtgtgtccgggtgcgagatcatgtcggtgaacctggggttgtccgcggcgtgcgggccggcgagcggcggttccagcgctcccagcggcgtcgagccggggccagaggccgccaggaagctggagtcggccggggactgcgcctgcgaaggcgggccgtgcgcgaagaagtcgtagttgcttcccggcgcgtagtagtcgccttggtagtctgcggagggggagcgggaaggagacagggcgcggtgagagaaggcgaagtaggcgggggacccgggacccggggaggggacccgggcgggcgagagaggggagcgcgcgacaccgacccaaggttagagagacctgcggaggccggcgccccttgagacggtggacgtcgcaggctcacggggagggttggggagagagacaatgagagatctcgaaagggcaagagactcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagtcgatgcgcccagagaacgcaagacggtggatcagagatgagtcccaggaacctccagagaagcggaggctgacaggcccggggagaggaaccgggcagggacaaaccagcggacagagcagagcgcgaaatggttgagaccgggaagcgacctggccgggggaaactggatccgggccgcggcaggagcgactggtgggttgggccgggcggggcggccttggcgccctaaactcggtccctgcgccctaccaacccagtccaagtccttcgcctcgccaagtacggccgccgcgtcgatcccggtgagaccatttgtaccggcctagcctagcc

SEQ ID NO: 108168 - DNA, 963 bp, Homo sapiens; identical to SEQ ID NO: 73811
  misc_feature 1..963: note = chr12:113902608-113903571
  misc_feature 1..963: note = Hyper
  source 1..963: mol_type = genomic DNA

SEQ ID NO: 108169 - DNA, 30 bp, Homo sapiens; identical to SEQ ID NO: 73812
  misc_feature 1..30: note = chr12:113903957-113903987
  misc_feature 1..30: note = Hyper
  source 1..30: mol_type = genomic DNA

SEQ ID NO: 108170 - DNA, 346 bp, Homo sapiens; identical to SEQ ID NO: 73813
  misc_feature 1..346: note = chr12:113904732-113905078
  misc_feature 1..346: note = Hyper
  source 1..346: mol_type = genomic DNA

SEQ ID NO: 108171 - DNA, 1054 bp, Homo sapiens; identical to SEQ ID NO: 73814
  misc_feature 1..1054: note = chr12:113905380-113906434
  misc_feature 1..1054: note = Hyper
  source 1..1054: mol_type = genomic DNA

SEQ ID NO: 108172 - DNA, 62 bp, Homo sapiens
  misc_feature 1..62: note = chr12:113906828-113906890
  misc_feature 1..62: note = Hyper
  source 1..62: mol_type = genomic DNA
gcacagacagcacaccgggggccaagtagggagtgccaggctgggcacggtgggagggtgct

SEQ ID NO: 108173 - DNA, 58 bp, Homo sapiens; identical to SEQ ID NO: 73816
  misc_feature 1..58: note = chr12:113907104-113907162
  misc_feature 1..58: note = Hyper
  source 1..58: mol_type = genomic DNA

SEQ ID NO: 108174 - DNA, 42 bp, Homo sapiens; identical to SEQ ID NO: 73817
  misc_feature 1..42: note = chr12:113908232-113908274
  misc_feature 1..42: note = Hyper
  source 1..42: mol_type = genomic DNA

SEQ ID NO: 108175 - DNA, 1955 bp, Homo sapiens
  misc_feature 1..1955: note = chr12:113908739-113910694
  misc_feature 1..1955: note = Hyper
  source 1..1955: mol_type = genomic DNA
cgagaagccttcaggcgtctctaactcatgcaaaaatccttcctctctctcgggacggggcttgaagcttctgtcttggggttgcagctgcttggaaggggcggagaggagtggatagcaagtttgtcagggcttcctccctctgccccgccagcgctctgagccggcctcgagccaacgtgaggcagcgaagcagcgtccttcttcctccgcctgggctcgggacctttcctggaccaaggacaggaggagagcaaagtgctgcccgctccccatctaagcttgtgatccggggaggctgggatggggatgggggtatccccttccccagcgccccagtggagcgcgcgcagggtgggcgcgcaggcagcagagcggcgcggcctcttacctgaaaaagtcatttttgcagtagagcttgccctcgcgcgagaagcacttctccgagaggttggttttgcactcgcagcactgaacacatttgatgtgccacgcgcggtccagcacgttcagcagaaagcggtcgaggatgggccgctcgcaaccggcgcagtgcaccatcatagccccgcgccccggcggcttcggccgccttgccctccctttgggcccctggccctcgggcctgccgggccctccgctgcccttcgcctcttgtctcagcagctgcagggcgagtctggtccggaccaagactcagccggtccagtccttgggcaatctctggcctggcgctgggctgcccggagtggggtggtggggggcgggtggcgttcacaacctcatgccacgggccgcacgccccggcgcctgttccgggcttccccaggtatctcgggtggctgctggcctcggcgctgcggagcggctttccccggtggcggaggcgccggcactttcccccactttcaagcggtccggatcctcatctttgtctggtcgccgcgtaattcgcgcatccttattcagatttggtgacgtggcgctgcacgtagggggcccagcggccaatgggcgcaccgtggccatggcaacctcttaaatttatagcatatctaaattggctacagcgttgctgtccggacagagcaaaaaaaacaaggcatcagtattgttgagtattagcttgtacctggttcggaggctaagtaagtatttaccttccagtttggggctgacggggcgggggcagcgcgaaacgaaaattgcgtctctcttcctctctctttctcctcacaaatatttgggggtcacgggttccaaggcctagtccgggaggtacccctgcccccttcgccatccctggaacttgcagaagttgccccacgccccacacttcgctccccttctccagcccagccagcccagattggattcccccacccccgcgccccctctgcgccctgaagctgcgtcagcgcggttctcccggctcctggagccggccccggcttctttttgtcatacacggggctggggcccagccgggcctttctcatggagagagctagtggagaccgcgcggcctgggtagttttccccgcccggccgccgagcccaggcccaggcccagggtggggaggcgggggagcaggaggggtgccatttggcctggtcccgaactccagagtttcaggcctgagtgcgctgctcacggggctctgagggagatgtggacagggggagattcagggtggacgggtcttcccgcagacagctcggaggtggcactcaccacgtctctcctttcctcgctgcaccttccagattccaggtcagcctatggggcactgtggtgagtgggtcgtacggctgaggcgggggacaccagcgactatgagagcgctgtttgtattcacgccgtgcgggctgggtgtgcaagttcgtcccctcattgggcgcaggagaagcggcgcacgtatgttccgtgctcggcagggcgcccagagtgtgag

SEQ ID NO: 108176 - DNA, 1699 bp, Homo sapiens
  misc_feature 1..1699: note = chr12:113912829-113914528
  misc_feature 1..1699: note = Hyper
  source 1..1699: mol_type = genomic DNA
agtcccctagagttgcgttgggggcctcatcctcagtacagctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgtagagttagtaatatgcggtttgcatattcccccttgagttcggtaattaattactggcgaggaggcgcacactagcctggggtgggagttttggggagcgctgagctggggcgtggggcatacctctcttgagttctccagcccgggacaccgggcagcggccggaatgagggcgcttccagaggtttggagctgacccacccgcgggttgaagaggtcgtttcagttgcacctccctattcctcaccggaaagcctccggcctgggagattctgcagccaagcaggaaagggggtcttctctggcagccagtgtctctcctggctcctcttaaagcatcctctccttcgaacggccgggagtggcagctttattgggaaacgcgcgctctgggggcccaggtggctggggggaccggagaggcgcgcgctttgcccacttctcttggtggcatcttgtgcgacccagcccgtcctctcccgacttcgatcattaccgctcccaccccaacacgcatacttcccccaccccacccccaagagccagcgcggctttaacattaaacaaacgcagcgagcgcctccgagctgcgctctcggccgggtctgcgcggcggcggcggcgttacaaattgtaaatttaaattgctcgccggattcattacctcccctctttgatttcagccagccgtgaaaaattatactggtgtaccactgagaaactgttttgccgcaaagagcctacgcctaatcactggctttctccctccgacaaaagtgtaattattttgtttggggtgtaaatataggccgcgcctcgcacacacactcagcgtcccgcagcgccgcagagcaccgcccgccgccggaaggaatcgggcccccgagtaggagcgggcgtgaaggctgagccccgctgtctggaggccggaggagagcggctggtgtggcgctccggcgagacccagcgagcccagcctctgccctccgcagttcgggtttgcccgagaacctcgggaccgcgcgctcccaggcgggccagagaggacgccggcggggtgcaatgggtgctcaggcctagacatccgggcagggatgcgagagggatggcgggggtgggagtggggtgggtggggggtggtggtgaattttctggggaacccttgggggtggccgtctgagagcggcccggagcccaggcggggagagtgtcctggcctgggtggaaccctgggaggcgggggcgtcgtggctggtgtgcc

SEQ ID NO: 108177 - DNA, 44 bp, Homo sapiens; identical to SEQ ID NO: 34663
  misc_feature 1..44: note = chr12:113916222-113916266
  misc_feature 1..44: note = Hyper
  source 1..44: mol_type = genomic DNA

SEQ ID NO: 108178 - DNA, 404 bp, Homo sapiens; identical to SEQ ID NO: 34664
  misc_feature 1..404: note = chr12:113916326-113916730
  misc_feature 1..404: note = Hyper
  source 1..404: mol_type = genomic DNA

SEQ ID NO: 108179 - DNA, 40 bp, Homo sapiens; identical to SEQ ID NO: 73828
  misc_feature 1..40: note = chr12:113916972-113917012
  misc_feature 1..40: note = Hyper
  source 1..40: mol_type = genomic DNA

SEQ ID NO: 108180 - DNA, 1079 bp, Homo sapiens
  misc_feature 1..1079: note = chr12:113917226-113918305
  misc_feature 1..1079: note = Hyper
  source 1..1079: mol_type = genomic DNA
ttggcgagtgagcttcgtgcacggcatttttcaccctctggaagaagccagatttcgggcaaggtagaacgtgagaagaatcccttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcccgggacgcggttgcgtcggaagaaacgctttctaatctttctagctccctggatttgaagttgcgggtcttggggcgaggcttagctggtctgggggtccttgcgtgtccacagccccggatacgcacccgcgaaacgttcgacatcgccgcttttttgttttgttttgctttgtttttttagtcgaaggcgaggcgttgtttggggacagatcgcggccggctggggcctcgggcagtgacagtgaaacgaattccaaacccattctgaactcgccatggcgctctcctgccctccaacacccaccccaaacaccgtgtaggcagaagcgaggttccccgtgaagccgggttaaaatcggcagctgagatgcggtgggatgggatcatagccgagttcggaggatgcggggagagaatagaaaaatctccatcgttctgctctgctctctttctttctcctctaagcaggtttgccggagaaggcaggggtgagccacggtggctgcccggctgtgcaccggcgccggagtttggaccaagacaaagacaggagctgtccgcggtgctgaatcggcggcgccgtcgccggagcaagggggcttctgtaaccagccctctgctcatttactccccatccttctagctccccttcgctctgtgactcttgccttcccctgaatttatttcccttttgggggactcaccttagaacctgcgccctgtacacaggtgtatatacatatatcaaagaacaaaacgattgattgaaaacggtgtcttctcctt

SEQ ID NO: 108181 - DNA, 254 bp, Homo sapiens; identical to SEQ ID NO: 73832
  misc_feature 1..254: note = chr12:113952930-113953184
  misc_feature 1..254: note = Hyper
  source 1..254: mol_type = genomic DNA

SEQ ID NO: 108182 - DNA, 42 bp, Homo sapiens; identical to SEQ ID NO: 34670
  misc_feature 1..42: note = chr12:113953467-113953509
  misc_feature 1..42: note = Hyper
  source 1..42: mol_type = genomic DNA

SEQ ID NO: 108183 - DNA, 425 bp, Homo sapiens; identical to SEQ ID NO: 73834
  misc_feature 1..425: note = chr12:113957582-113958007
  misc_feature 1..425: note = Hyper
  source 1..425: mol_type = genomic DNA

SEQ ID NO: 108184 - DNA, 30 bp, Homo sapiens; identical to SEQ ID NO: 73835
  misc_feature 1..30: note = chr12:113972789-113972819
  misc_feature 1..30: note = Hypo
  source 1..30: mol_type = genomic DNA

SEQ ID NO: 108185 - DNA, 61 bp, Homo sapiens; identical to SEQ ID NO: 73836
  misc_feature 1..61: note = chr12:114029358-114029419
  misc_feature 1..61: note = Hyper
  source 1..61: mol_type = genomic DNA

SEQ ID NO: 108186 - DNA, 249 bp, Homo sapiens; identical to SEQ ID NO: 73837
  misc_feature 1..249: note = chr12:114029630-114029879
  misc_feature 1..249: note = Hyper
  source 1..249: mol_type = genomic DNA

SEQ ID NO: 108187 - DNA, 313 bp, Homo sapiens
  misc_feature 1..313: note = chr12:114075780-114076093
  misc_feature 1..313: note = Hyper
  source 1..313: mol_type = genomic DNA
gctcgagttcaaggacgcagagaggacgggagggggttaaagcccattcaaacgcgcagccccccgcccccggctcgccccccactccccgccggccgcccgcatctgggcgcgcagaggaacagatttcgcgtttcacacagcgcacaatggccgccctcaaaggcgcgccgcccgcattgttcgggccggcgcccgcgcgtcctacctccgcgcgcgaattaacccccgtcaccccgccattgtcaccgcgcacttcggggccggccacaaaggcgccagaaaaccctgccgtgttcggaagggtgggggg

SEQ ID NO: 108188 - DNA, 84 bp, Homo sapiens; identical to SEQ ID NO: 73840
  misc_feature 1..84: note = chr12:114107345-114107429
  misc_feature 1..84: note = Hypo
  source 1..84: mol_type = genomic DNA

SEQ ID NO: 108189 - DNA, 153 bp, Homo sapiens; identical to SEQ ID NO: 73841
  misc_feature 1..153: note = chr12:114130067-114130220
  misc_feature 1..153: note = Hypo
  source 1..153: mol_type = genomic DNA

SEQ ID NO: 108190 - DNA, 109 bp, Homo sapiens; identical to SEQ ID NO: 73842
  misc_feature 1..109: note = chr12:114236423-114236532
  misc_feature 1..109: note = Hypo
  source 1..109: mol_type = genomic DNA

SEQ ID NO: 108191 - DNA, 242 bp, Homo sapiens; identical to SEQ ID NO: 73843
  misc_feature 1..242: note = chr12:114240196-114240438
  misc_feature 1..242: note = Hypo
  source 1..242: mol_type = genomic DNA

SEQ ID NO: 108192 - DNA, 84 bp, Homo sapiens; identical to SEQ ID NO: 73844
  misc_feature 1..84: note = chr12:114273766-114273850
  misc_feature 1..84: note = Hypo
  source 1..84: mol_type = genomic DNA

SEQ ID NO: 108193 - DNA, 44 bp, Homo sapiens; identical to SEQ ID NO: 73845
  misc_feature 1..44: note = chr12:114282443-114282487
  misc_feature 1..44: note = Hypo
  source 1..44: mol_type = genomic DNA

SEQ ID NO: 108194 - DNA, 249 bp, Homo sapiens; identical to SEQ ID NO: 73846
  misc_feature 1..249: note = chr12:114290668-114290917
  misc_feature 1..249: note = Hypo
  source 1..249: mol_type = genomic DNA

SEQ ID NO: 108195 - DNA, 44 bp, Homo sapiens; identical to SEQ ID NO: 73847
  misc_feature 1..44: note = chr12:114295503-114295547
  misc_feature 1..44: note = Hypo
  source 1..44: mol_type = genomic DNA

SEQ ID NO: 108196 - DNA, 152 bp, Homo sapiens; identical to SEQ ID NO: 43574
  misc_feature 1..152: note = chr12:114329563-114329715
  misc_feature 1..152: note = Hypo
  source 1..152: mol_type = genomic DNA

SEQ ID NO: 108197 - DNA, 30 bp, Homo sapiens; identical to SEQ ID NO: 73849
  misc_feature 1..30: note = chr12:114337104-114337134
  misc_feature 1..30: note = Hypo
  source 1..30: mol_type = genomic DNA

SEQ ID NO: 108198 - DNA, 58 bp, Homo sapiens; identical to SEQ ID NO: 73850
  misc_feature 1..58: note = chr12:114337939-114337997
  misc_feature 1..58: note = Hypo
  source 1..58: mol_type = genomic DNA

SEQ ID NO: 108199 - DNA, 32 bp, Homo sapiens; identical to SEQ ID NO: 73851
  misc_feature 1..32: note = chr12:114402798-114402830
  misc_feature 1..32: note = Hypo
  source 1..32: mol_type = genomic DNA

SEQ ID NO: 108200 - DNA, 390 bp, Homo sapiens; identical to SEQ ID NO: 73852
  misc_feature 1..390: note = chr12:114833759-114834149
  misc_feature 1..390: note = Hyper
  source 1..390: mol_type = genomic DNA

SEQ ID NO: 108201 - DNA, 30 bp, Homo sapiens; identical to SEQ ID NO: 34676
  misc_feature 1..30: note = chr12:114834466-114834496
  misc_feature 1..30: note = Hyper
  source 1..30: mol_type = genomic DNA

SEQ ID NO: 108202 - DNA, 577 bp, Homo sapiens
  misc_feature 1..577: note = chr12:114838325-114838902
  misc_feature 1..577: note = Hyper
  source 1..577: mol_type = genomic DNA
caagttggcagatctcggctcactcagcgatggcgggaacggtcgaatggaggcctctccctccgagccccggagccaaagcctcgcagtgtttatcagcctgagcgagcgcgcccggaggcggaggcgcagaagacttcgcaggccttttatagttaaatcctcacggctcaggctcggggggaaagagggactcggacgtgtctttccttcctgggggaataggaagaggactgcagttcgttgatataaacagaacgcgcctcctagttcactcaggccttgggccgagcggggagcagactttgtttaattttaaataataataaatgtcactgttgtcagtttattgagggaggcttcggctggagaacgggggcggggggcgtctggaaaggcggctccaccctcccccttcacacactcggtggcttgggcctaccgttcgcctgctccacacgcctgctcggggcatcctctggctttttgctttgcgggacgcggaagacccgtccagcacgggtagggatgtggccaggacgtccccaggcctgggcgcgcgcgtgcacatgctcac

SEQ ID NO: 108203 - DNA, 154 bp, Homo sapiens; identical to SEQ ID NO: 73855
  misc_feature 1..154: note = chr12:114841029-114841183
  misc_feature 1..154: note = Hyper
  source 1..154: mol_type = genomic DNA

SEQ ID NO: 108204 - DNA, 324 bp, Homo sapiens; identical to SEQ ID NO: 73856
  misc_feature 1..324: note = chr12:114841672-114841996
  misc_feature 1..324: note = Hyper
  source 1..324: mol_type = genomic DNA

SEQ ID NO: 108205 - DNA, 845 bp, Homo sapiens
  misc_feature 1..845: note = chr12:114842960-114843805
  misc_feature 1..845: note = Hyper
  source 1..845: mol_type = genomic DNA
atctagaaatggggccgaggagaaggacagcttctgaggcctgacttgcaagcagctttcttcgcctcgttctcggggcttcagggaggcggcgactggagccccgctgcctactcacaacaaaagaaagcagggctggcgcccctacacgcgctcccattcactgccggccgcggggagaatcctaccccgcgccctcgccagggtcccggggagctctgggctggcggaggcgaacaagatgcggtttgacagaaccaggccgtgcttctgcaaacctcaatgccgctccgccagccgcggcggcctcccagactccatttgccggggagctccgagccgcgcaaaatctctgcaagctgtgctctgcagaatgcaaagccgggctggaatccgccattcccgccgccccagccgactcggccgacgagctccctcctgagcctcccgggccatctgccgggacggttacctcgttcggtgaagccggtgcattcaccacatcctctgctgctcctagcagggaagccggcggtgaggcgggggagcaggcatggtggctccggggtttatgcggggtttactgcttacccagaatagcggctactgctgcctactagggcgcacctaccgctggagcctccgcggcgactgcccacctccaacacacacctcctctgctgtgcgcttgctctccctaaatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 108206 - DNA, 193 bp, Homo sapiens; identical to SEQ ID NO: 73859
  misc_feature 1..193: note = chr12:114844184-114844377
  misc_feature 1..193: note = Hyper
  source 1..193: mol_type = genomic DNA

SEQ ID NO: 108207 - DNA, 1809 bp, Homo sapiens
  misc_feature 1..1809: note = chr12:114845846-114847655
  misc_feature 1..1809: note = Hyper
  source 1..1809: mol_type = genomic DNA
aaagaggcaaccaggcgatagcgactatctcaccagccgctgcacctataggacttggagacgtcacgagtcacgcaaccggcccgcgcgctgtcacgtttggctggggggcagcggcgggaggtaaatttctctccgtcttcgcctatcagtgccgggtctgcgcagccacaggttccggacgtcttggccccgggaataaataaagacataaaccaacccggctttctccggaggaatgagggtgatgaacataagacacaaatagagccaagatcgactttcttaggaagggggagaggagggaactcttcacgaagggaggtgggagtccacctcagacctctattggaaggaaatcgagttgttccgggggactgaggtctcttgcataaggcatgggatccttattattattattattatttttaaatcccccgcggaggagctctgggcaaatgaataccgaggcgccgctctagctggttaggcttgggatgcgataactcagtgccctcttgcagacttgcatagaaataattactgggttgtcgtggaggggacacgagacagagggagttctccgtaatgtgccttgcggagagaaaggtccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcccggtcctgtaaggactggaacggcagcaaaatgtgcagggaggcagtcggccggcagagctgcggcgggagccaaggtcaggcccgcggggagagcgggcagcttccagcgccggccacaagctcccaggccagctgggccgcagacccctttgcttccagagagcacaacccgcgtcctttctctcagccaggctgcagtggctgccccgagcttcgctttcgtttcccaagctgttaataacgatatgtccccaaatccgaggctcgtgtttgctcccagatgccaagaacgcaacccgaaatccttctcccaaaccctaggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggaccggcattcaaaggattctgcaagtccagcttcacagactggctttcccagacgctccgaagcccgcaccacgaacagaataaaggagagacgagagatcgcaactagatttgagaatcctcgttcttttccccaatcgttcgggcagtaaactccggagccggctacagcgcgcatcctcccttcctcctttcggagaactgtcgctttcccgaagct

SEQ ID NO: 108208 - DNA, 142 bp, Homo sapiens; identical to SEQ ID NO: 73864
  misc_feature 1..142: note = chr12:114852047-114852189
  misc_feature 1..142: note = Hyper
  source 1..142: mol_type = genomic DNA

SEQ ID NO: 108209 - DNA, 244 bp, Homo sapiens; identical to SEQ ID NO: 73865
  misc_feature 1..244: note = chr12:114877144-114877388
  misc_feature 1..244: note = Hyper
  source 1..244: mol_type = genomic DNA

SEQ ID NO: 108210 - DNA, 768 bp, Homo sapiens
  misc_feature 1..768: note = chr12:114878244-114879012
  misc_feature 1..768: note = Hyper
  source 1..768: mol_type = genomic DNA
caaataatgtgtgtgcgcaaagacgtttctgtctacagataattacgcgtaaattatccgtggcaaacaacatatgcaaacgacatatgcaaacaacatatgcaaacgattatctatgtgcagataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtctcgatggttggtcagcgcgcgcatctgcggcactggctaaatcccgggaagcagcgcggagaaacaaaaagtgcttttcttccagccatgccttctccctgcggaaaccgcctgctccctgcgccgcacggaaagcagaaggcggaagggtgggttaggtgttctgggttctccggcctcctccaagcttcgtgctcggtgaggtacggcgcgttcaggttgctgcatcagtttgcacagcgctgtgccgcgctcagtcgggaattgccacagacgcccgatttcctcggtgccatgtgggctcctagctgccgccacagagcggccggatcctaccagggtttcccagtgcccgggtacctgcaagaatcttcccaggacgggagcagtgggcactgagcagcgctgccgggagaaagatgttgcgttttgccaagcgctcacccgcgcttcaaaacccca

SEQ ID NO: 108211 - DNA, 542 bp, Homo sapiens; identical to SEQ ID NO: 73868
  misc_feature 1..542: note = chr12:114881542-114882084
  misc_feature 1..542: note = Hyper
  source 1..542: mol_type = genomic DNA

SEQ ID NO: 108212 - DNA, 78 bp, Homo sapiens; identical to SEQ ID NO: 73869
  misc_feature 1..78: note = chr12:114882568-114882646
  misc_feature 1..78: note = Hyper
  source 1..78: mol_type = genomic DNA

SEQ ID NO: 108213 - DNA, 30 bp, Homo sapiens; identical to SEQ ID NO: 73870
  misc_feature 1..30: note = chr12:114883016-114883046
  misc_feature 1..30: note = Hyper
  source 1..30: mol_type = genomic DNA

SEQ ID NO: 108214 - DNA, 83 bp, Homo sapiens; identical to SEQ ID NO: 34694
  misc_feature 1..83: note = chr12:114883452-114883535
  misc_feature 1..83: note = Hyper
  source 1..83: mol_type = genomic DNA

SEQ ID NO: 108215 - DNA, 91 bp, Homo sapiens; identical to SEQ ID NO: 73872
  misc_feature 1..91: note = chr12:114883793-114883884
  misc_feature 1..91: note = Hyper
  source 1..91: mol_type = genomic DNA

SEQ ID NO: 108216 - DNA, 568 bp, Homo sapiens
  misc_feature 1..568: note = chr12:114885098-114885666
  misc_feature 1..568: note = Hyper
  source 1..568: mol_type = genomic DNA
gagaagccgcctcagcgagcctctgggctccgggccatgtgagccggttggccagagcctggcgggttccgtgcttggctagccagcggagcggggtgagagggtgagagaaggacgcttctcctttgattcgcagacccgggcgcagccggagaccgcccggcaccgcggcgtctgtctgtctgagcgcctactcgcgggtcctctgctgccccgagtgaactctaggcgcagctggaccggggtgagggcgcgcggtgagcccaggccaagcgctggaagaaacgaactgggggccgagttcgggcggcgatctgccggggacccagtcctgagcggcttgtttgggatactgggattaaggcctcagaggagcacatggctagcctctgcagccctcggagggtcactgacgccccctgcttttccttccaaatgtctttccccgaggctggggacacctgttctgagcagaagagggcaatggttcaacctgtttgaccccgcccgggtctccttctgcgggaacatacgccccagtcagctgaggtgccggctgactttcccc

SEQ ID NO: 108217 - DNA, 420 bp, Homo sapiens
  misc_feature 1..420: note = chr12:114886043-114886463
  misc_feature 1..420: note = Hyper
  source 1..420: mol_type = genomic DNA
agagaaaatgcggatcggaggtcaggtgcacccttaccggcaacttggggtacacaaccggggtcccagcatcacctcccctcgccccgcgctcatgtccccactctgaggcccgtgggcactgaggtggcaccgacctcccaggacccctgcattgcctcacactttcacttccctccctgctccgcagtgtccataaaataccagccgttcacctgcctatagcgaacggatccgagggtggaggcaatgacttacctggttgtgggtggatggatgaagaaggcctttacttggagcctaagccctggcgcgcgcgcaccacggcgcgaactgctccatcaagcatccactggcctccagccgcgtttccggttgtagcactgggcgcccccagagtggacccgataagctatcggc

SEQ ID NO: 108218 - DNA, 421 bp, Homo sapiens; identical to SEQ ID NO: 34699
  misc_feature 1..421: note = chr12:114917674-114918095
  misc_feature 1..421: note = Hyper
  source 1..421: mol_type = genomic DNA

SEQ ID NO: 108219 - DNA, 150 bp, Homo sapiens; identical to SEQ ID NO: 73877
  misc_feature 1..150: note = chr12:114918587-114918737
  misc_feature 1..150: note = Hyper
  source 1..150: mol_type = genomic DNA

SEQ ID NO: 108220 - DNA, 66 bp, Homo sapiens; identical to SEQ ID NO: 73878
  misc_feature 1..66: note = chr12:114939117-114939183
  misc_feature 1..66: note = Hyper
  source 1..66: mol_type = genomic DNA

SEQ ID NO: 108221 - DNA, 30 bp, Homo sapiens; identical to SEQ ID NO: 73879
  misc_feature 1..30: note = chr12:115106216-115106246
  misc_feature 1..30: note = Hyper
  source 1..30: mol_type = genomic DNA

SEQ ID NO: 108222 - DNA, 38 bp, Homo sapiens; identical to SEQ ID NO: 11459
  misc_feature 1..38: note = chr12:115106464-115106502
  misc_feature 1..38: note = Hyper
  source 1..38: mol_type = genomic DNA

SEQ ID NO: 108223 - DNA, 38 bp, Homo sapiens; identical to SEQ ID NO: 73881
  misc_feature 1..38: note = chr12:115120626-115120664
  misc_feature 1..38: note = Hyper
  source 1..38: mol_type = genomic DNA

SEQ ID NO: 108224 - DNA, 39 bp, Homo sapiens; identical to SEQ ID NO: 73882
  misc_feature 1..39: note = chr12:115121505-115121544
  misc_feature 1..39: note = Hyper
  source 1..39: mol_type = genomic DNA

SEQ ID NO: 108225 - DNA, 130 bp, Homo sapiens; identical to SEQ ID NO: 34702
  misc_feature 1..130: note = chr12:115121885-115122015
  misc_feature 1..130: note = Hyper
  source 1..130: mol_type = genomic DNA

SEQ ID NO: 108226 - DNA, 288 bp, Homo sapiens; identical to SEQ ID NO: 73884
  misc_feature 1..288: note = chr12:115122236-115122524
  misc_feature 1..288: note = Hyper
  source 1..288: mol_type = genomic DNA

SEQ ID NO: 108227 - DNA, 102 bp, Homo sapiens; identical to SEQ ID NO: 73885
  misc_feature 1..102: note = chr12:115130675-115130777
  misc_feature 1..102: note = Hyper
  source 1..102: mol_type = genomic DNA

SEQ ID NO: 108228 - DNA, 65 bp, Homo sapiens; identical to SEQ ID NO: 73886
  misc_feature 1..65: note = chr12:115135302-115135367
  misc_feature 1..65: note = Hyper
  source 1..65: mol_type = genomic DNA

SEQ ID NO: 108229 - DNA, 123 bp, Homo sapiens; identical to SEQ ID NO: 73887
  misc_feature 1..123: note = chr12:115136240-115136363
  misc_feature 1..123: note = Hyper
  source 1..123: mol_type = genomic DNA

SEQ ID NO: 108230 - DNA, 73 bp, Homo sapiens; identical to SEQ ID NO: 34704
  misc_feature 1..73: note = chr12:115889703-115889776
  misc_feature 1..73: note = Hyper
  source 1..73: mol_type = genomic DNA

SEQ ID NO: 108231 - DNA, 352 bp, Homo sapiens; identical to SEQ ID NO: 73891
  misc_feature 1..352: note = chr12:116755878-116756230
  misc_feature 1..352: note = Hypo
  source 1..352: mol_type = genomic DNA

SEQ ID NO: 108232 - DNA, 142 bp, Homo sapiens; identical to SEQ ID NO: 73892
  misc_feature 1..142: note = chr12:116842262-116842404
  misc_feature 1..142: note = Hypo
  source 1..142: mol_type = genomic DNA

SEQ ID NO: 108233 - DNA, 186 bp, Homo sapiens; identical to SEQ ID NO: 73893
  misc_feature 1..186: note = chr12:116941184-116941370
  misc_feature 1..186: note = Hypo
  source 1..186: mol_type = genomic DNA

SEQ ID NO: 108234 - DNA, 462 bp, Homo sapiens
  misc_feature 1..462: note = chr12:116946086-116946548
  misc_feature 1..462: note = Hyper
  source 1..462: mol_type = genomic DNA
tctgcaagctctcagcggctccagcgttttcaaggagcggggtcaaggtcaaagggcccctcccaggctgcccgggcggggctgtagtgggatgctggtccccaggctgcgcctcggttctccagggcgaaacgcaggggcggggccgtgcaggggctgggcgtcgccgccggagagggtcccagcgcgcccaggcctcccgcaggcgggacgcggcgtcggggggctgctgcgctgctcggccccagcgggcccgccgcgccgccgcggctctggctgcctcctgcatgccaattaggccctaatttgatttctgttctatctgtgcgaaccccattaaaacccaattccgcttattaccaacagctttcttgcaacgcgacgcctctccctcccagggccgctgctcaggcgcgccgaggagccaggctccgcgcaccaggctggcggggacaccttccc

SEQ ID NO: 108235 - DNA, 39 bp, Homo sapiens; identical to SEQ ID NO: 73896
  misc_feature 1..39: note = chr12:117155588-117155627
  misc_feature 1..39: note = Hypo
  source 1..39: mol_type = genomic DNA

SEQ ID NO: 108236 - DNA, 30 bp, Homo sapiens; identical to SEQ ID NO: 73897
  misc_feature 1..30: note = chr12:117157142-117157172
  misc_feature 1..30: note = Hypo
  source 1..30: mol_type = genomic DNA

SEQ ID NO: 108237 - DNA, 41 bp, Homo sapiens; identical to SEQ ID NO: 73898
  misc_feature 1..41: note = chr12:117300848-117300889
  misc_feature 1..41: note = Hypo
  source 1..41: mol_type = genomic DNA

SEQ ID NO: 108238 - DNA, 29 bp, Homo sapiens
  misc_feature 1..29: note = chr12:117316475-117316504
  misc_feature 1..29: note = Hyper
  source 1..29: mol_type = genomic DNA
gctgggaagccgagcggggcatcctgagg

SEQ ID NO: 108239 - DNA, 30 bp, Homo sapiens; identical to SEQ ID NO: 73899
  misc_feature 1..30: note = chr12:117316744-117316774
  misc_feature 1..30: note = Hyper
  source 1..30: mol_type = genomic DNA

SEQ ID NO: 108240 - DNA, 32 bp, Homo sapiens; identical to SEQ ID NO: 73900
  misc_feature 1..32: note = chr12:117317256-117317288
  misc_feature 1..32: note = Hyper
  source 1..32: mol_type = genomic DNA

SEQ ID NO: 108241 - DNA, 47 bp, Homo sapiens; identical to SEQ ID NO: 73901
  misc_feature 1..47: note = chr12:117318318-117318365
  misc_feature 1..47: note = Hyper
  source 1..47: mol_type = genomic DNA

SEQ ID NO: 108242 - DNA, 110 bp, Homo sapiens; identical to SEQ ID NO: 73902
  misc_feature 1..110: note = chr12:117319409-117319519
  misc_feature 1..110: note = Hyper
  source 1..110: mol_type = genomic DNA

SEQ ID NO: 108243 - DNA, 338 bp, Homo sapiens; identical to SEQ ID NO: 73903
  misc_feature 1..338: note = chr12:117319758-117320096
  misc_feature 1..338: note = Hyper
  source 1..338: mol_type = genomic DNA

SEQ ID NO: 108244 - DNA, 30 bp, Homo sapiens; identical to SEQ ID NO: 73904
  misc_feature 1..30: note = chr12:117408106-117408136
  misc_feature 1..30: note = Hypo
  source 1..30: mol_type = genomic DNA

SEQ ID NO: 108245 - DNA, 502 bp, Homo sapiens; identical to SEQ ID NO: 73906
  misc_feature 1..502: note = chr12:117472595-117473097
  misc_feature 1..502: note = Hypo
  source 1..502: mol_type = genomic DNA

SEQ ID NO: 108246 - DNA, 211 bp, Homo sapiens; identical to SEQ ID NO: 43581
  misc_feature 1..211: note = chr12:117473987-117474198
  misc_feature 1..211: note = Hypo
  source 1..211: mol_type = genomic DNA

SEQ ID NO: 108247 - DNA, 198 bp, Homo sapiens; identical to SEQ ID NO: 43582
  misc_feature 1..198: note = chr12:117474577-117474775
  misc_feature 1..198: note = Hypo
  source 1..198: mol_type = genomic DNA

SEQ ID NO: 108248 - DNA, 30 bp, Homo sapiens; identical to SEQ ID NO: 43583
  misc_feature 1..30: note = chr12:117484341-117484371
  misc_feature 1..30: note = Hypo
  source 1..30: mol_type = genomic DNA

SEQ ID NO: 108249 - DNA, 89 bp, Homo sapiens; identical to SEQ ID NO: 73910
  misc_feature 1..89: note = chr12:117498335-117498424
  misc_feature 1..89: note = Hypo
  source 1..89: mol_type = genomic DNA

SEQ ID NO: 108250 - DNA, 38 bp, Homo sapiens; identical to SEQ ID NO: 73911
  misc_feature 1..38: note = chr12:117512545-117512583
  misc_feature 1..38: note = Hypo
  source 1..38: mol_type = genomic DNA

SEQ ID NO: 108251 - DNA, 30 bp, Homo sapiens; identical to SEQ ID NO: 73912
  misc_feature 1..30: note = chr12:117512972-117513002
  misc_feature 1..30: note = Hypo
  source 1..30: mol_type = genomic DNA

SEQ ID NO: 108252 - DNA, 523 bp, Homo sapiens; identical to SEQ ID NO: 73913
  misc_feature 1..523: note = chr12:117529736-117530259
  misc_feature 1..523: note = Hypo
  source 1..523: mol_type = genomic DNA

SEQ ID NO: 108253 - DNA, 136 bp, Homo sapiens; identical to SEQ ID NO: 73914
  misc_feature 1..136: note = chr12:117530986-117531122
  misc_feature 1..136: note = Hypo
  source 1..136: mol_type = genomic DNA

SEQ ID NO: 108254 - DNA, 141 bp, Homo sapiens; identical to SEQ ID NO: 73915
  misc_feature 1..141: note = chr12:117532388-117532529
  misc_feature 1..141: note = Hypo
  source 1..141: mol_type = genomic DNA

SEQ ID NO: 108255 - DNA, 148 bp, Homo sapiens; identical to SEQ ID NO: 73916
  misc_feature 1..148: note = chr12:117533174-117533322
  misc_feature 1..148: note = Hypo
  source 1..148: mol_type = genomic DNA

SEQ ID NO: 108256 - DNA, 67 bp, Homo sapiens; identical to SEQ ID NO: 43588
  misc_feature 1..67: note = chr12:117544227-117544294
  misc_feature 1..67: note = Hypo
  source 1..67: mol_type = genomic DNA

SEQ ID NO: 108257 - DNA, 82 bp, Homo sapiens; identical to SEQ ID NO: 73918
  misc_feature 1..82: note = chr12:117563218-117563300
  misc_feature 1..82: note = Hypo
  source 1..82: mol_type = genomic DNA

SEQ ID NO: 108258 - DNA, 100 bp, Homo sapiens; identical to SEQ ID NO: 73919
  misc_feature 1..100: note = chr12:117564823-117564923
  misc_feature 1..100: note = Hypo
  source 1..100: mol_type = genomic DNA

SEQ ID NO: 108259 - DNA, 30 bp, Homo sapiens; identical to SEQ ID NO: 73920
  misc_feature 1..30: note = chr12:117669835-117669865
  misc_feature 1..30: note = Hypo
  source 1..30: mol_type = genomic DNA

SEQ ID NO: 108260 - DNA, 24 bp, Homo sapiens
  misc_feature 1..24: note = chr12:117716889-117716913
  misc_feature 1..24: note = Hypo
  source 1..24: mol_type = genomic DNA
aaatgatcaatgggccgggcgcgg

SEQ ID NO: 108261 - DNA, 152 bp, Homo sapiens; identical to SEQ ID NO: 73922
  misc_feature 1..152: note = chr12:117718680-117718832
  misc_feature 1..152: note = Hypo
  source 1..152: mol_type = genomic DNA

SEQ ID NO: 108262 - DNA, 34 bp, Homo sapiens; identical to SEQ ID NO: 73923
  misc_feature 1..34: note = chr12:117796936-117796970
  misc_feature 1..34: note = Hyper
  source 1..34: mol_type = genomic DNA

SEQ ID NO: 108263 - DNA, 36 bp, Homo sapiens; identical to SEQ ID NO: 73924
  misc_feature 1..36: note = chr12:117797434-117797470
  misc_feature 1..36: note = Hyper
  source 1..36: mol_type = genomic DNA

SEQ ID NO: 108264 - DNA, 1507 bp, Homo sapiens
  misc_feature 1..1507: note = chr12:117798084-117799591
  misc_feature 1..1507: note = Hyper
  source 1..1507: mol_type = genomic DNA
tggcgtcctctggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgcaaggaggctcctcgcaaagttggaggccaggccggagcgatgttccgggagcggagccctcccagcctcgggcccccagccgcggacagctggcagtgccaaagactccgccattacctgcggctcgcagttgcgattcggccgcagagtcgggcaccgaggaaggcgtaaagttgagcttgggcaggtacaacggtccccagggactggcatcccccagcccgggctgcccgcgggagggtagcgagctgtgccaagggctccgccattaccgccagcgcacagctcggagccaagcgcgcggctgaggaacgactagggtcttgcaaagttggagcctgggcgcgtagacccccggaccggagcccccggcctgaggccgcccgctaggaggaaaatgaggccgcccgaaccaagttgggacgcgcagcaaagcccgagccttccgcgcacaccaggggctcgggcgggagcggggagccctggggacggagaaggggcgcgggacgcctggatcaggaactcacctgacgccgagccgggcagcgccgaggctgcctcttcgcgctgcgcacccgcccgcccgcctcgtactcctcctcttcctcccgggcgcccgcggccgccgcgctccgggttctgaatcctccgagtccgccgccccgcgcggctggagggcgccggttgcacccactcgcctcctggtaggagccgcgcgcgtccctccccttcccctccgctttgtgcctccaagatccctccccaccccctctcccctagcccccactcctcccttctcttcttccctccccttgcgtcccctccctcagcctcagcgaacccaagttcgggacggaggctgcgggcttccccggcgcagtgctgggcgccccgcgcgcgcccctggctcaccccgtccgctcggccgctgctcgctgcccggccgcccctcggaggagccgcggcgctaagtagctcctcacccagcggctggaaacgcggcataaatatgtagggactgagccgtgagctcagcgagggtcgtgagggggaatttatttcttaatgtccctcctttatcctatcatcactgaaacgaattagcagtgacgtccaacccgactggtttatgggtgtggggagggagacgtcgcaaccctcattaaaagagccgctctgggctccaa

SEQ ID NO: 108265 - DNA, 36 bp, Homo sapiens; identical to SEQ ID NO: 73928
  misc_feature 1..36: note = chr12:118177132-118177168
  misc_feature 1..36: note = Hypo
  source 1..36: mol_type = genomic DNA

SEQ ID NO: 108266 - DNA, 265 bp, Homo sapiens; identical to SEQ ID NO: 73929
  misc_feature 1..265: note = chr12:118198608-118198873
  misc_feature 1..265: note = Hypo
  source 1..265: mol_type = genomic DNA

SEQ ID NO: 108267 - DNA, 45 bp, Homo sapiens; identical to SEQ ID NO: 73930
  misc_feature 1..45: note = chr12:118324438-118324483
  misc_feature 1..45: note = Hypo
  source 1..45: mol_type = genomic DNA

SEQ ID NO: 108268 - DNA, 30 bp, Homo sapiens; identical to SEQ ID NO: 73931
  misc_feature 1..30: note = chr12:118331639-118331669
  misc_feature 1..30: note = Hypo
  source 1..30: mol_type = genomic DNA

SEQ ID NO: 108269 - DNA, 16 bp, Homo sapiens
  misc_feature 1..16: note = chr12:118711017-118711033
  misc_feature 1..16: note = Hypo
  source 1..16: mol_type = genomic DNA
aaaaaatagggccagc

SEQ ID NO: 108270 - DNA, 157 bp, Homo sapiens; identical to SEQ ID NO: 73933
  misc_feature 1..157: note = chr12:118795285-118795442
  misc_feature 1..157: note = Hyper
  source 1..157: mol_type = genomic DNA

SEQ ID NO: 108271 - DNA, 30 bp, Homo sapiens; identical to SEQ ID NO: 73934
  misc_feature 1..30: note = chr12:118830447-118830477
  misc_feature 1..30: note = Hypo
  source 1..30: mol_type = genomic DNA

SEQ ID NO: 108272 - DNA, 39 bp, Homo sapiens; identical to SEQ ID NO: 43592
  misc_feature 1..39: note = chr12:118860397-118860436
  misc_feature 1..39: note = Hypo
  source 1..39: mol_type = genomic DNA

SEQ ID NO: 108273 - DNA, 294 bp, Homo sapiens
  misc_feature 1..294: note = chr12:119212112-119212406
  misc_feature 1..294: note = Hyper
  source 1..294: mol_type = genomic DNA
cggggcgtttgaacacgaatttggaggtccttgtttgtccttgaacgcggcagggagtggaggaaggcgccgggaggaggcacaaaatcgctttgtgcgacagcgcccgacagcttctccgcccggagccggctccgccgtgaatgggccgcggacaaaggcgtcccctcccaagtacctgtaattggagcgtccatgtgcgcgggcgctgctgaaatgcaatggacaaaagggagaggaatggccgcatcttccggctgcccgttgctatggtttccgcggagctggtgaagg

SEQ ID NO: 108274 - DNA, 99 bp, Homo sapiens; identical to SEQ ID NO: 73938
  misc_feature 1..99: note = chr12:119417727-119417826
  misc_feature 1..99: note = Hyper
  source 1..99: mol_type = genomic DNA

SEQ ID NO: 108275 - DNA, 1307 bp, Homo sapiens
  misc_feature 1..1307: note = chr12:119418516-119419823
  misc_feature 1..1307: note = Hyper
  source 1..1307: mol_type = genomic DNA
aaaagtggctgcaggcggattccccaggagtggatgggggtggggtggggtgagatgggaactctttcctctggacggggttggcggcggggacgctgggcaggccggctgtgagacacaaaagagatacccttgacagctccgcatgcacagatgtaacgctgcgccccttggcgggcgggggccctgctcggcagatggcgagaagccgaattggtgagggattgtctatcaaatggcactttctgggtggtggagacctcgctaacccccggcgcaaagaggaacgcagggcaccctctgtaccggcctaggccgtgtctcccaaaagtgagggtctgggggaggccggctggggtggatagattaagttttttacgagcccccccaaccccccccccccccccacgcagaagatcagctacaagacttgcgaaggggctggaaagaaaggtggcctggcccaaagggggcacccaggaaagggctgaggaaggccagcgatgatgggagaggagaggggcctgggaagcaggatctcctgcctggcgcagattggggtgccaggatggcttctcagagggatcagcgctgcaactcggtcgccgcggggccctggtgacaggcgcacgccccgccctttctcctcccaagacctgcgggcttttgttatgcagatggcggcaggaggctgagcctgaggaggagggggttggtggggaggaggagagacggagaggggggaggaaagtgcagctcgcgcgaccagcctcctcttccaacgtcacattgtgcgagagacaaaacccgggcgcgccggagctcacacgcgcacgcacacacatccgaccccgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggtaat

SEQ ID NO: 108276 - DNA, 80 bp, Homo sapiens; identical to SEQ ID NO: 73941
  misc_feature 1..80: note = chr12:119446570-119446650
  misc_feature 1..80: note = Hyper
  source 1..80: mol_type = genomic DNA

SEQ ID NO: 108277 - DNA, 91 bp, Homo sapiens; identical to SEQ ID NO: 34717
  misc_feature 1..91: note = chr12:119458719-119458810
  misc_feature 1..91: note = Hyper
  source 1..91: mol_type = genomic DNA

SEQ ID NO: 108278 - DNA, 318 bp, Homo sapiens; identical to SEQ ID NO: 73943
  misc_feature 1..318: note = chr12:119499049-119499367
  misc_feature 1..318: note = Hyper
  source 1..318: mol_type = genomic DNA

SEQ ID NO: 108279 - DNA, 83 bp, Homo sapiens; identical to SEQ ID NO: 73944
  misc_feature 1..83: note = chr12:119616507-119616590
  misc_feature 1..83: note = Hyper
  source 1..83: mol_type = genomic DNA

SEQ ID NO: 108280 - DNA, 32 bp, Homo sapiens; identical to SEQ ID NO: 73945
  misc_feature 1..32: note = chr12:119730037-119730069
  misc_feature 1..32: note = Hypo
  source 1..32: mol_type = genomic DNA

SEQ ID NO: 108281 - DNA, 36 bp, Homo sapiens; identical to SEQ ID NO: 73946
  misc_feature 1..36: note = chr12:120001632-120001668
  misc_feature 1..36: note = Hypo
  source 1..36: mol_type = genomic DNA

SEQ ID NO: 108282 - DNA, 380 bp, Homo sapiens; identical to SEQ ID NO: 73947
  misc_feature 1..380: note = chr12:120031519-120031899
  misc_feature 1..380: note = Hyper
  source 1..380: mol_type = genomic DNA

SEQ ID NO: 108283 - DNA, 1064 bp, Homo sapiens
  misc_feature 1..1064: note = chr12:120032256-120033320
  misc_feature 1..1064: note = Hyper
  source 1..1064: mol_type = genomic DNA
agcatgcaggctctacgttcctttccctgccgctccgggggctcctgctctccagcgcccaggactgtctctatctcagcctgtgctcccttctctctttgctgcgcccaagggcaccgcttccgccactctccggggggtccccaggcgattcctgatgccccctccttgatcccgtttccgcgctttggcacggcacgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgcagagccctgattcagcgctgtgaaaatcgctagccacccgtcccccatcaagtccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 108284 - DNA, 25 bp, Homo sapiens
  misc_feature 1..25: note = chr12:120087669-120087694
  misc_feature 1..25: note = Hypo
  source 1..25: mol_type = genomic DNA
aaaaaaaaaaagggccgggcgcgtt

SEQ ID NO: 108285 - DNA, 184 bp, Homo sapiens; identical to SEQ ID NO: 73952
  misc_feature 1..184: note = chr12:120148212-120148396
  misc_feature 1..184: note = Hypo
  source 1..184: mol_type = genomic DNA

SEQ ID NO: 108286 - DNA, 380 bp, Homo sapiens; identical to SEQ ID NO: 73953
  misc_feature 1..380: note = chr12:120148731-120149111
  misc_feature 1..380: note = Hypo
  source 1..380: mol_type = genomic DNA

SEQ ID NO: 108287 - DNA, 54 bp, Homo sapiens; identical to SEQ ID NO: 73954
  misc_feature 1..54: note = chr12:120152051-120152105
  misc_feature 1..54: note = Hypo
  source 1..54: mol_type = genomic DNA

SEQ ID NO: 108288 - DNA, 81 bp, Homo sapiens; identical to SEQ ID NO: 73955
  misc_feature 1..81: note = chr12:120173056-120173137
  misc_feature 1..81: note = Hypo
  source 1..81: mol_type = genomic DNA

SEQ ID NO: 108289 - DNA, 30 bp, Homo sapiens; identical to SEQ ID NO: 73956
  misc_feature 1..30: note = chr12:120353676-120353706
  misc_feature 1..30: note = Hypo
  source 1..30: mol_type = genomic DNA

SEQ ID NO: 108290 - DNA, 22 bp, Homo sapiens
  misc_feature 1..22: note = chr12:120411854-120411876
  misc_feature 1..22: note = Hypo
  source 1..22: mol_type = genomic DNA
aggcgcggtggctcacgcctgt

SEQ ID NO: 108291 - DNA, 67 bp, Homo sapiens; identical to SEQ ID NO: 73958
  misc_feature 1..67: note = chr12:120574326-120574393
  misc_feature 1..67: note = Hypo
  source 1..67: mol_type = genomic DNA

SEQ ID NO: 108292 - DNA, 63 bp, Homo sapiens; identical to SEQ ID NO: 43596
  misc_feature 1..63: note = chr12:120580446-120580509
  misc_feature 1..63: note = Hypo
  source 1..63: mol_type = genomic DNA

SEQ ID NO: 108293 - DNA, 30 bp, Homo sapiens; identical to SEQ ID NO: 73960
  misc_feature 1..30: note = chr12:120620325-120620355
  misc_feature 1..30: note = Hypo
  source 1..30: mol_type = genomic DNA

SEQ ID NO: 108294 - DNA, 30 bp, Homo sapiens; identical to SEQ ID NO: 73961
  misc_feature 1..30: note = chr12:120661930-120661960
  misc_feature 1..30: note = Hypo
  source 1..30: mol_type = genomic DNA

SEQ ID NO: 108295 - DNA, 30 bp, Homo sapiens; identical to SEQ ID NO: 73962
  misc_feature 1..30: note = chr12:120724619-120724649
  misc_feature 1..30: note = Hypo
  source 1..30: mol_type = genomic DNA

SEQ ID NO: 108296 - DNA, 42 bp, Homo sapiens; identical to SEQ ID NO: 73963
  misc_feature 1..42: note = chr12:120728061-120728103
  misc_feature 1..42: note = Hypo
  source 1..42: mol_type = genomic DNA

SEQ ID NO: 108297 - DNA, 30 bp, Homo sapiens; identical to SEQ ID NO: 43597
  misc_feature 1..30: note = chr12:120740933-120740963
  misc_feature 1..30: note = Hypo
  source 1..30: mol_type = genomic DNA

SEQ ID NO: 108298 - DNA, 30 bp, Homo sapiens; identical to SEQ ID NO: 73965
  misc_feature 1..30: note = chr12:120750504-120750534
  misc_feature 1..30: note = Hypo
  source 1..30: mol_type = genomic DNA

SEQ ID NO: 108299 - DNA, 26 bp, Homo sapiens
  misc_feature 1..26: note = chr12:120758797-120758823
  misc_feature 1..26: note = Hypo
  source 1..26: mol_type = genomic DNA
tttagaaaagaaagtcgtggccgtgt

SEQ ID NO: 108300 - DNA, 444 bp, Homo sapiens; identical to SEQ ID NO: 73967
  misc_feature 1..444: note = chr12:120806287-120806731
  misc_feature 1..444: note = Hyper
  source 1..444: mol_type = genomic DNA

SEQ ID NO: 108301 - DNA, 580 bp, Homo sapiens; identical to SEQ ID NO: 73968
  misc_feature 1..580: note = chr12:120807457-120808037
  misc_feature 1..580: note = Hyper
  source 1..580: mol_type = genomic DNA

SEQ ID NO: 108302 - DNA, 165 bp, Homo sapiens; identical to SEQ ID NO: 73969
  misc_feature 1..165: note = chr12:120826806-120826971
  misc_feature 1..165: note = Hyper
  source 1..165: mol_type = genomic DNA

SEQ ID NO: 108303 - DNA, 26 bp, Homo sapiens
  misc_feature 1..26: note = chr12:120868614-120868640
  misc_feature 1..26: note = Hypo
  source 1..26: mol_type = genomic DNA
tttttttttttgagacggagtttcgc

SEQ ID NO: 108304 - DNA, 20 bp, Homo sapiens
  misc_feature 1..20: note = chr12:120877324-120877344
  misc_feature 1..20: note = Hypo
  source 1..20: mol_type = genomic DNA
aactccgtctcaaaaaaaaa

SEQ ID NO: 108305 - DNA, 27 bp, Homo sapiens
  misc_feature 1..27: note = chr12:120885154-120885181
  misc_feature 1..27: note = Hypo
  source 1..27: mol_type = genomic DNA
ggtgtgagccaccgcgcctggcctaat

SEQ ID NO: 108306 - DNA, 42 bp, Homo sapiens; identical to SEQ ID NO: 43598
  misc_feature 1..42: note = chr12:120932999-120933041
  misc_feature 1..42: note = Hypo
  source 1..42: mol_type = genomic DNA

SEQ ID NO: 108307 - DNA, 62 bp, Homo sapiens; identical to SEQ ID NO: 73974
  misc_feature 1..62: note = chr12:121163445-121163507
  misc_feature 1..62: note = Hyper
  source 1..62: mol_type = genomic DNA

SEQ ID NO: 108308 - DNA, 30 bp, Homo sapiens; identical to SEQ ID NO: 73975
  misc_feature 1..30: note = chr12:121163726-121163756
  misc_feature 1..30: note = Hyper
  source 1..30: mol_type = genomic DNA

SEQ ID NO: 108309 - DNA, 30 bp, Homo sapiens; identical to SEQ ID NO: 73976
  misc_feature 1..30: note = chr12:121197853-121197883
  misc_feature 1..30: note = Hypo
  source 1..30: mol_type = genomic DNA

SEQ ID NO: 108310 - DNA, 30 bp, Homo sapiens; identical to SEQ ID NO: 73977
  misc_feature 1..30: note = chr12:121204975-121205005
  misc_feature 1..30: note = Hypo
  source 1..30: mol_type = genomic DNA

SEQ ID NO: 108311 - DNA, 30 bp, Homo sapiens; identical to SEQ ID NO: 73978
  misc_feature 1..30: note = chr12:121211742-121211772
  misc_feature 1..30: note = Hypo
  source 1..30: mol_type = genomic DNA

SEQ ID NO: 108312 - DNA, 209 bp, Homo sapiens; identical to SEQ ID NO: 73979
  misc_feature 1..209: note = chr12:121366974-121367183
  misc_feature 1..209: note = Hypo
  source 1..209: mol_type = genomic DNA

SEQ ID NO: 108313 - DNA, 169 bp, Homo sapiens; identical to SEQ ID NO: 73980
  misc_feature 1..169: note = chr12:121394362-121394531
  misc_feature 1..169: note = Hypo
  source 1..169: mol_type = genomic DNA

SEQ ID NO: 108314 - DNA, 191 bp, Homo sapiens; identical to SEQ ID NO: 34727
  misc_feature 1..191: note = chr12:121566850-121567041
  misc_feature 1..191: note = Hyper
  source 1..191: mol_type = genomic DNA

SEQ ID NO: 108315 - DNA, 93 bp, Homo sapiens; identical to SEQ ID NO: 73982
  misc_feature 1..93: note = chr12:121622470-121622563
  misc_feature 1..93: note = Hypo
  source 1..93: mol_type = genomic DNA

SEQ ID NO: 108316 - DNA, 30 bp, Homo sapiens; identical to SEQ ID NO: 43600
  misc_feature 1..30: note = chr12:121641645-121641675
  misc_feature 1..30: note = Hypo
  source 1..30: mol_type = genomic DNA

SEQ ID NO: 108317 - DNA, 30 bp, Homo sapiens; identical to SEQ ID NO: 73984
  misc_feature 1..30: note = chr12:121653407-121653437
  misc_feature 1..30: note = Hypo
  source 1..30: mol_type = genomic DNA

SEQ ID NO: 108318 - DNA, 44 bp, Homo sapiens; identical to SEQ ID NO: 73985
  misc_feature 1..44: note = chr12:121667860-121667904
  misc_feature 1..44: note = Hypo
  source 1..44: mol_type = genomic DNA

SEQ ID NO: 108319 - DNA, 30 bp, Homo sapiens; identical to SEQ ID NO: 43601
  misc_feature 1..30: note = chr12:121688301-121688331
  misc_feature 1..30: note = Hypo
  source 1..30: mol_type = genomic DNA

SEQ ID NO: 108320 - DNA, 30 bp, Homo sapiens; identical to SEQ ID NO: 73987
  misc_feature 1..30: note = chr12:121740282-121740312
  misc_feature 1..30: note = Hypo
  source 1..30: mol_type = genomic DNA

SEQ ID NO: 108321 - DNA, 82 bp, Homo sapiens; identical to SEQ ID NO: 43602
  misc_feature 1..82: note = chr12:122107201-122107283
  misc_feature 1..82: note = Hypo
  source 1..82: mol_type = genomic DNA

SEQ ID NO: 108322 - DNA, 46 bp, Homo sapiens; identical to SEQ ID NO: 15700
  misc_feature 1..46: note = chr12:122141060-122141106
  misc_feature 1..46: note = Hypo
  source 1..46: mol_type = genomic DNA

SEQ ID NO: 108323 - DNA, 30 bp, Homo sapiens; identical to SEQ ID NO: 73990
  misc_feature 1..30: note = chr12:122186181-122186211
  misc_feature 1..30: note = Hypo
  source 1..30: mol_type = genomic DNA

SEQ ID NO: 108324 - DNA, 30 bp, Homo sapiens; identical to SEQ ID NO: 73991
  misc_feature 1..30: note = chr12:122192959-122192989
  misc_feature 1..30: note = Hypo
  source 1..30: mol_type = genomic DNA

SEQ ID NO: 108325 - DNA, 81 bp, Homo sapiens; identical to SEQ ID NO: 73992
  misc_feature 1..81: note = chr12:122204974-122205055
  misc_feature 1..81: note = Hypo
  source 1..81: mol_type = genomic DNA

SEQ ID NO: 108326 - DNA, 200 bp, Homo sapiens; identical to SEQ ID NO: 73993
  misc_feature 1..200: note = chr12:122205355-122205555
  misc_feature 1..200: note = Hypo
  source 1..200: mol_type = genomic DNA

SEQ ID NO: 108327 - DNA, 66 bp, Homo sapiens; identical to SEQ ID NO: 73994
  misc_feature 1..66: note = chr12:122208388-122208454
  misc_feature 1..66: note = Hypo
  source 1..66: mol_type = genomic DNA

SEQ ID NO: 108328 - DNA, 30 bp, Homo sapiens; identical to SEQ ID NO: 73995
  misc_feature 1..30: note = chr12:122208777-122208807
  misc_feature 1..30: note = Hypo
  source 1..30: mol_type = genomic DNA

SEQ ID NO: 108329 - DNA, 123 bp, Homo sapiens; identical to SEQ ID NO: 73996
  misc_feature 1..123: note = chr12:122212425-122212548
  misc_feature 1..123: note = Hypo
  source 1..123: mol_type = genomic DNA

SEQ ID NO: 108330 - DNA, 85 bp, Homo sapiens; identical to SEQ ID NO: 43605
  misc_feature 1..85: note = chr12:122213608-122213693
  misc_feature 1..85: note = Hypo
  source 1..85: mol_type = genomic DNA

SEQ ID NO: 108331 - DNA, 30 bp, Homo sapiens; identical to SEQ ID NO: 73998
  misc_feature 1..30: note = chr12:122219029-122219059
  misc_feature 1..30: note = Hypo
  source 1..30: mol_type = genomic DNA

SEQ ID NO: 108332 - DNA, 176 bp, Homo sapiens; identical to SEQ ID NO: 73999
  misc_feature 1..176: note = chr12:122231347-122231523
  misc_feature 1..176: note = Hyper
  source 1..176: mol_type = genomic DNA

SEQ ID NO: 108333 - DNA, 166 bp, Homo sapiens; identical to SEQ ID NO: 43606
  misc_feature 1..166: note = chr12:122281163-122281329
  misc_feature 1..166: note = Hypo
  source 1..166: mol_type = genomic DNA

SEQ ID NO: 108334 - DNA, 139 bp, Homo sapiens; identical to SEQ ID NO: 74001
  misc_feature 1..139: note = chr12:122284969-122285108
  misc_feature 1..139: note = Hypo
  source 1..139: mol_type = genomic DNA

SEQ ID NO: 108335 - DNA, 30 bp, Homo sapiens; identical to SEQ ID NO: 15703
  misc_feature 1..30: note = chr12:122292767-122292797
  misc_feature 1..30: note = Hypo
  source 1..30: mol_type = genomic DNA

SEQ ID NO: 108336 - DNA, 21 bp, Homo sapiens
  misc_feature 1..21: note = chr12:122301174-122301195
  misc_feature 1..21: note = Hypo
  source 1..21: mol_type = genomic DNA
ccactgcgcccagccagctct

SEQ ID NO: 108337 - DNA, 140 bp, Homo sapiens; identical to SEQ ID NO: 74004
  misc_feature 1..140: note = chr12:122343727-122343867
  misc_feature 1..140: note = Hypo
  source 1..140: mol_type = genomic DNA

SEQ ID NO: 108338 - DNA, 112 bp, Homo sapiens; identical to SEQ ID NO: 43609
  misc_feature 1..112: note = chr12:122439399-122439511
  misc_feature 1..112: note = Hypo
  source 1..112: mol_type = genomic DNA

SEQ ID NO: 108339 - DNA, 53 bp, Homo sapiens; identical to SEQ ID NO: 43610
  misc_feature 1..53: note = chr12:122458643-122458696
  misc_feature 1..53: note = Hypo
  source 1..53: mol_type = genomic DNA

SEQ ID NO: 108340 - DNA, 30 bp, Homo sapiens; identical to SEQ ID NO: 74007
  misc_feature 1..30: note = chr12:122487551-122487581
  misc_feature 1..30: note = Hypo
  source 1..30: mol_type = genomic DNA

SEQ ID NO: 108341 - DNA, 68 bp, Homo sapiens; identical to SEQ ID NO: 74008
  misc_feature 1..68: note = chr12:122591572-122591640
  misc_feature 1..68: note = Hypo
  source 1..68: mol_type = genomic DNA

SEQ ID NO: 108342 - DNA, 23 bp, Homo sapiens
  misc_feature 1..23: note = chr12:122596891-122596914
  misc_feature 1..23: note = Hypo
  source 1..23: mol_type = genomic DNA
aatgtatgtacaggccgggcgtg

SEQ ID NO: 108343 - DNA, 86 bp, Homo sapiens; identical to SEQ ID NO: 74010
  misc_feature 1..86: note = chr12:122602862-122602948
  misc_feature 1..86: note = Hypo
  source 1..86: mol_type = genomic DNA

SEQ ID NO: 108344 - DNA, 352 bp, Homo sapiens; identical to SEQ ID NO: 74011
  misc_feature 1..352: note = chr12:122622033-122622385
  misc_feature 1..352: note = Hypo
  source 1..352: mol_type = genomic DNA

SEQ ID NO: 108345 - DNA, 48 bp, Homo sapiens; identical to SEQ ID NO: 74012
  misc_feature 1..48: note = chr12:122622594-122622642
  misc_feature 1..48: note = Hypo
  source 1..48: mol_type = genomic DNA

SEQ ID NO: 108346 - DNA, 114 bp, Homo sapiens; identical to SEQ ID NO: 74013
  misc_feature 1..114: note = chr12:122623990-122624104
  misc_feature 1..114: note = Hypo
  source 1..114: mol_type = genomic DNA

SEQ ID NO: 108347 - DNA, 30 bp, Homo sapiens; identical to SEQ ID NO: 74014
  misc_feature 1..30: note = chr12:122643546-122643576
  misc_feature 1..30: note = Hypo
  source 1..30: mol_type = genomic DNA

SEQ ID NO: 108348 - DNA, 33 bp, Homo sapiens; identical to SEQ ID NO: 74015
  misc_feature 1..33: note = chr12:122658513-122658546
  misc_feature 1..33: note = Hypo
  source 1..33: mol_type = genomic DNA

SEQ ID NO: 108349 - DNA, 163 bp, Homo sapiens; identical to SEQ ID NO: 74016
  misc_feature 1..163: note = chr12:122667736-122667899
  misc_feature 1..163: note = Hyper
  source 1..163: mol_type = genomic DNA

SEQ ID NO: 108350 - DNA, 573 bp, Homo sapiens; identical to SEQ ID NO: 74017
  misc_feature 1..573: note = chr12:122688648-122689221
  misc_feature 1..573: note = Hyper
  source 1..573: mol_type = genomic DNA

SEQ ID NO: 108351 - DNA, 42 bp, Homo sapiens; identical to SEQ ID NO: 74018
  misc_feature 1..42: note = chr12:122691182-122691224
  misc_feature 1..42: note = Hypo
  source 1..42: mol_type = genomic DNA

SEQ ID NO: 108352 - DNA, 30 bp, Homo sapiens; identical to SEQ ID NO: 74019
  misc_feature 1..30: note = chr12:122958549-122958579
  misc_feature 1..30: note = Hypo
  source 1..30: mol_type = genomic DNA

SEQ ID NO: 108353 - DNA, 180 bp, Homo sapiens; identical to SEQ ID NO: 74020
  misc_feature 1..180: note = chr12:123128959-123129139
  misc_feature 1..180: note = Hypo
  source 1..180: mol_type = genomic DNA

SEQ ID NO: 108354 - DNA, 29 bp, Homo sapiens
  misc_feature 1..29: note = chr12:123233817-123233846
  misc_feature 1..29: note = Hypo
  source 1..29: mol_type = genomic DNA
tcagccaccgcgcccgccctattactatt

SEQ ID NO: 108355 - DNA, 171 bp, Homo sapiens; identical to SEQ ID NO: 74022
  misc_feature 1..171: note = chr12:123333222-123333393
  misc_feature 1..171: note = Hypo
  source 1..171: mol_type = genomic DNA

SEQ ID NO: 108356 - DNA, 16 bp, Homo sapiens
  misc_feature 1..16: note = chr12:123373979-123373995
  misc_feature 1..16: note = Hypo
  source 1..16: mol_type = genomic DNA
cagtttcaggccgggc

SEQ ID NO: 108357 - DNA, 30 bp, Homo sapiens; identical to SEQ ID NO: 74024
  misc_feature 1..30: note = chr12:123428902-123428932
  misc_feature 1..30: note = Hypo
  source 1..30: mol_type = genomic DNA

SEQ ID NO: 108358 - DNA, 216 bp, Homo sapiens; identical to SEQ ID NO: 74025
  misc_feature 1..216: note = chr12:123436083-123436299
  misc_feature 1..216: note = Hypo
  source 1..216: mol_type = genomic DNA

SEQ ID NO: 108359 - DNA, 30 bp, Homo sapiens; identical to SEQ ID NO: 74026
  misc_feature 1..30: note = chr12:123636606-123636636
  misc_feature 1..30: note = Hypo
  source 1..30: mol_type = genomic DNA

SEQ ID NO: 108360 - DNA, 123 bp, Homo sapiens; identical to SEQ ID NO: 74027
  misc_feature 1..123: note = chr12:123753196-123753319
  misc_feature 1..123: note = Hyper
  source 1..123: mol_type = genomic DNA

SEQ ID NO: 108361 - DNA, 38 bp, Homo sapiens; identical to SEQ ID NO: 43619
  misc_feature 1..38: note = chr12:123881693-123881731
  misc_feature 1..38: note = Hypo
  source 1..38: mol_type = genomic DNA

SEQ ID NO: 108362 - DNA, 214 bp, Homo sapiens; identical to SEQ ID NO: 74029
  misc_feature 1..214: note = chr12:123920513-123920727
  misc_feature 1..214: note = Hyper
  source 1..214: mol_type = genomic DNA

SEQ ID NO: 108363 - DNA, 34 bp, Homo sapiens; identical to SEQ ID NO: 74030
  misc_feature 1..34: note = chr12:123921841-123921875
  misc_feature 1..34: note = Hypo
  source 1..34: mol_type = genomic DNA

SEQ ID NO: 108364 - DNA, 84 bp, Homo sapiens; identical to SEQ ID NO: 74032
  misc_feature 1..84: note = chr12:123998069-123998153
  misc_feature 1..84: note = Hypo
  source 1..84: mol_type = genomic DNA

SEQ ID NO: 108365 - DNA, 30 bp, Homo sapiens; identical to SEQ ID NO: 74033
  misc_feature 1..30: note = chr12:124092980-124093010
  misc_feature 1..30: note = Hypo
  source 1..30: mol_type = genomic DNA

SEQ ID NO: 108366 - DNA, 38 bp, Homo sapiens; identical to SEQ ID NO: 74034
  misc_feature 1..38: note = chr12:124117199-124117237
  misc_feature 1..38: note = Hypo
  source 1..38: mol_type = genomic DNA

SEQ ID NO: 108367 - DNA, 30 bp, Homo sapiens; identical to SEQ ID NO: 74035
  misc_feature 1..30: note = chr12:124152701-124152731
  misc_feature 1..30: note = Hypo
  source 1..30: mol_type = genomic DNA

SEQ ID NO: 108368 - DNA, 78 bp, Homo sapiens; identical to SEQ ID NO: 74037
  misc_feature 1..78: note = chr12:124195871-124195949
  misc_feature 1..78: note = Hypo
  source 1..78: mol_type = genomic DNA

SEQ ID NO: 108369 - DNA, 30 bp, Homo sapiens; identical to SEQ ID NO: 43621
  misc_feature 1..30: note = chr12:124284067-124284097
  misc_feature 1..30: note = Hypo
  source 1..30: mol_type = genomic DNA

SEQ ID NO: 108370 - DNA, 30 bp, Homo sapiens; identical to SEQ ID NO: 74039
  misc_feature 1..30: note = chr12:124285872-124285902
  misc_feature 1..30: note = Hypo
  source 1..30: mol_type = genomic DNA

SEQ ID NO: 108371 - DNA, 30 bp, Homo sapiens; identical to SEQ ID NO: 74040
  misc_feature 1..30: note = chr12:124323044-124323074
  misc_feature 1..30: note = Hypo
  source 1..30: mol_type = genomic DNA

SEQ ID NO: 108372 - DNA, 44 bp, Homo sapiens; identical to SEQ ID NO: 74041
  misc_feature 1..44: note = chr12:124393560-124393604
  misc_feature 1..44: note = Hypo
  source 1..44: mol_type = genomic DNA

SEQ ID NO: 108373 - DNA, 30 bp, Homo sapiens; identical to SEQ ID NO: 43623
  misc_feature 1..30: note = chr12:124397588-124397618
  misc_feature 1..30: note = Hypo
  source 1..30: mol_type = genomic DNA

SEQ ID NO: 108374 - DNA, 92 bp, Homo sapiens; identical to SEQ ID NO: 43624
  misc_feature 1..92: note = chr12:124404180-124404272
  misc_feature 1..92: note = Hypo
  source 1..92: mol_type = genomic DNA

SEQ ID NO: 108375 - DNA, 30 bp, Homo sapiens; identical to SEQ ID NO: 74044
  misc_feature 1..30: note = chr12:124566628-124566658
  misc_feature 1..30: note = Hypo
  source 1..30: mol_type = genomic DNA

SEQ ID NO: 108376 - DNA, 78 bp, Homo sapiens; identical to SEQ ID NO: 74045
  misc_feature 1..78: note = chr12:124651773-124651851
  misc_feature 1..78: note = Hypo
  source 1..78: mol_type = genomic DNA

SEQ ID NO: 108377 - DNA, 207 bp, Homo sapiens; identical to SEQ ID NO: 43626
  misc_feature 1..207: note = chr12:124716795-124717002
  misc_feature 1..207: note = Hypo
  source 1..207: mol_type = genomic DNA

SEQ ID NO: 108378 - DNA, 30 bp, Homo sapiens; identical to SEQ ID NO: 74047
  misc_feature 1..30: note = chr12:124723968-124723998
  misc_feature 1..30: note = Hypo
  source 1..30: mol_type = genomic DNA

SEQ ID NO: 108379 - DNA, 169 bp, Homo sapiens; identical to SEQ ID NO: 74048
  misc_feature 1..169: note = chr12:124726523-124726692
  misc_feature 1..169: note = Hypo
  source 1..169: mol_type = genomic DNA

SEQ ID NO: 108380 - DNA, 283 bp, Homo sapiens; identical to SEQ ID NO: 74049
  misc_feature 1..283: note = chr12:124778114-124778397
  misc_feature 1..283: note = Hypo
  source 1..283: mol_type = genomic DNA

SEQ ID NO: 108381 - DNA, 88 bp, Homo sapiens; identical to SEQ ID NO: 74050
  misc_feature 1..88: note = chr12:124779505-124779593
  misc_feature 1..88: note = Hyper
  source 1..88: mol_type = genomic DNA

SEQ ID NO: 108382 - DNA, 36 bp, Homo sapiens; identical to SEQ ID NO: 74051
  misc_feature 1..36: note = chr12:124780202-124780238
  misc_feature 1..36: note = Hyper
  source 1..36: mol_type = genomic DNA

SEQ ID NO: 108383 - DNA, 143 bp, Homo sapiens; identical to SEQ ID NO: 74052
  misc_feature 1..143: note = chr12:124780828-124780971
  misc_feature 1..143: note = Hyper
  source 1..143: mol_type = genomic DNA

SEQ ID NO: 108384 - DNA, 30 bp, Homo sapiens; identical to SEQ ID NO: 43628
  misc_feature 1..30: note = chr12:124782655-124782685
  misc_feature 1..30: note = Hypo
  source 1..30: mol_type = genomic DNA

SEQ ID NO: 108385 - DNA, 223 bp, Homo sapiens; identical to SEQ ID NO: 43629
  misc_feature 1..223: note = chr12:124788775-124788998
  misc_feature 1..223: note = Hypo
  source 1..223: mol_type = genomic DNA

SEQ ID NO: 108386 - DNA, 52 bp, Homo sapiens; identical to SEQ ID NO: 74055
  misc_feature 1..52: note = chr12:124799068-124799120
  misc_feature 1..52: note = Hypo
  source 1..52: mol_type = genomic DNA

SEQ ID NO: 108387 - DNA, 30 bp, Homo sapiens; identical to SEQ ID NO: 74056
  misc_feature 1..30: note = chr12:124832960-124832990
  misc_feature 1..30: note = Hypo
  source 1..30: mol_type = genomic DNA

SEQ ID NO: 108388 - DNA, 33 bp, Homo sapiens; identical to SEQ ID NO: 43630
  misc_feature 1..33: note = chr12:124843830-124843863
  misc_feature 1..33: note = Hypo
  source 1..33: mol_type = genomic DNA

SEQ ID NO: 108389 - DNA, 276 bp, Homo sapiens; identical to SEQ ID NO: 74058
  misc_feature 1..276: note = chr12:124869876-124870152
  misc_feature 1..276: note = Hypo
  source 1..276: mol_type = genomic DNA

SEQ ID NO: 108390 - DNA, 239 bp, Homo sapiens; identical to SEQ ID NO: 74059
  misc_feature 1..239: note = chr12:124880121-124880360
  misc_feature 1..239: note = Hypo
  source 1..239: mol_type = genomic DNA

SEQ ID NO: 108391 - DNA, 108 bp, Homo sapiens; identical to SEQ ID NO: 74060
  misc_feature 1..108: note = chr12:124890812-124890920
  misc_feature 1..108: note = Hypo
  source 1..108: mol_type = genomic DNA

SEQ ID NO: 108392 - DNA, 168 bp, Homo sapiens; identical to SEQ ID NO: 74061
  misc_feature 1..168: note = chr12:124893402-124893570
  misc_feature 1..168: note = Hypo
  source 1..168: mol_type = genomic DNA

SEQ ID NO: 108393 - DNA, 30 bp, Homo sapiens; identical to SEQ ID NO: 74062
  misc_feature 1..30: note = chr12:124985749-124985779
  misc_feature 1..30: note = Hypo
  source 1..30: mol_type = genomic DNA

SEQ ID NO: 108394 - DNA, 165 bp, Homo sapiens; identical to SEQ ID NO: 74063
  misc_feature 1..165: note = chr12:124989245-124989410
  misc_feature 1..165: note = Hypo
  source 1..165: mol_type = genomic DNA

SEQ ID NO: 108395 - DNA, 30 bp, Homo sapiens; identical to SEQ ID NO: 74064
  misc_feature 1..30: note = chr12:125001347-125001377
  misc_feature 1..30: note = Hypo
  source 1..30: mol_type = genomic DNA

SEQ ID NO: 108396 - DNA, 54 bp, Homo sapiens; identical to SEQ ID NO: 15714
  misc_feature 1..54: note = chr12:125009346-125009400
  misc_feature 1..54: note = Hypo
  source 1..54: mol_type = genomic DNA

SEQ ID NO: 108397 - DNA, 40 bp, Homo sapiens; identical to SEQ ID NO: 74066
  misc_feature 1..40: note = chr12:125027278-125027318
  misc_feature 1..40: note = Hypo
  source 1..40: mol_type = genomic DNA

SEQ ID NO: 108398 - DNA, 51 bp, Homo sapiens; identical to SEQ ID NO: 74068
  misc_feature 1..51: note = chr12:125062836-125062887
  misc_feature 1..51: note = Hypo
  source 1..51: mol_type = genomic DNA

SEQ ID NO: 108399 - DNA, 30 bp, Homo sapiens; identical to SEQ ID NO: 74069
  misc_feature 1..30: note = chr12:125091024-125091054
  misc_feature 1..30: note = Hypo
  source 1..30: mol_type = genomic DNA

SEQ ID NO: 108400 - DNA, 84 bp, Homo sapiens; identical to SEQ ID NO: 74070
  misc_feature 1..84: note = chr12:125092412-125092496
  misc_feature 1..84: note = Hypo
  source 1..84: mol_type = genomic DNA

SEQ ID NO: 108401 - DNA, 493 bp, Homo sapiens; identical to SEQ ID NO: 74071
  misc_feature 1..493: note = chr12:125102096-125102589
  misc_feature 1..493: note = Hypo
  source 1..493: mol_type = genomic DNA

SEQ ID NO: 108402 - DNA, 65 bp, Homo sapiens; identical to SEQ ID NO: 43638
  misc_feature 1..65: note = chr12:125102819-125102884
  misc_feature 1..65: note = Hypo
  source 1..65: mol_type = genomic DNA

SEQ ID NO: 108403 - DNA, 58 bp, Homo sapiens; identical to SEQ ID NO: 43639
  misc_feature 1..58: note = chr12:125119323-125119381
  misc_feature 1..58: note = Hypo
  source 1..58: mol_type = genomic DNA

SEQ ID NO: 108404 - DNA, 232 bp, Homo sapiens; identical to SEQ ID NO: 74074
  misc_feature 1..232: note = chr12:125122425-125122657
  misc_feature 1..232: note = Hypo
  source 1..232: mol_type = genomic DNA

SEQ ID NO: 108405 - DNA, 146 bp, Homo sapiens; identical to SEQ ID NO: 43640
  misc_feature 1..146: note = chr12:125152108-125152254
  misc_feature 1..146: note = Hypo
  source 1..146: mol_type = genomic DNA

SEQ ID NO: 108406 - DNA, 85 bp, Homo sapiens; identical to SEQ ID NO: 74076
  misc_feature 1..85: note = chr12:125167660-125167745
  misc_feature 1..85: note = Hypo
  source 1..85: mol_type = genomic DNA

SEQ ID NO: 108407 - DNA, 30 bp, Homo sapiens; identical to SEQ ID NO: 74077
  misc_feature 1..30: note = chr12:125184551-125184581
  misc_feature 1..30: note = Hypo
  source 1..30: mol_type = genomic DNA

SEQ ID NO: 108408 - DNA, 30 bp, Homo sapiens; identical to SEQ ID NO: 43642
  misc_feature 1..30: note = chr12:125200849-125200879
  misc_feature 1..30: note = Hypo
  source 1..30: mol_type = genomic DNA

SEQ ID NO: 108409 - DNA, 30 bp, Homo sapiens; identical to SEQ ID NO: 74079
  misc_feature 1..30: note = chr12:125336074-125336104
  misc_feature 1..30: note = Hypo
  source 1..30: mol_type = genomic DNA

SEQ ID NO: 108410 - DNA, 485 bp, Homo sapiens; identical to SEQ ID NO: 74080
  misc_feature 1..485: note = chr12:125533937-125534422
  misc_feature 1..485: note = Hyper
  source 1..485: mol_type = genomic DNA

SEQ ID NO: 108411 - DNA, 191 bp, Homo sapiens; identical to SEQ ID NO: 74081
  misc_feature 1..191: note = chr12:125565948-125566139
  misc_feature 1..191: note = Hypo
  source 1..191: mol_type = genomic DNA

SEQ ID NO: 108412 - DNA, 159 bp, Homo sapiens; identical to SEQ ID NO: 74082
  misc_feature 1..159: note = chr12:125578406-125578565
  misc_feature 1..159: note = Hypo
  source 1..159: mol_type = genomic DNA

SEQ ID NO: 108413 - DNA, 98 bp, Homo sapiens; identical to SEQ ID NO: 74083
  misc_feature 1..98: note = chr12:125609670-125609768
  misc_feature 1..98: note = Hypo
  source 1..98: mol_type = genomic DNA

SEQ ID NO: 108414 - DNA, 343 bp, Homo sapiens
  misc_feature 1..343: note = chr12:125670102-125670445
  misc_feature 1..343: note = Hyper
  source 1..343: mol_type = genomic DNA
ctggatggaagaattcgaccacctagtacccggccctgcgcaacacctccgctccgtcactgcctgaccctgcgctgggaactcattcccgggaccgccagggaatctgcccttcccaggagaactcctggctgcctccgcgtgctcctagggcctgcgcgaaatgggaaggcgcatcctctagcctgggtaaataagggaccctgcctcacccgggtggccatccccaggccgccttcgctgtgtttcaggtcaccgcacccagcctgcgcacccctagcccccatcccggtgccgtgcagaggctctgcacacagcctcggcctcccggaggccctcccct

SEQ ID NO: 108415 - DNA, 551 bp, Homo sapiens; identical to SEQ ID NO: 74086
  misc_feature 1..551: note = chr12:125671499-125672050
  misc_feature 1..551: note = Hyper
  source 1..551: mol_type = genomic DNA

SEQ ID NO: 108416 - DNA, 268 bp, Homo sapiens; identical to SEQ ID NO: 34736
  misc_feature 1..268: note = chr12:125672764-125673032
  misc_feature 1..268: note = Hyper
  source 1..268: mol_type = genomic DNA

SEQ ID NO: 108417 - DNA, 199 bp, Homo sapiens; identical to SEQ ID NO: 74088
  misc_feature 1..199: note = chr12:125812590-125812789
  misc_feature 1..199: note = Hypo
  source 1..199: mol_type = genomic DNA

SEQ ID NO: 108418 - DNA, 186 bp, Homo sapiens; identical to SEQ ID NO: 43645
  misc_feature 1..186: note = chr12:125813536-125813722
  misc_feature 1..186: note = Hypo
  source 1..186: mol_type = genomic DNA

SEQ ID NO: 108419 - DNA, 161 bp, Homo sapiens; identical to SEQ ID NO: 74090
  misc_feature 1..161: note = chr12:125977237-125977398
  misc_feature 1..161: note = Hypo
  source 1..161: mol_type = genomic DNA

SEQ ID NO: 108420 - DNA, 114 bp, Homo sapiens
  misc_feature 1..114: note = chr12:126018151-126018265
  misc_feature 1..114: note = Hyper
  source 1..114: mol_type = genomic DNA
gggcgatggtcctggcgcacccgctagatggcgccgcagaccggcttgtacaggccgcgcgccctcccctccccggcggaggctcctggagcccctgcccggcctgactggctg

SEQ ID NO: 108421 - DNA, 246 bp, Homo sapiens; identical to SEQ ID NO: 74093
  misc_feature 1..246: note = chr12:126168425-126168671
  misc_feature 1..246: note = Hyper
  source 1..246: mol_type = genomic DNA

SEQ ID NO: 108422 - DNA, 29 bp, Homo sapiens
  misc_feature 1..29: note = chr12:126243099-126243128
  misc_feature 1..29: note = Hypo
  source 1..29: mol_type = genomic DNA
tgagccaccgcgcccggctgatgattgtg

SEQ ID NO: 108423 - DNA, 45 bp, Homo sapiens; identical to SEQ ID NO: 74095
  misc_feature 1..45: note = chr12:126288373-126288418
  misc_feature 1..45: note = Hypo
  source 1..45: mol_type = genomic DNA

SEQ ID NO: 108424 - DNA, 280 bp, Homo sapiens; identical to SEQ ID NO: 74096
  misc_feature 1..280: note = chr12:126675639-126675919
  misc_feature 1..280: note = Hyper
  source 1..280: mol_type = genomic DNA

SEQ ID NO: 108425 - DNA, 139 bp, Homo sapiens; identical to SEQ ID NO: 74097
  misc_feature 1..139: note = chr12:127051874-127052013
  misc_feature 1..139: note = Hypo
  source 1..139: mol_type = genomic DNA

SEQ ID NO: 108426 - DNA, 367 bp, Homo sapiens
  misc_feature 1..367: note = chr12:127211018-127211385
  misc_feature 1..367: note = Hyper
  source 1..367: mol_type = genomic DNA
gggagtctgcagacacggagtttccgtgccagaggagcgggtccacgcggacaggcagttccagctccgggtaagtgcggccccatctcctctccgtccccggctccgccagcagcagtcccggagagatttcccctccccgccgcccgcgctctctctcctcctgcgcccaggccggtctccggctccggagtcggacggcgacggtgcagatgagggcgcacaggggacggtcctggagcccgggaagggtgcgagatggagacggcggttcagaaaagttgtcaggtctccagcccgggcagtggcgggagctggagccgcggtggagacgactcgaggggacgcagcccgcctggcacaaagg

SEQ ID NO: 108427 - DNA, 60 bp, Homo sapiens; identical to SEQ ID NO: 74099
  misc_feature 1..60: note = chr12:127212512-127212572
  misc_feature 1..60: note = Hyper
  source 1..60: mol_type = genomic DNA

SEQ ID NO: 108428 - DNA, 30 bp, Homo sapiens; identical to SEQ ID NO: 74100
  misc_feature 1..30: note = chr12:127519655-127519685
  misc_feature 1..30: note = Hypo
  source 1..30: mol_type = genomic DNA

SEQ ID NO: 108429 - DNA, 387 bp, Homo sapiens; identical to SEQ ID NO: 74101
  misc_feature 1..387: note = chr12:127765141-127765528
  misc_feature 1..387: note = Hyper
  source 1..387: mol_type = genomic DNA

SEQ ID NO: 108430 - DNA, 192 bp, Homo sapiens
  misc_feature 1..192: note = chr12:127865670-127865862
  misc_feature 1..192: note = Hyper
  source 1..192: mol_type = genomic DNA
ggaaggcctggaaatcgcaggtcctgaggacgcggcgagttcacggagaggacctgccgggcaggggctctgggagcctccgcggggaggggagggcgcgcggccggcgcggccacaacccggtctgcggcgccatctagcgggcgcgccgggaccgtcgcccactaggcccttttccggaggagaagctga

SEQ ID NO: 108431 - DNA, 165 bp, Homo sapiens; identical to SEQ ID NO: 74104
  misc_feature 1..165: note = chr12:127939926-127940091
  misc_feature 1..165: note = Hyper
  source 1..165: mol_type = genomic DNA

SEQ ID NO: 108432 - DNA, 187 bp, Homo sapiens
  misc_feature 1..187: note = chr12:127940356-127940543
  misc_feature 1..187: note = Hyper
  source 1..187: mol_type = genomic DNA
ccggggccggaaaggcgaggcggggctggggctggggcggctgcggggcgcgggggagatgccgaggggctgggctggggcagggtctgcaggtgcggcgggcggatcagcggcacccgctgcagacgcggtcggcgaaacgtcgtcccggccccagctcgagcagcggctccgggtggacctcgca

SEQ ID NO: 108433 - DNA, 30 bp, Homo sapiens; identical to SEQ ID NO: 74107
  misc_feature 1..30: note = chr12:128142127-128142157
  misc_feature 1..30: note = Hypo
  source 1..30: mol_type = genomic DNA

SEQ ID NO: 108434 - DNA, 30 bp, Homo sapiens; identical to SEQ ID NO: 74108
  misc_feature 1..30: note = chr12:128245440-128245470
  misc_feature 1..30: note = Hypo
  source 1..30: mol_type = genomic DNA

SEQ ID NO: 108435 - DNA, 81 bp, Homo sapiens; identical to SEQ ID NO: 74109
  misc_feature 1..81: note = chr12:128310374-128310455
  misc_feature 1..81: note = Hypo
  source 1..81: mol_type = genomic DNA

SEQ ID NO: 108436 - DNA, 28 bp, Homo sapiens
  misc_feature 1..28: note = chr12:128310875-128310903
  misc_feature 1..28: note = Hypo
  source 1..28: mol_type = genomic DNA
cttcaggaaggaagccgggaccctcgcg

SEQ ID NO: 108437 - DNA, 28 bp, Homo sapiens
  misc_feature 1..28: note = chr12:128311023-128311051
  misc_feature 1..28: note = Hypo
  source 1..28: mol_type = genomic DNA
ccttcgcagtgaacgttacagctcttaa

SEQ ID NO: 108438 - DNA, 2122 bp, Homo sapiens
  misc_feature 1..2122: note = chr12:128751118-128753240
  misc_feature 1..2122: note = Hyper
  source 1..2122: mol_type = genomic DNA
catctgtcttgagcccgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccgggccacgggccgctgtccgttgggcacccgggcaggagtctgcgaacgctgagtttctctggaaaggcgcggacccccggaggagccgtcccagccgcctggggagacgccccctcctctcccggtcttctttcccgggcacaccctccctagcccgggcgggggggttctccatctgccgcccctcccggcgggcaggcgaactctctcctaccgcaccctcaatctgtccgcggtcgcggggctcggcgggggcggggcccgggcgggggcgggggcggggccgggggcggggcgggccggcggctgcggaggctgcggaggctgcgggagaaaagttgtcccggccggagcgcgagcagcggcggagccggagccgccagagccagagccggagctgcggcggcgtggacccggcaggggcgggcctcggacagcagagacgcagcgggcccggccgaccgggctgcgggagtggccccgggcatggggcggccggcgggggccgcgggcgggcgctgcgcttcgggctggcggcgggctgcgtgagcggccgggacgcaggatgcgctccgagggtgcggcccccgggccggcggcgccgctgtgcggggcgctgagcctgctgctgggcgcgctgctgggcaaaggtaaggccggggcgggtgcctggcgcgccgacgcatgcgaacttcccggttccgggggagctcggggtgagggcagccgaagcgaggggtgcggcgggggcctcggcgggggctcggatcccatcaacagcgcctctgcgggtgccgagccgcccctaatccagaagggcgctcccagctgggcgccgggatccgggcaagttaggctggtcccgagtcccgaatctcccaccccggaccccccagacccagagctgccccgcggatgaggagggggcgtggctgagggacacggtgtttgttccccatccctgagttccgtgcggacctgccccagccccagcacagtcaccctgtggaactggcatccaggagaggtgctccgctctgtgcgctccttcctcccggctgtgtgctccctgtccacagctccccatccacagcttcggcactgtggggctggtgctccaggagggaaggcccggttctttgcatcccctttccgcaaccgctagggtctctgtgcgggccctagaggaacgctcactcatcgcgcagctcaccagggaccccagcttggcagaaaccaggggctctctgcgggttctctcaaatgagtcctttgcggtgggggagcgcggatggggaggtgggtgcgtccctcgcgacgggaactacctcaccagcggtcctgtccggggctccttcacctcagtgtcctcttctctacaatgggagtgacggccctgctttgggttggaggaatttaaaggagttaacgtatggcgcccgcagggctcacgaaaggtagccgtgtggtttttccgaccttttttattatgtgcgtgtgcggccgagtggccgcgcggatgcggcggcgggaagggcggggagaggcggtctccagccccaggagccgcggggcaggcggggagcaaggcctaggctctgccagggcagcagctgcccgagtcccggggcgcgcccagggcgtagaaaaaggagagcgtcgctttcctgctccccgcgccctggcgaaggtctcgggttcatttggttaaacggaggtgcgcacatgggtgccctgagccttcgcgcggcgccgcgggtccagtatcggccccaggctctgagcagagaacactcaaagccacccttctcccgcctaatgctctgaggctgagctagaaatgcgttcagagagacaa

SEQ ID NO: 108439 - DNA, 234 bp, Homo sapiens
  misc_feature 1..234: note = chr12:128850534-128850768
  misc_feature 1..234: note = Hyper
  source 1..234: mol_type = genomic DNA
aaactcagctggatccgcgggccgtgattaaacacattgcccgctttgttgccgagatggtgtttcggaaggcgctgtgaatgcacttccctttgcggggctcacacagacaagatgtgtgttgcaaggatgaggcgcctgctcggcctccagcccagggccgggaagggagaaggtgctgtgcgtcgctgcctgtgtcgcccgcggctctcctcccagcgacagactccagac

SEQ ID NO: 108440 - DNA, 166 bp, Homo sapiens; identical to SEQ ID NO: 43651
  misc_feature 1..166: note = chr12:128899701-128899867
  misc_feature 1..166: note = Hypo
  source 1..166: mol_type = genomic DNA

SEQ ID NO: 108441 - DNA, 91 bp, Homo sapiens; identical to SEQ ID NO: 74119
  misc_feature 1..91: note = chr12:128944040-128944131
  misc_feature 1..91: note = Hypo
  source 1..91: mol_type = genomic DNA

SEQ ID NO: 108442 - DNA, 193 bp, Homo sapiens; identical to SEQ ID NO: 43652
  misc_feature 1..193: note = chr12:128964823-128965016
  misc_feature 1..193: note = Hypo
  source 1..193: mol_type = genomic DNA

SEQ ID NO: 108443 - DNA, 30 bp, Homo sapiens; identical to SEQ ID NO: 43653
  misc_feature 1..30: note = chr12:129028675-129028705
  misc_feature 1..30: note = Hypo
  source 1..30: mol_type = genomic DNA

SEQ ID NO: 108444 - DNA, 30 bp, Homo sapiens; identical to SEQ ID NO: 74122
  misc_feature 1..30: note = chr12:129189879-129189909
  misc_feature 1..30: note = Hypo
  source 1..30: mol_type = genomic DNA

SEQ ID NO: 108445 - DNA, 30 bp, Homo sapiens; identical to SEQ ID NO: 74123
  misc_feature 1..30: note = chr12:129190114-129190144
  misc_feature 1..30: note = Hypo
  source 1..30: mol_type = genomic DNA

SEQ ID NO: 108446 - DNA, 1114 bp, Homo sapiens
  misc_feature 1..1114: note = chr12:129337805-129338919
  misc_feature 1..1114: note = Hyper
  source 1..1114: mol_type = genomic DNA
gatggtcctggtccccgtggaagggactgtggtcaccgctggtcctggtccaggtggaaacagaccgcggctaccctggtgatggaccccacggggcacacccgcgccaccccgcacccagggctcgcgccgcccgaggcccccggttcctgtccccctccccgcctggcgccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcggtaggtgcagggcgccggggcctacgaagcctgggccgggggccggggggcggggacgcgggacccggggacgcggggcgctcagccaggccccctccagccgcgccggggccgtcccgagccgcgcgcacaaacggatgggccggtgccgcctgccgggcgcgcgggggtcggtgccttctgcgtggcgcgcgtgtccccgggtctccgtgcggccggcgcattggcctcgcgctctccggaggggactgagcaggtgaacaggcccggagcctgtcgtggaggggcccgggaaggcctcgctgcagaagcaggatgggagcaggatccgcagggatgcgcagcggggtccgcggagctcccggcgggggcgcgtttccaggccggggaccgcggtgccagccctgccctcgcggatcgggtctcggctgtgtgccggcgtccggggtcctgtccccgaagtccctttcccacctcccctctgccctgtctattctcgtcttcctggctggttagctccttcacactcatctttttctgcctttgtcttatttgtttacttgttggtctgtgttctggtcgctggaacgcaagcccggcgggggcccggggaggggccgccgcgttaatcccgccgcctcccacccgcacagcgggcgctcggcctgtattagccggataaacatattccttgaggcgaagcctgggaagtgccaggattagag

SEQ ID NO: 108447 - DNA, 30 bp, Homo sapiens; identical to SEQ ID NO: 43654
  misc_feature 1..30: note = chr12:129441934-129441964
  misc_feature 1..30: note = Hypo
  source 1..30: mol_type = genomic DNA

SEQ ID NO: 108448 - DNA, 120 bp, Homo sapiens; identical to SEQ ID NO: 74128
  misc_feature 1..120: note = chr12:129520236-129520356
  misc_feature 1..120: note = Hypo
  source 1..120: mol_type = genomic DNA

SEQ ID NO: 108449 - DNA, 77 bp, Homo sapiens; identical to SEQ ID NO: 74129
  misc_feature 1..77: note = chr12:129615016-129615093
  misc_feature 1..77: note = Hypo
  source 1..77: mol_type = genomic DNA

SEQ ID NO: 108450 - DNA, 30 bp, Homo sapiens; identical to SEQ ID NO: 74130
  misc_feature 1..30: note = chr12:129728999-129729029
  misc_feature 1..30: note = Hypo
  source 1..30: mol_type = genomic DNA

SEQ ID NO: 108451 - DNA, 170 bp, Homo sapiens; identical to SEQ ID NO: 74131
  misc_feature 1..170: note = chr12:129821969-129822139
  misc_feature 1..170: note = Hypo
  source 1..170: mol_type = genomic DNA

SEQ ID NO: 108452 - DNA, 194 bp, Homo sapiens; identical to SEQ ID NO: 74132
  misc_feature 1..194: note = chr12:130037653-130037847
  misc_feature 1..194: note = Hypo
  source 1..194: mol_type = genomic DNA

SEQ ID NO: 108453 - DNA, 30 bp, Homo sapiens; identical to SEQ ID NO: 74133
  misc_feature 1..30: note = chr12:130184730-130184760
  misc_feature 1..30: note = Hypo
  source 1..30: mol_type = genomic DNA

SEQ ID NO: 108454 - DNA, 34 bp, Homo sapiens; identical to SEQ ID NO: 74134
  misc_feature 1..34: note = chr12:130195436-130195470
  misc_feature 1..34: note = Hypo
  source 1..34: mol_type = genomic DNA

SEQ ID NO: 108455 - DNA, 52 bp, Homo sapiens; identical to SEQ ID NO: 74135
  misc_feature 1..52: note = chr12:130216130-130216182
  misc_feature 1..52: note = Hypo
  source 1..52: mol_type = genomic DNA

SEQ ID NO: 108456 - DNA, 30 bp, Homo sapiens; identical to SEQ ID NO: 43658
  misc_feature 1..30: note = chr12:130308451-130308481
  misc_feature 1..30: note = Hypo
  source 1..30: mol_type = genomic DNA

SEQ ID NO: 108457 - DNA, 74 bp, Homo sapiens; identical to SEQ ID NO: 74139
  misc_feature 1..74: note = chr12:130325114-130325188
  misc_feature 1..74: note = Hypo
  source 1..74: mol_type = genomic DNA

SEQ ID NO: 108458 - DNA, 216 bp, Homo sapiens
  misc_feature 1..216: note = chr12:130387439-130387655
  misc_feature 1..216: note = Hyper
  source 1..216: mol_type = genomic DNA
tcctcccccgacagccggctcggccctccagaggccacctttcctctcaagggtccccacgccctctccctttacagaaaaggctttcaggaaacagccttcctttcctttcggctccttagtagtctcacctaaggcctcccacccaagtgctccaggacaagcaccttcggccaaggggcgtccgaggagcttggctgccgcacgagcgcacgt

SEQ ID NO: 108459 - DNA, 336 bp, Homo sapiens
  misc_feature 1..336: note = chr12:130387715-130388051
  misc_feature 1..336: note = Hyper
  source 1..336: mol_type = genomic DNA
tctcccggccgcccccatcctccacacactcccacacactcactccaggcgaagttagtccccgggccctggcggccgcggcgtcctcacctttggaaaacagggcggccaggctgatgagtaccggcgaccagtggtgccacagcgtccccatctcagacgggcacatcctggagacccggagcgcagatcctccgctccccggcgccgtccaggcgaacaagagaccgtctcagtcccctagaggcccgcagcggggccggtggcgagggagcgcccggctaggggcccgagcagcccgggcgccctgctccctcttcccgccagtccatggcc

SEQ ID NO: 108460 - DNA, 883 bp, Homo sapiens
  misc_feature 1..883: note = chr12:130388269-130389152
  misc_feature 1..883: note = Hyper
  source 1..883: mol_type = genomic DNA
tcccgggctggctagcgggcgctggcgcaggcggcgccggggtggcggggctgcggagcccgggacgcgggcagaggcggctcggagccccccgggcgggtggccgggctcgctgggcggcccggggctccctggcccgcagcccccatcccaggccggccgctgcgcctcggggctcgggcgcgcgcgcgctccggcacccaaagtttggcgggtgcggctgctccccggccgccgcctcggcccgcccggccccgggcccggctggggctcgcggggctctacgcgcgccgagcgcactgcaggctccggagacgcggggctcccccctgcgcccgggggaggcgggccagatgtgcgcggaggagggcccgccggctcggggacgcggccgagcaacgcagctgcctcctgccagcaggcgcgggggctccgctccgcaaggaccgcatccggaacggaacggaggcgatcgccacggtgcccggagccggctggggctttcgccttaaaaatttgtctgcttttaaaaagccccaccctttcggagtgacagctgtgagccccaatccgcaaagtaaatcccacctccccctggccgccccacgcccagcctcccggccaccctccctgcgagcgcggacgcgcggtggcggcgggcgagggctcccagcgcgggcgcaccccggggacggagccacccactctcccaacaggtgtccagctggccaccggcctctcgtcgtcatcaaaacctcaggcccaggggaggtcctccagcccgggggcacctgaggctcttcgccagggagagcgcaaggatggctggagaagggccctcgccccgccctgcgcatctcccagggatcgcagtgaggaagtc

SEQ ID NO: 108461 - DNA, 30 bp, Homo sapiens; identical to SEQ ID NO: 74145
  misc_feature 1..30: note = chr12:130414807-130414837
  misc_feature 1..30: note = Hypo
  source 1..30: mol_type = genomic DNA

SEQ ID NO: 108462 - DNA, 30 bp, Homo sapiens; identical to SEQ ID NO: 34754
  misc_feature 1..30: note = chr12:130498725-130498755
  misc_feature 1..30: note = Hyper
  source 1..30: mol_type = genomic DNA

SEQ ID NO: 108463 - DNA, 30 bp, Homo sapiens; identical to SEQ ID NO: 74147
  misc_feature 1..30: note = chr12:130499052-130499082
  misc_feature 1..30: note = Hyper
  source 1..30: mol_type = genomic DNA

SEQ ID NO: 108464 - DNA, 109 bp, Homo sapiens; identical to SEQ ID NO: 74148
  misc_feature 1..109: note = chr12:130501672-130501781
  misc_feature 1..109: note = Hypo
  source 1..109: mol_type = genomic DNA

SEQ ID NO: 108465 - DNA, 310 bp, Homo sapiens
  misc_feature 1..310: note = chr12:130526820-130527130
  misc_feature 1..310: note = Hyper
  source 1..310: mol_type = genomic DNA
cacacagatgtgggtcgctgccttcccaacaggctcctgcccggttcacctggggaagcgcagggctgcgggcacaggattctcccatcagacaccgggagagcatctccgcggcagcttgcagggcccgctgtctccactagggggcggcgtacgcgcgtctctcgaagccgggacccgcgcggggaggctgcactggctggaaacagcgcctgggcgctcccgcggctcccacctcagagatgtccccaggtgccccacgccccccgcgcgagccccgacacgcgagccccaccgcactcctcaaggg

SEQ ID NO: 108466 - DNA, 125 bp, Homo sapiens; identical to SEQ ID NO: 74152
  misc_feature 1..125: note = chr12:130589202-130589327
  misc_feature 1..125: note = Hyper
  source 1..125: mol_type = genomic DNA

SEQ ID NO: 108467 - DNA, 130 bp, Homo sapiens; identical to SEQ ID NO: 74153
  misc_feature 1..130: note = chr12:130604031-130604161
  misc_feature 1..130: note = Hypo
  source 1..130: mol_type = genomic DNA

SEQ ID NO: 108468 - DNA, 620 bp, Homo sapiens; identical to SEQ ID NO: 74154
  misc_feature 1..620: note = chr12:130645186-130645806
  misc_feature 1..620: note = Hyper
  source 1..620: mol_type = genomic DNA

SEQ ID NO: 108469 - DNA, 260 bp, Homo sapiens; identical to SEQ ID NO: 74155
  misc_feature 1..260: note = chr12:130646084-130646344
  misc_feature 1..260: note = Hyper
  source 1..260: mol_type = genomic DNA

SEQ ID NO: 108470 - DNA, 527 bp, Homo sapiens
  misc_feature 1..527: note = chr12:130646555-130647082
  misc_feature 1..527: note = Hyper
  source 1..527: mol_type = genomic DNA
ccaaaccccttctcccgccagtccccgaacttcccgtaacctcggcgtcctcggggtgccggggaccatcccggggaccgccgggaaagggggcgccggcggagaggatagcgagaggcaaagttggaggccaggcagagagagggcgaggagaggcgggcgggactgccggggagggtcgcagcgcgcagagccccgcgcgccaggcgggctgtcccggggctggcgggcgacgcgggcgggactaggcgctgcgccccccgcaggctgggctgcaggccgggggggatcggcccccgcggggcccgggagcccgcggcggggcggcggggaggaggctgccccgggccgctgcgctttctcatgcaaagcagcggcggggcggggcgcgcggcccgggggcggggcctgtcagcgctcggcttttctgcccccctttgcctttttgcgagtcttctcatcccgggacgcaaacctcgaaacagctgccggctggtcccggccgaggccggcgcagggagggagga

SEQ ID NO: 108471 - DNA, 1142 bp, Homo sapiens
  misc_feature 1..1142: note = chr12:130647351-130648493
  misc_feature 1..1142: note = Hyper
  source 1..1142: mol_type = genomic DNA
gcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcc

SEQ ID NO: 108472 - DNA, 72 bp, Homo sapiens; identical to SEQ ID NO: 74161
  misc_feature 1..72: note = chr12:130726962-130727034
  misc_feature 1..72: note = Hypo
  source 1..72: mol_type = genomic DNA

SEQ ID NO: 108473 - DNA, 301 bp, Homo sapiens; identical to SEQ ID NO: 5141
  misc_feature 1..301: note = chr12:130821371-130821672
  misc_feature 1..301: note = Hypo
  source 1..301: mol_type = genomic DNA

SEQ ID NO: 108474 - DNA, 30 bp, Homo sapiens; identical to SEQ ID NO: 74164
  misc_feature 1..30: note = chr12:130889105-130889135
  misc_feature 1..30: note = Hypo
  source 1..30: mol_type = genomic DNA

SEQ ID NO: 108475 - DNA, 153 bp, Homo sapiens; identical to SEQ ID NO: 74165
  misc_feature 1..153: note = chr12:130909584-130909737
  misc_feature 1..153: note = Hypo
  source 1..153: mol_type = genomic DNA

SEQ ID NO: 108476 - DNA, 30 bp, Homo sapiens; identical to SEQ ID NO: 74166
  misc_feature 1..30: note = chr12:130910571-130910601
  misc_feature 1..30: note = Hypo
  source 1..30: mol_type = genomic DNA

SEQ ID NO: 108477 - DNA, 177 bp, Homo sapiens; identical to SEQ ID NO: 74167
  misc_feature 1..177: note = chr12:130918507-130918684
  misc_feature 1..177: note = Hypo
  source 1..177: mol_type = genomic DNA

SEQ ID NO: 108478 - DNA, 188 bp, Homo sapiens; identical to SEQ ID NO: 74168
  misc_feature 1..188: note = chr12:130920592-130920780
  misc_feature 1..188: note = Hypo
  source 1..188: mol_type = genomic DNA

SEQ ID NO: 108479 - DNA, 35 bp, Homo sapiens; identical to SEQ ID NO: 74169
  misc_feature 1..35: note = chr12:130921348-130921383
  misc_feature 1..35: note = Hypo
  source 1..35: mol_type = genomic DNA

SEQ ID NO: 108480 - DNA, 30 bp, Homo sapiens; identical to SEQ ID NO: 74170
  misc_feature 1..30: note = chr12:130941083-130941113
  misc_feature 1..30: note = Hypo
  source 1..30: mol_type = genomic DNA

SEQ ID NO: 108481 - DNA, 30 bp, Homo sapiens; identical to SEQ ID NO: 74171
  misc_feature 1..30: note = chr12:130947017-130947047
  misc_feature 1..30: note = Hypo
  source 1..30: mol_type = genomic DNA

SEQ ID NO: 108482 - DNA, 30 bp, Homo sapiens; identical to SEQ ID NO: 43663
  misc_feature 1..30: note = chr12:130947254-130947284
  misc_feature 1..30: note = Hypo
  source 1..30: mol_type = genomic DNA

SEQ ID NO: 108483 - DNA, 112 bp, Homo sapiens; identical to SEQ ID NO: 74173
  misc_feature 1..112: note = chr12:130956148-130956260
  misc_feature 1..112: note = Hypo
  source 1..112: mol_type = genomic DNA

SEQ ID NO: 108484 - DNA, 30 bp, Homo sapiens; identical to SEQ ID NO: 74174
  misc_feature 1..30: note = chr12:130968660-130968690
  misc_feature 1..30: note = Hypo
  source 1..30: mol_type = genomic DNA

SEQ ID NO: 108485 - DNA, 251 bp, Homo sapiens; identical to SEQ ID NO: 74175
  misc_feature 1..251: note = chr12:131042217-131042468
  misc_feature 1..251: note = Hypo
  source 1..251: mol_type = genomic DNA

SEQ ID NO: 108486 - DNA, 237 bp, Homo sapiens; identical to SEQ ID NO: 74176
  misc_feature 1..237: note = chr12:131060814-131061051
  misc_feature 1..237: note = Hypo
  source 1..237: mol_type = genomic DNA

SEQ ID NO: 108487 - DNA, 39 bp, Homo sapiens; identical to SEQ ID NO: 43664
  misc_feature 1..39: note = chr12:131077323-131077362
  misc_feature 1..39: note = Hypo
  source 1..39: mol_type = genomic DNA

SEQ ID NO: 108488 - DNA, 30 bp, Homo sapiens; identical to SEQ ID NO: 74178
  misc_feature 1..30: note = chr12:131088329-131088359
  misc_feature 1..30: note = Hypo
  source 1..30: mol_type = genomic DNA

SEQ ID NO: 108489 - DNA, 63 bp, Homo sapiens; identical to SEQ ID NO: 74179
  misc_feature 1..63: note = chr12:131098650-131098713
  misc_feature 1..63: note = Hypo
  source 1..63: mol_type = genomic DNA

SEQ ID NO: 108490 - DNA, 85 bp, Homo sapiens; identical to SEQ ID NO: 74180
  misc_feature 1..85: note = chr12:131159445-131159530
  misc_feature 1..85: note = Hypo
  source 1..85: mol_type = genomic DNA

SEQ ID NO: 108491 - DNA, 30 bp, Homo sapiens; identical to SEQ ID NO: 43665
  misc_feature 1..30: note = chr12:131159790-131159820
  misc_feature 1..30: note = Hypo
  source 1..30: mol_type = genomic DNA

SEQ ID NO: 108492 - DNA, 254 bp, Homo sapiens; identical to SEQ ID NO: 74182
  misc_feature 1..254: note = chr12:131199288-131199542
  misc_feature 1..254: note = Hyper
  source 1..254: mol_type = genomic DNA

SEQ ID NO: 108493 - DNA, 148 bp, Homo sapiens
  misc_feature 1..148: note = chr12:131199859-131200007
  misc_feature 1..148: note = Hyper
  source 1..148: mol_type = genomic DNA
ggccagtgaccaggccgggaggtgaagcagtcctccctccctccggccagccgccaccccgacctcagccagcgtgcgctccccggggacaggagggaggctgcttccaccgaggcctctgctgacagatgtccgggcccccacctgg

SEQ ID NO: 108494 - DNA, 215 bp, Homo sapiens; identical to SEQ ID NO: 74185
  misc_feature 1..215: note = chr12:131200331-131200546
  misc_feature 1..215: note = Hyper
  source 1..215: mol_type = genomic DNA

SEQ ID NO: 108495 - DNA, 30 bp, Homo sapiens; identical to SEQ ID NO: 74186
  misc_feature 1..30: note = chr12:131201356-131201386
  misc_feature 1..30: note = Hyper
  source 1..30: mol_type = genomic DNA

SEQ ID NO: 108496 - DNA, 30 bp, Homo sapiens; identical to SEQ ID NO: 43666
  misc_feature 1..30: note = chr12:131229952-131229982
  misc_feature 1..30: note = Hypo
  source 1..30: mol_type = genomic DNA

SEQ ID NO: 108497 - DNA, 30 bp, Homo sapiens; identical to SEQ ID NO: 74188
  misc_feature 1..30: note = chr12:131261499-131261529
  misc_feature 1..30: note = Hypo
  source 1..30: mol_type = genomic DNA

SEQ ID NO: 108498 - DNA, 123 bp, Homo sapiens; identical to SEQ ID NO: 43667
  misc_feature 1..123: note = chr12:131268359-131268482
  misc_feature 1..123: note = Hypo
  source 1..123: mol_type = genomic DNA

SEQ ID NO: 108499 - DNA, 56 bp, Homo sapiens; identical to SEQ ID NO: 43668
  misc_feature 1..56: note = chr12:131271976-131272032
  misc_feature 1..56: note = Hypo
  source 1..56: mol_type = genomic DNA

SEQ ID NO: 108500 - DNA, 37 bp, Homo sapiens; identical to SEQ ID NO: 74191
  misc_feature 1..37: note = chr12:131272330-131272367
  misc_feature 1..37: note = Hypo
  source 1..37: mol_type = genomic DNA

SEQ ID NO: 108501 - DNA, 245 bp, Homo sapiens; identical to SEQ ID NO: 74192
  misc_feature 1..245: note = chr12:131290735-131290980
  misc_feature 1..245: note = Hypo
  source 1..245: mol_type = genomic DNA

SEQ ID NO: 108502 - DNA, 134 bp, Homo sapiens; identical to SEQ ID NO: 74193
  misc_feature 1..134: note = chr12:131335189-131335323
  misc_feature 1..134: note = Hypo
  source 1..134: mol_type = genomic DNA

SEQ ID NO: 108503 - DNA, 166 bp, Homo sapiens; identical to SEQ ID NO: 43670
  misc_feature 1..166: note = chr12:131383570-131383736
  misc_feature 1..166: note = Hypo
  source 1..166: mol_type = genomic DNA

SEQ ID NO: 108504 - DNA, 30 bp, Homo sapiens; identical to SEQ ID NO: 43671
  misc_feature 1..30: note = chr12:131387248-131387278
  misc_feature 1..30: note = Hypo
  source 1..30: mol_type = genomic DNA

SEQ ID NO: 108505 - DNA, 44 bp, Homo sapiens; identical to SEQ ID NO: 74196
  misc_feature 1..44: note = chr12:131389290-131389334
  misc_feature 1..44: note = Hypo
  source 1..44: mol_type = genomic DNA

SEQ ID NO: 108506 - DNA, 103 bp, Homo sapiens; identical to SEQ ID NO: 74197
  misc_feature 1..103: note = chr12:131400816-131400919
  misc_feature 1..103: note = Hyper
  source 1..103: mol_type = genomic DNA

SEQ ID NO: 108507 - DNA, 76 bp, Homo sapiens; identical to SEQ ID NO: 74198
  misc_feature 1..76: note = chr12:131402548-131402624
  misc_feature 1..76: note = Hypo
  source 1..76: mol_type = genomic DNA

SEQ ID NO: 108508 - DNA, 179 bp, Homo sapiens; identical to SEQ ID NO: 74199
  misc_feature 1..179: note = chr12:131403032-131403211
  misc_feature 1..179: note = Hypo
  source 1..179: mol_type = genomic DNA

SEQ ID NO: 108509 - DNA, 30 bp, Homo sapiens; identical to SEQ ID NO: 74200
  misc_feature 1..30: note = chr12:131417941-131417971
  misc_feature 1..30: note = Hypo
  source 1..30: mol_type = genomic DNA

SEQ ID NO: 108510 - DNA, 42 bp, Homo sapiens; identical to SEQ ID NO: 74201
  misc_feature 1..42: note = chr12:131418388-131418430
  misc_feature 1..42: note = Hypo
  source 1..42: mol_type = genomic DNA

SEQ ID NO: 108511 - DNA, 310 bp, Homo sapiens; identical to SEQ ID NO: 74202
  misc_feature 1..310: note = chr12:131433135-131433445
  misc_feature 1..310: note = Hypo
  source 1..310: mol_type = genomic DNA

SEQ ID NO: 108512 - DNA, 30 bp, Homo sapiens; identical to SEQ ID NO: 74203
  misc_feature 1..30: note = chr12:131434432-131434462
  misc_feature 1..30: note = Hypo
  source 1..30: mol_type = genomic DNA

SEQ ID NO: 108513 - DNA, 30 bp, Homo sapiens; identical to SEQ ID NO: 74204
  misc_feature 1..30: note = chr12:131436515-131436545
  misc_feature 1..30: note = Hypo
  source 1..30: mol_type = genomic DNA

SEQ ID NO: 108514 - DNA, 30 bp, Homo sapiens; identical to SEQ ID NO: 74205
  misc_feature 1..30: note = chr12:131438610-131438640
  misc_feature 1..30: note = Hyper
  source 1..30: mol_type = genomic DNA

SEQ ID NO: 108515 - DNA, 66 bp, Homo sapiens; identical to SEQ ID NO: 74206
  misc_feature 1..66: note = chr12:131499103-131499169
  misc_feature 1..66: note = Hypo
  source 1..66: mol_type = genomic DNA

SEQ ID NO: 108516 - DNA, 53 bp, Homo sapiens; identical to SEQ ID NO: 43675
  misc_feature 1..53: note = chr12:131500873-131500926
  misc_feature 1..53: note = Hypo
  source 1..53: mol_type = genomic DNA

SEQ ID NO: 108517 - DNA, 248 bp, Homo sapiens; identical to SEQ ID NO: 74208
  misc_feature 1..248: note = chr12:131513257-131513505
  misc_feature 1..248: note = Hypo
  source 1..248: mol_type = genomic DNA

SEQ ID NO: 108518 - DNA, 56 bp, Homo sapiens; identical to SEQ ID NO: 74209
  misc_feature 1..56: note = chr12:131518701-131518757
  misc_feature 1..56: note = Hypo
  source 1..56: mol_type = genomic DNA

SEQ ID NO: 108519 - DNA, 70 bp, Homo sapiens; identical to SEQ ID NO: 74210
  misc_feature 1..70: note = chr12:131535487-131535557
  misc_feature 1..70: note = Hypo
  source 1..70: mol_type = genomic DNA

SEQ ID NO: 108520 - DNA, 30 bp, Homo sapiens; identical to SEQ ID NO: 74211
  misc_feature 1..30: note = chr12:131544833-131544863
  misc_feature 1..30: note = Hypo
  source 1..30: mol_type = genomic DNA

SEQ ID NO: 108521 - DNA, 27 bp, Homo sapiens
  misc_feature 1..27: note = chr12:131547329-131547356
  misc_feature 1..27: note = Hypo
  source 1..27: mol_type = genomic DNA
atacaagggtcacgtggtaaatatatt

SEQ ID NO: 108522 - DNA, 38 bp, Homo sapiens; identical to SEQ ID NO: 74214
  misc_feature 1..38: note = chr12:131556190-131556228
  misc_feature 1..38: note = Hypo
  source 1..38: mol_type = genomic DNA

SEQ ID NO: 108523 - DNA, 115 bp, Homo sapiens; identical to SEQ ID NO: 74215
  misc_feature 1..115: note = chr12:131569132-131569247
  misc_feature 1..115: note = Hypo
  source 1..115: mol_type = genomic DNA

SEQ ID NO: 108524 - DNA, 30 bp, Homo sapiens; identical to SEQ ID NO: 74216
  misc_feature 1..30: note = chr12:131579447-131579477
  misc_feature 1..30: note = Hypo
  source 1..30: mol_type = genomic DNA

SEQ ID NO: 108525 - DNA, 33 bp, Homo sapiens; identical to SEQ ID NO: 74217
  misc_feature 1..33: note = chr12:131588532-131588565
  misc_feature 1..33: note = Hypo
  source 1..33: mol_type = genomic DNA

SEQ ID NO: 108526 - DNA, 119 bp, Homo sapiens; identical to SEQ ID NO: 74218
  misc_feature 1..119: note = chr12:131615224-131615343
  misc_feature 1..119: note = Hypo
  source 1..119: mol_type = genomic DNA

SEQ ID NO: 108527 - DNA, 198 bp, Homo sapiens; identical to SEQ ID NO: 74219
  misc_feature 1..198: note = chr12:131619032-131619230
  misc_feature 1..198: note = Hypo
  source 1..198: mol_type = genomic DNA

SEQ ID NO: 108528 - DNA, 62 bp, Homo sapiens; identical to SEQ ID NO: 74220
  misc_feature 1..62: note = chr12:131620158-131620220
  misc_feature 1..62: note = Hypo
  source 1..62: mol_type = genomic DNA

SEQ ID NO: 108529 - DNA, 171 bp, Homo sapiens; identical to SEQ ID NO: 74221
  misc_feature 1..171: note = chr12:131621480-131621651
  misc_feature 1..171: note = Hypo
  source 1..171: mol_type = genomic DNA

SEQ ID NO: 108530 - DNA, 73 bp, Homo sapiens; identical to SEQ ID NO: 74222
  misc_feature 1..73: note = chr12:131623324-131623397
  misc_feature 1..73: note = Hypo
  source 1..73: mol_type = genomic DNA

SEQ ID NO: 108531 - DNA, 30 bp, Homo sapiens; identical to SEQ ID NO: 43683
  misc_feature 1..30: note = chr12:131624881-131624911
  misc_feature 1..30: note = Hypo
  source 1..30: mol_type = genomic DNA

SEQ ID NO: 108532 - DNA, 53 bp, Homo sapiens; identical to SEQ ID NO: 74224
  misc_feature 1..53: note = chr12:131649098-131649151
  misc_feature 1..53: note = Hypo
  source 1..53: mol_type = genomic DNA

SEQ ID NO: 108533 - DNA, 42 bp, Homo sapiens; identical to SEQ ID NO: 43684
  misc_feature 1..42: note = chr12:131687270-131687312
  misc_feature 1..42: note = Hypo
  source 1..42: mol_type = genomic DNA

SEQ ID NO: 108534 - DNA, 91 bp, Homo sapiens; identical to SEQ ID NO: 74226
  misc_feature 1..91: note = chr12:131699434-131699525
  misc_feature 1..91: note = Hypo
  source 1..91: mol_type = genomic DNA

SEQ ID NO: 108535 - DNA, 122 bp, Homo sapiens; identical to SEQ ID NO: 74227
  misc_feature 1..122: note = chr12:131700501-131700623
  misc_feature 1..122: note = Hypo
  source 1..122: mol_type = genomic DNA

SEQ ID NO: 108536 - DNA, 87 bp, Homo sapiens; identical to SEQ ID NO: 43685
  misc_feature 1..87: note = chr12:131725445-131725532
  misc_feature 1..87: note = Hypo
  source 1..87: mol_type = genomic DNA

SEQ ID NO: 108537 - DNA, 30 bp, Homo sapiens; identical to SEQ ID NO: 74229
  misc_feature 1..30: note = chr12:131746673-131746703
  misc_feature 1..30: note = Hypo
  source 1..30: mol_type = genomic DNA

SEQ ID NO: 108538 - DNA, 36 bp, Homo sapiens; identical to SEQ ID NO: 74230
  misc_feature 1..36: note = chr12:131750463-131750499
  misc_feature 1..36: note = Hypo
  source 1..36: mol_type = genomic DNA

SEQ ID NO: 108539 - DNA, 33 bp, Homo sapiens; identical to SEQ ID NO: 43686
  misc_feature 1..33: note = chr12:131767017-131767050
  misc_feature 1..33: note = Hypo
  source 1..33: mol_type = genomic DNA

SEQ ID NO: 108540 - DNA, 266 bp, Homo sapiens; identical to SEQ ID NO: 74232
  misc_feature 1..266: note = chr12:131768368-131768634
  misc_feature 1..266: note = Hypo
  source 1..266: mol_type = genomic DNA

SEQ ID NO: 108541 - DNA, 30 bp, Homo sapiens; identical to SEQ ID NO: 43688
  misc_feature 1..30: note = chr12:131769387-131769417
  misc_feature 1..30: note = Hypo
  source 1..30: mol_type = genomic DNA

SEQ ID NO: 108542 - DNA, 37 bp, Homo sapiens; identical to SEQ ID NO: 43689
  misc_feature 1..37: note = chr12:131772177-131772214
  misc_feature 1..37: note = Hypo
  source 1..37: mol_type = genomic DNA

SEQ ID NO: 108543 - DNA, 71 bp, Homo sapiens; identical to SEQ ID NO: 74235
  misc_feature 1..71: note = chr12:131780201-131780272
  misc_feature 1..71: note = Hypo
  source 1..71: mol_type = genomic DNA

SEQ ID NO: 108544 - DNA, 201 bp, Homo sapiens; identical to SEQ ID NO: 74236
  misc_feature 1..201: note = chr12:131801478-131801679
  misc_feature 1..201: note = Hypo
  source 1..201: mol_type = genomic DNA

SEQ ID NO: 108545 - DNA, 67 bp, Homo sapiens; identical to SEQ ID NO: 74237
  misc_feature 1..67: note = chr12:131834197-131834264
  misc_feature 1..67: note = Hypo
  source 1..67: mol_type = genomic DNA

SEQ ID NO: 108546 - DNA, 30 bp, Homo sapiens; identical to SEQ ID NO: 74238
  misc_feature 1..30: note = chr12:131836813-131836843
  misc_feature 1..30: note = Hypo
  source 1..30: mol_type = genomic DNA

SEQ ID NO: 108547 - DNA, 30 bp, Homo sapiens; identical to SEQ ID NO: 43691
  misc_feature 1..30: note = chr12:131850690-131850720
  misc_feature 1..30: note = Hypo
  source 1..30: mol_type = genomic DNA

SEQ ID NO: 108548 - DNA, 259 bp, Homo sapiens; identical to SEQ ID NO: 74240
  misc_feature 1..259: note = chr12:131852223-131852482
  misc_feature 1..259: note = Hypo
  source 1..259: mol_type = genomic DNA

SEQ ID NO: 108549 - DNA, 30 bp, Homo sapiens; identical to SEQ ID NO: 74241
  misc_feature 1..30: note = chr12:131856761-131856791
  misc_feature 1..30: note = Hypo
  source 1..30: mol_type = genomic DNA

SEQ ID NO: 108550 - DNA, 34 bp, Homo sapiens; identical to SEQ ID NO: 74242
  misc_feature 1..34: note = chr12:131927584-131927618
  misc_feature 1..34: note = Hypo
  source 1..34: mol_type = genomic DNA

SEQ ID NO: 108551 - DNA, 329 bp, Homo sapiens; identical to SEQ ID NO: 74243
  misc_feature 1..329: note = chr12:131928780-131929109
  misc_feature 1..329: note = Hypo
  source 1..329: mol_type = genomic DNA

SEQ ID NO: 108552 - DNA, 127 bp, Homo sapiens; identical to SEQ ID NO: 74244
  misc_feature 1..127: note = chr12:131943696-131943823
  misc_feature 1..127: note = Hypo
  source 1..127: mol_type = genomic DNA

SEQ ID NO: 108553 - DNA, 30 bp, Homo sapiens; identical to SEQ ID NO: 74245
  misc_feature 1..30: note = chr12:131966801-131966831
  misc_feature 1..30: note = Hypo
  source 1..30: mol_type = genomic DNA

SEQ ID NO: 108554 - DNA, 83 bp, Homo sapiens; identical to SEQ ID NO: 74246
  misc_feature 1..83: note = chr12:131977760-131977843
  misc_feature 1..83: note = Hypo
  source 1..83: mol_type = genomic DNA

SEQ ID NO: 108555 - DNA, 436 bp, Homo sapiens; identical to SEQ ID NO: 74247
  misc_feature 1..436: note = chr12:131978755-131979191
  misc_feature 1..436: note = Hypo
  source 1..436: mol_type = genomic DNA

SEQ ID NO: 108556 - DNA, 34 bp, Homo sapiens; identical to SEQ ID NO: 74250
  misc_feature 1..34: note = chr12:132025011-132025045
  misc_feature 1..34: note = Hypo
  source 1..34: mol_type = genomic DNA

SEQ ID NO: 108557 - DNA, 286 bp, Homo sapiens; identical to SEQ ID NO: 74251
  misc_feature 1..286: note = chr12:132044061-132044347
  misc_feature 1..286: note = Hypo
  source 1..286: mol_type = genomic DNA

SEQ ID NO: 108558 - DNA, 211 bp, Homo sapiens; identical to SEQ ID NO: 74252
  misc_feature 1..211: note = chr12:132057357-132057568
  misc_feature 1..211: note = Hypo
  source 1..211: mol_type = genomic DNA

SEQ ID NO: 108559 - DNA, 99 bp, Homo sapiens; identical to SEQ ID NO: 74253
  misc_feature 1..99: note = chr12:132060675-132060774
  misc_feature 1..99: note = Hypo
  source 1..99: mol_type = genomic DNA

SEQ ID NO: 108560 - DNA, 30 bp, Homo sapiens; identical to SEQ ID NO: 43696
  misc_feature 1..30: note = chr12:132068982-132069012
  misc_feature 1..30: note = Hypo
  source 1..30: mol_type = genomic DNA

SEQ ID NO: 108561 - DNA, 30 bp, Homo sapiens; identical to SEQ ID NO: 74255
  misc_feature 1..30: note = chr12:132076155-132076185
  misc_feature 1..30: note = Hypo
  source 1..30: mol_type = genomic DNA

SEQ ID NO: 108562 - DNA, 402 bp, Homo sapiens; identical to SEQ ID NO: 74256
  misc_feature 1..402: note = chr12:132076426-132076828
  misc_feature 1..402: note = Hypo
  source 1..402: mol_type = genomic DNA

SEQ ID NO: 108563 - DNA, 66 bp, Homo sapiens; identical to SEQ ID NO: 74257
  misc_feature 1..66: note = chr12:132097008-132097074
  misc_feature 1..66: note = Hypo
  source 1..66: mol_type = genomic DNA

SEQ ID NO: 108564 - DNA, 30 bp, Homo sapiens; identical to SEQ ID NO: 74258
  misc_feature 1..30: note = chr12:132104755-132104785
  misc_feature 1..30: note = Hypo
  source 1..30: mol_type = genomic DNA

SEQ ID NO: 108565 - DNA, 160 bp, Homo sapiens; identical to SEQ ID NO: 74259
  misc_feature 1..160: note = chr12:132106063-132106223
  misc_feature 1..160: note = Hypo
  source 1..160: mol_type = genomic DNA

SEQ ID NO: 108566 - DNA, 155 bp, Homo sapiens; identical to SEQ ID NO: 74261
  misc_feature 1..155: note = chr12:132168266-132168421
  misc_feature 1..155: note = Hypo
  source 1..155: mol_type = genomic DNA

SEQ ID NO: 108567 - DNA, 103 bp, Homo sapiens; identical to SEQ ID NO: 74262
  misc_feature 1..103: note = chr12:132169254-132169357
  misc_feature 1..103: note = Hypo
  source 1..103: mol_type = genomic DNA

SEQ ID NO: 108568 - DNA, 139 bp, Homo sapiens; identical to SEQ ID NO: 74263
  misc_feature 1..139: note = chr12:132171649-132171788
  misc_feature 1..139: note = Hypo
  source 1..139: mol_type = genomic DNA

SEQ ID NO: 108569 - DNA, 83 bp, Homo sapiens; identical to SEQ ID NO: 74264
  misc_feature 1..83: note = chr12:132197162-132197245
  misc_feature 1..83: note = Hypo
  source 1..83: mol_type = genomic DNA

SEQ ID NO: 108570 - DNA, 628 bp, Homo sapiens; identical to SEQ ID NO: 74265
  misc_feature 1..628: note = chr12:132221496-132222124
  misc_feature 1..628: note = Hypo
  source 1..628: mol_type = genomic DNA

SEQ ID NO: 108571 - DNA, 161 bp, Homo sapiens; identical to SEQ ID NO: 74266
  misc_feature 1..161: note = chr12:132240161-132240322
  misc_feature 1..161: note = Hypo
  source 1..161: mol_type = genomic DNA

SEQ ID NO: 108572 - DNA, 30 bp, Homo sapiens; identical to SEQ ID NO: 74267
  misc_feature 1..30: note = chr12:132242801-132242831
  misc_feature 1..30: note = Hypo
  source 1..30: mol_type = genomic DNA

SEQ ID NO: 108573 - DNA, 21 bp, Homo sapiens
  misc_feature 1..21: note = chr12:132244054-132244075
  misc_feature 1..21: note = Hypo
  source 1..21: mol_type = genomic DNA
aaatagtaggccgggcgcggt

SEQ ID NO: 108574 - DNA, 30 bp, Homo sapiens; identical to SEQ ID NO: 74269
  misc_feature 1..30: note = chr12:132259853-132259883
  misc_feature 1..30: note = Hypo
  source 1..30: mol_type = genomic DNA

SEQ ID NO: 108575 - DNA, 30 bp, Homo sapiens; identical to SEQ ID NO: 43704
  misc_feature 1..30: note = chr12:132279981-132280011
  misc_feature 1..30: note = Hypo
  source 1..30: mol_type = genomic DNA

SEQ ID NO: 108576 - DNA, 173 bp, Homo sapiens; identical to SEQ ID NO: 74271
  misc_feature 1..173: note = chr12:132280837-132281010
  misc_feature 1..173: note = Hypo
  source 1..173: mol_type = genomic DNA

SEQ ID NO: 108577 - DNA, 227 bp, Homo sapiens; identical to SEQ ID NO: 74272
  misc_feature 1..227: note = chr12:132284411-132284638
  misc_feature 1..227: note = Hypo
  source 1..227: mol_type = genomic DNA

SEQ ID NO: 108578 - DNA, 221 bp, Homo sapiens; identical to SEQ ID NO: 74273
  misc_feature 1..221: note = chr12:132286008-132286229
  misc_feature 1..221: note = Hypo
  source 1..221: mol_type = genomic DNA

SEQ ID NO: 108579 - DNA, 30 bp, Homo sapiens; identical to SEQ ID NO: 74275
  misc_feature 1..30: note = chr12:132291006-132291036
  misc_feature 1..30: note = Hypo
  source 1..30: mol_type = genomic DNA

SEQ ID NO: 108580 - DNA, 1101 bp, Homo sapiens
  misc_feature 1..1101: note = chr12:132312558-132313659
  misc_feature 1..1101: note = Hyper
  source 1..1101: mol_type = genomic DNA
gcgggctccaccaagcgcccacctgctgcgctgcggcggcggctccggggcctgaacccgggtctgaacccgggcctcggcgccgtggggggtggacccgggagcgcggccggagaggggagtcagggtcagctccccgcaggcgccccgacccccgcctccgcgcccatcccgcgcgtccccgccgccccaagagcgtcctaagacacccggggaaacgccttccctgtgatgccgcggacccagtcccgtcgcggacacggcggggcgggcgggggtggcagcgtccgaggcggcgcgggccctttaaggcggccggcctcgttagcatacatttgcatggccccgccccgccgcttgaggctgccgcgcggggctcagtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggtgagcgcgcgggcgggacgggcgcggagctcctgggccggagccgggggtctccgcgggccgggtggcggggaccgggaagaccccagcagtgcacgtcggcgtcgcgcgggagccctggcgccctggacccatttcctgggtggggagactgaggcagggacgcgggctgagcgaccgggcgagcgcacgcgagtcctggggaggcgccggctgccgtcccggctccgtgcgctgggagcgcgccgcagccgcaggagcccgtggagttgtgagggggtcgcccacccggagcccgggtcgccggcttgcagcagccccggagcagccgggctgggcgagagcaggcatcgcggccgccccgagctctgcgcgctgcgtgcgttccgggtgggagtggcgggggcaggagcacgcacccacaaagcgaggaagggcaggggctacggagtgggggcacc

SEQ ID NO: 108581 - DNA, 30 bp, Homo sapiens; identical to SEQ ID NO: 34771
  misc_feature 1..30: note = chr12:132314800-132314830
  misc_feature 1..30: note = Hyper
  source 1..30: mol_type = genomic DNA

SEQ ID NO: 108582 - DNA, 30 bp, Homo sapiens; identical to SEQ ID NO: 34772
  misc_feature 1..30: note = chr12:132315470-132315500
  misc_feature 1..30: note = Hyper
  source 1..30: mol_type = genomic DNA

SEQ ID NO: 108583 - DNA, 47 bp, Homo sapiens; identical to SEQ ID NO: 74280
  misc_feature 1..47: note = chr12:132323460-132323507
  misc_feature 1..47: note = Hypo
  source 1..47: mol_type = genomic DNA

SEQ ID NO: 108584 - DNA, 321 bp, Homo sapiens; identical to SEQ ID NO: 74281
  misc_feature 1..321: note = chr12:132325069-132325390
  misc_feature 1..321: note = Hypo
  source 1..321: mol_type = genomic DNA

SEQ ID NO: 108585 - DNA, 511 bp, Homo sapiens; identical to SEQ ID NO: 74282
  misc_feature 1..511: note = chr12:132329560-132330071
  misc_feature 1..511: note = Hypo
  source 1..511: mol_type = genomic DNA

SEQ ID NO: 108586 - DNA, 197 bp, Homo sapiens; identical to SEQ ID NO: 74283
  misc_feature 1..197: note = chr12:132332952-132333149
  misc_feature 1..197: note = Hypo
  source 1..197: mol_type = genomic DNA

SEQ ID NO: 108587 - DNA, 32 bp, Homo sapiens; identical to SEQ ID NO: 74284
  misc_feature 1..32: note = chr12:132333386-132333418
  misc_feature 1..32: note = Hypo
  source 1..32: mol_type = genomic DNA

SEQ ID NO: 108588 - DNA, 211 bp, Homo sapiens; identical to SEQ ID NO: 74285
  misc_feature 1..211: note = chr12:132333478-132333689
  misc_feature 1..211: note = Hypo
  source 1..211: mol_type = genomic DNA

SEQ ID NO: 108589 - DNA, 30 bp, Homo sapiens; identical to SEQ ID NO: 74286
  misc_feature 1..30: note = chr12:132334483-132334513
  misc_feature 1..30: note = Hypo
  source 1..30: mol_type = genomic DNA

SEQ ID NO: 108590 - DNA, 224 bp, Homo sapiens; identical to SEQ ID NO: 74287
  misc_feature 1..224: note = chr12:132335471-132335695
  misc_feature 1..224: note = Hypo
  source 1..224: mol_type = genomic DNA

SEQ ID NO: 108591 - DNA, 393 bp, Homo sapiens; identical to SEQ ID NO: 74288
  misc_feature 1..393: note = chr12:132336227-132336620
  misc_feature 1..393: note = Hypo
  source 1..393: mol_type = genomic DNA

SEQ ID NO: 108592 - DNA, 35 bp, Homo sapiens; identical to SEQ ID NO: 74289
  misc_feature 1..35: note = chr12:132338738-132338773
  misc_feature 1..35: note = Hypo
  source 1..35: mol_type = genomic DNA

SEQ ID NO: 108593 - DNA, 176 bp, Homo sapiens; identical to SEQ ID NO: 74290
  misc_feature 1..176: note = chr12:132348560-132348736
  misc_feature 1..176: note = Hypo
  source 1..176: mol_type = genomic DNA

SEQ ID NO: 108594 - DNA, 376 bp, Homo sapiens; identical to SEQ ID NO: 74291
  misc_feature 1..376: note = chr12:132349603-132349979
  misc_feature 1..376: note = Hypo
  source 1..376: mol_type = genomic DNA

SEQ ID NO: 108595 - DNA, 49 bp, Homo sapiens; identical to SEQ ID NO: 74292
  misc_feature 1..49: note = chr12:132377450-132377499
  misc_feature 1..49: note = Hypo
  source 1..49: mol_type = genomic DNA

SEQ ID NO: 108596 - DNA, 129 bp, Homo sapiens; identical to SEQ ID NO: 74293
  misc_feature 1..129: note = chr12:132377954-132378083
  misc_feature 1..129: note = Hypo
  source 1..129: mol_type = genomic DNA

SEQ ID NO: 108597 - DNA, 30 bp, Homo sapiens; identical to SEQ ID NO: 74294
  misc_feature 1..30: note = chr12:132406501-132406531
  misc_feature 1..30: note = Hypo
  source 1..30: mol_type = genomic DNA

SEQ ID NO: 108598 - DNA, 37 bp, Homo sapiens; identical to SEQ ID NO: 43716
  misc_feature 1..37: note = chr12:132415173-132415210
  misc_feature 1..37: note = Hypo
  source 1..37: mol_type = genomic DNA

SEQ ID NO: 108599 - DNA, 37 bp, Homo sapiens; identical to SEQ ID NO: 43717
  misc_feature 1..37: note = chr12:132415270-132415307
  misc_feature 1..37: note = Hypo
  source 1..37: mol_type = genomic DNA

SEQ ID NO: 108600 - DNA, 157 bp, Homo sapiens; identical to SEQ ID NO: 43718
  misc_feature 1..157: note = chr12:132423589-132423746
  misc_feature 1..157: note = Hypo
  source 1..157: mol_type = genomic DNA

SEQ ID NO: 108601 - DNA, 30 bp, Homo sapiens; identical to SEQ ID NO: 74298
  misc_feature 1..30: note = chr12:132429244-132429274
  misc_feature 1..30: note = Hypo
  source 1..30: mol_type = genomic DNA

SEQ ID NO: 108602 - DNA, 44 bp, Homo sapiens; identical to SEQ ID NO: 74299
  misc_feature 1..44: note = chr12:132566992-132567036
  misc_feature 1..44: note = Hypo
  source 1..44: mol_type = genomic DNA

SEQ ID NO: 108603 - DNA, 249 bp, Homo sapiens; identical to SEQ ID NO: 74300
  misc_feature 1..249: note = chr12:132593124-132593373
  misc_feature 1..249: note = Hypo
  source 1..249: mol_type = genomic DNA

SEQ ID NO: 108604 - DNA, 38 bp, Homo sapiens; identical to SEQ ID NO: 74301
  misc_feature 1..38: note = chr12:132616617-132616655
  misc_feature 1..38: note = Hypo
  source 1..38: mol_type = genomic DNA

SEQ ID NO: 108605 - DNA, 522 bp, Homo sapiens; identical to SEQ ID NO: 74302
  misc_feature 1..522: note = chr12:132617183-132617705
  misc_feature 1..522: note = Hypo
  source 1..522: mol_type = genomic DNA

SEQ ID NO: 108606 - DNA, 150 bp, Homo sapiens; identical to SEQ ID NO: 74303
  misc_feature 1..150: note = chr12:132619054-132619204
  misc_feature 1..150: note = Hypo
  source 1..150: mol_type = genomic DNA

SEQ ID NO: 108607 - DNA, 70 bp, Homo sapiens; identical to SEQ ID NO: 74304
  misc_feature 1..70: note = chr12:132643455-132643525
  misc_feature 1..70: note = Hypo
  source 1..70: mol_type = genomic DNA

SEQ ID NO: 108608 - DNA, 163 bp, Homo sapiens; identical to SEQ ID NO: 74305
  misc_feature 1..163: note = chr12:132643845-132644008
  misc_feature 1..163: note = Hypo
  source 1..163: mol_type = genomic DNA

SEQ ID NO: 108609 - DNA, 30 bp, Homo sapiens; identical to SEQ ID NO: 74306
  misc_feature 1..30: note = chr12:132644527-132644557
  misc_feature 1..30: note = Hypo
  source 1..30: mol_type = genomic DNA

SEQ ID NO: 108610 - DNA, 337 bp, Homo sapiens; identical to SEQ ID NO: 74307
  misc_feature 1..337: note = chr12:132648196-132648533
  misc_feature 1..337: note = Hypo
  source 1..337: mol_type = genomic DNA

SEQ ID NO: 108611 - DNA, 30 bp, Homo sapiens; identical to SEQ ID NO: 74308
  misc_feature 1..30: note = chr12:132651886-132651916
  misc_feature 1..30: note = Hypo
  source 1..30: mol_type = genomic DNA

SEQ ID NO: 108612 - DNA, 231 bp, Homo sapiens; identical to SEQ ID NO: 74309
  misc_feature 1..231: note = chr12:132652953-132653184
  misc_feature 1..231: note = Hypo
  source 1..231: mol_type = genomic DNA

SEQ ID NO: 108613 - DNA, 30 bp, Homo sapiens; identical to SEQ ID NO: 74310
  misc_feature 1..30: note = chr12:132654109-132654139
  misc_feature 1..30: note = Hypo
  source 1..30: mol_type = genomic DNA

SEQ ID NO: 108614 - DNA, 30 bp, Homo sapiens; identical to SEQ ID NO: 74311
  misc_feature 1..30: note = chr12:132656988-132657018
  misc_feature 1..30: note = Hypo
  source 1..30: mol_type = genomic DNA

SEQ ID NO: 108615 - DNA, 30 bp, Homo sapiens; identical to SEQ ID NO: 74312
  misc_feature 1..30: note = chr12:132658236-132658266
  misc_feature 1..30: note = Hypo
  source 1..30: mol_type = genomic DNA

SEQ ID NO: 108616 - DNA, 125 bp, Homo sapiens; identical to SEQ ID NO: 74313
  misc_feature 1..125: note = chr12:132666377-132666502
  misc_feature 1..125: note = Hypo
  source 1..125: mol_type = genomic DNA

SEQ ID NO: 108617 - DNA, 30 bp, Homo sapiens; identical to SEQ ID NO: 74314
  misc_feature 1..30: note = chr12:132672104-132672134
  misc_feature 1..30: note = Hypo
  source 1..30: mol_type = genomic DNA

SEQ ID NO: 108618 - DNA, 30 bp, Homo sapiens; identical to SEQ ID NO: 74315
  misc_feature 1..30: note = chr12:132675830-132675860
  misc_feature 1..30: note = Hypo
  source 1..30: mol_type = genomic DNA

SEQ ID NO: 108619 - DNA, 219 bp, Homo sapiens; identical to SEQ ID NO: 74316
  misc_feature 1..219: note = chr12:132677480-132677699
  misc_feature 1..219: note = Hypo
  source 1..219: mol_type = genomic DNA

SEQ ID NO: 108620 - DNA, 123 bp, Homo sapiens; identical to SEQ ID NO: 74317
  misc_feature 1..123: note = chr12:132682557-132682680
  misc_feature 1..123: note = Hypo
  source 1..123: mol_type = genomic DNA

SEQ ID NO: 108621 - DNA, 157 bp, Homo sapiens; identical to SEQ ID NO: 74318
  misc_feature 1..157: note = chr12:132683736-132683893
  misc_feature 1..157: note = Hypo
  source 1..157: mol_type = genomic DNA

SEQ ID NO: 108622 - DNA, 288 bp, Homo sapiens; identical to SEQ ID NO: 43726
  misc_feature 1..288: note = chr12:132687989-132688277
  misc_feature 1..288: note = Hypo
  source 1..288: mol_type = genomic DNA

SEQ ID NO: 108623 - DNA, 198 bp, Homo sapiens; identical to SEQ ID NO: 74320
  misc_feature 1..198: note = chr12:132691172-132691370
  misc_feature 1..198: note = Hypo
  source 1..198: mol_type = genomic DNA

SEQ ID NO: 108624 - DNA, 232 bp, Homo sapiens; identical to SEQ ID NO: 74321
  misc_feature 1..232: note = chr12:132694804-132695036
  misc_feature 1..232: note = Hypo
  source 1..232: mol_type = genomic DNA

SEQ ID NO: 108625 - DNA, 64 bp, Homo sapiens; identical to SEQ ID NO: 74322
  misc_feature 1..64: note = chr12:132699804-132699868
  misc_feature 1..64: note = Hypo
  source 1..64: mol_type = genomic DNA

SEQ ID NO: 108626 - DNA, 373 bp, Homo sapiens; identical to SEQ ID NO: 74323
  misc_feature 1..373: note = chr12:132983393-132983766
  misc_feature 1..373: note = Hypo
  source 1..373: mol_type = genomic DNA

SEQ ID NO: 108627 - DNA, 48 bp, Homo sapiens; identical to SEQ ID NO: 43730
  misc_feature 1..48: note = chr12:132985665-132985713
  misc_feature 1..48: note = Hypo
  source 1..48: mol_type = genomic DNA

SEQ ID NO: 108628 - DNA, 250 bp, Homo sapiens; identical to SEQ ID NO: 74325
  misc_feature 1..250: note = chr12:132986451-132986701
  misc_feature 1..250: note = Hypo
  source 1..250: mol_type = genomic DNA

SEQ ID NO: 108629 - DNA, 211 bp, Homo sapiens; identical to SEQ ID NO: 74326
  misc_feature 1..211: note = chr12:132987301-132987512
  misc_feature 1..211: note = Hypo
  source 1..211: mol_type = genomic DNA

SEQ ID NO: 108630 - DNA, 106 bp, Homo sapiens; identical to SEQ ID NO: 74327
  misc_feature 1..106: note = chr12:132988517-132988623
  misc_feature 1..106: note = Hypo
  source 1..106: mol_type = genomic DNA

SEQ ID NO: 108631 - DNA, 30 bp, Homo sapiens; identical to SEQ ID NO: 74328
  misc_feature 1..30: note = chr12:132993581-132993611
  misc_feature 1..30: note = Hypo
  source 1..30: mol_type = genomic DNA

SEQ ID NO: 108632 - DNA, 30 bp, Homo sapiens; identical to SEQ ID NO: 74329
  misc_feature 1..30: note = chr12:133000092-133000122
  misc_feature 1..30: note = Hypo
  source 1..30: mol_type = genomic DNA

SEQ ID NO: 108633 - DNA, 583 bp, Homo sapiens; identical to SEQ ID NO: 74330
  misc_feature 1..583: note = chr12:133002792-133003375
  misc_feature 1..583: note = Hypo
  source 1..583: mol_type = genomic DNA

SEQ ID NO: 108634 - DNA, 318 bp, Homo sapiens; identical to SEQ ID NO: 74331
  misc_feature 1..318: note = chr12:133019701-133020019
  misc_feature 1..318: note = Hypo
  source 1..318: mol_type = genomic DNA

SEQ ID NO: 108635 - DNA, 30 bp, Homo sapiens; identical to SEQ ID NO: 74332
  misc_feature 1..30: note = chr12:133035008-133035038
  misc_feature 1..30: note = Hypo
  source 1..30: mol_type = genomic DNA

SEQ ID NO: 108636 - DNA, 190 bp, Homo sapiens; identical to SEQ ID NO: 43736
  misc_feature 1..190: note = chr12:133035657-133035847
  misc_feature 1..190: note = Hypo
  source 1..190: mol_type = genomic DNA

SEQ ID NO: 108637 - DNA, 30 bp, Homo sapiens; identical to SEQ ID NO: 74334
  misc_feature 1..30: note = chr12:133036250-133036280
  misc_feature 1..30: note = Hypo
  source 1..30: mol_type = genomic DNA

SEQ ID NO: 108638 - DNA, 92 bp, Homo sapiens; identical to SEQ ID NO: 74335
  misc_feature 1..92: note = chr12:133056788-133056880
  misc_feature 1..92: note = Hypo
  source 1..92: mol_type = genomic DNA

SEQ ID NO: 108639 - DNA, 30 bp, Homo sapiens; identical to SEQ ID NO: 74336
  misc_feature 1..30: note = chr12:133058946-133058976
  misc_feature 1..30: note = Hypo
  source 1..30: mol_type = genomic DNA

SEQ ID NO: 108640 - DNA, 244 bp, Homo sapiens; identical to SEQ ID NO: 74337
  misc_feature 1..244: note = chr12:133060744-133060988
  misc_feature 1..244: note = Hypo
  source 1..244: mol_type = genomic DNA

SEQ ID NO: 108641 - DNA, 179 bp, Homo sapiens; identical to SEQ ID NO: 74338
  misc_feature 1..179: note = chr12:133098374-133098553
  misc_feature 1..179: note = Hypo
  source 1..179: mol_type = genomic DNA

SEQ ID NO: 108642 - DNA, 80 bp, Homo sapiens; identical to SEQ ID NO: 74339
  misc_feature 1..80: note = chr12:133100375-133100455
  misc_feature 1..80: note = Hypo
  source 1..80: mol_type = genomic DNA

SEQ ID NO: 108643 - DNA, 264 bp, Homo sapiens; identical to SEQ ID NO: 74340
  misc_feature 1..264: note = chr12:133100756-133101020
  misc_feature 1..264: note = Hypo
  source 1..264: mol_type = genomic DNA

SEQ ID NO: 108644 - DNA, 30 bp, Homo sapiens; identical to SEQ ID NO: 74341
  misc_feature 1..30: note = chr12:133101497-133101527
  misc_feature 1..30: note = Hypo
  source 1..30: mol_type = genomic DNA

SEQ ID NO: 108645 - DNA, 40 bp, Homo sapiens; identical to SEQ ID NO: 74342
  misc_feature 1..40: note = chr12:133122176-133122216
  misc_feature 1..40: note = Hypo
  source 1..40: mol_type = genomic DNA

SEQ ID NO: 108646 - DNA, 93 bp, Homo sapiens; identical to SEQ ID NO: 74343
  misc_feature 1..93: note = chr12:133130872-133130965
  misc_feature 1..93: note = Hypo
  source 1..93: mol_type = genomic DNA

SEQ ID NO: 108647 - DNA, 30 bp, Homo sapiens; identical to SEQ ID NO: 74344
  misc_feature 1..30: note = chr12:133161681-133161711
  misc_feature 1..30: note = Hypo
  source 1..30: mol_type = genomic DNA

SEQ ID NO: 108648 - DNA, 30 bp, Homo sapiens; identical to SEQ ID NO: 43741
  misc_feature 1..30: note = chr12:133167902-133167932
  misc_feature 1..30: note = Hypo
  source 1..30: mol_type = genomic DNA

SEQ ID NO: 108649 - DNA, 95 bp, Homo sapiens; identical to SEQ ID NO: 74346
  misc_feature 1..95: note = chr12:133168198-133168293
  misc_feature 1..95: note = Hypo
  source 1..95: mol_type = genomic DNA

SEQ ID NO: 108650 - DNA, 30 bp, Homo sapiens; identical to SEQ ID NO: 74347
  misc_feature 1..30: note = chr12:133168945-133168975
  misc_feature 1..30: note = Hypo
  source 1..30: mol_type = genomic DNA

SEQ ID NO: 108651 - DNA, 256 bp, Homo sapiens; identical to SEQ ID NO: 43742
  misc_feature 1..256: note = chr12:133169847-133170103
  misc_feature 1..256: note = Hypo
  source 1..256: mol_type = genomic DNA

SEQ ID NO: 108652 - DNA, 30 bp, Homo sapiens; identical to SEQ ID NO: 74349
  misc_feature 1..30: note = chr12:133172661-133172691
  misc_feature 1..30: note = Hypo
  source 1..30: mol_type = genomic DNA

SEQ ID NO: 108653 - DNA, 24 bp, Homo sapiens
  misc_feature 1..24: note = chr12:133174537-133174561
  misc_feature 1..24: note = Hyper
  source 1..24: mol_type = genomic DNA
cgcctcctctccgcgcgcccctcc

SEQ ID NO: 108654 - DNA, 87 bp, Homo sapiens; identical to SEQ ID NO: 74351
  misc_feature 1..87: note = chr12:133175277-133175364
  misc_feature 1..87: note = Hyper
  source 1..87: mol_type = genomic DNA

SEQ ID NO: 108655 - DNA, 30 bp, Homo sapiens; identical to SEQ ID NO: 74352
  misc_feature 1..30: note = chr12:133178414-133178444
  misc_feature 1..30: note = Hypo
  source 1..30: mol_type = genomic DNA

SEQ ID NO: 108656 - DNA, 170 bp, Homo sapiens; identical to SEQ ID NO: 74353
  misc_feature 1..170: note = chr12:133187664-133187834
  misc_feature 1..170: note = Hypo
  source 1..170: mol_type = genomic DNA

SEQ ID NO: 108657 - DNA, 136 bp, Homo sapiens; identical to SEQ ID NO: 74354
  misc_feature 1..136: note = chr12:133188323-133188459
  misc_feature 1..136: note = Hypo
  source 1..136: mol_type = genomic DNA

SEQ ID NO: 108658 - DNA, 775 bp, Homo sapiens
  misc_feature 1..775: note = chr12:133194853-133195628
  misc_feature 1..775: note = Hyper
  source 1..775: mol_type = genomic DNA
ttgcaaagaagaaaacggatcggccgtggatccctctccagctcgagggctggagctgcggcggaggcaggagctggaagcgaggcgtctgctggcaaaggcgggagtgcaggttgcgctcgaagccccggcagccgcggcaggaaccggcctggacggggtggggggcgccgcggaggccggcgggacttcccatgtctttctcctcgagctcggaaaaagttcccacccggggaatcccgaccctccaacttcgagaccgccggttccgcgctcggcccccacctggaccaagagctggggctgggctgccgcgcccccggctctgtccccgcgaggccccgctcccagccccacctgggacacccgggactcccgggacacctgcggggcggggcggggccggggcgaggcggggcgggctcgaggccgcaccccggaggcggagccgcgagctacccgcccgccgcgcgccccccgctctcggtgcgcagcggggccgaccctcagccctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtgcgcggggcgcggggtgcggggcgcggggtgcggggcgcaggggaggggct

SEQ ID NO: 108659 - DNA, 106 bp, Homo sapiens
  misc_feature 1..106: note = chr12:133195878-133195984
  misc_feature 1..106: note = Hyper
  source 1..106: mol_type = genomic DNA
ggctggggctgggaccgagggcgcggggcaggccccaagagccccgcagagcggacccgggtcgcgggagggcccctgccgtgcctgcgggcgggactcagccttc

SEQ ID NO: 108660 - DNA, 49 bp, Homo sapiens; identical to SEQ ID NO: 74360
  misc_feature 1..49: note = chr12:133199652-133199701
  misc_feature 1..49: note = Hypo
  source 1..49: mol_type = genomic DNA

SEQ ID NO: 108661 - DNA, 89 bp, Homo sapiens; identical to SEQ ID NO: 74361
  misc_feature 1..89: note = chr12:133200001-133200090
  misc_feature 1..89: note = Hypo
  source 1..89: mol_type = genomic DNA

SEQ ID NO: 108662 - DNA, 34 bp, Homo sapiens; identical to SEQ ID NO: 74362
  misc_feature 1..34: note = chr12:133262748-133262782
  misc_feature 1..34: note = Hypo
  source 1..34: mol_type = genomic DNA

SEQ ID NO: 108663 - DNA, 30 bp, Homo sapiens; identical to SEQ ID NO: 74363
  misc_feature 1..30: note = chr12:133295960-133295990
  misc_feature 1..30: note = Hypo
  source 1..30: mol_type = genomic DNA

SEQ ID NO: 108664 - DNA, 24 bp, Homo sapiens
  misc_feature 1..24: note = chr12:133334005-133334029
  misc_feature 1..24: note = Hypo
  source 1..24: mol_type = genomic DNA
cacctgtcaccccagcgcttgggg

SEQ ID NO: 108665 - DNA, 363 bp, Homo sapiens; identical to SEQ ID NO: 74365
  misc_feature 1..363: note = chr12:133428083-133428446
  misc_feature 1..363: note = Hypo
  source 1..363: mol_type = genomic DNA

SEQ ID NO: 108666 - DNA, 40 bp, Homo sapiens; identical to SEQ ID NO: 74366
  misc_feature 1..40: note = chr12:133453650-133453690
  misc_feature 1..40: note = Hypo
  source 1..40: mol_type = genomic DNA

SEQ ID NO: 108667 - DNA, 85 bp, Homo sapiens; identical to SEQ ID NO: 74367
  misc_feature 1..85: note = chr12:133463015-133463100
  misc_feature 1..85: note = Hypo
  source 1..85: mol_type = genomic DNA

SEQ ID NO: 108668 - DNA, 402 bp, Homo sapiens; identical to SEQ ID NO: 74368
  misc_feature 1..402: note = chr12:133463573-133463975
  misc_feature 1..402: note = Hyper
  source 1..402: mol_type = genomic DNA

SEQ ID NO: 108669 - DNA, 152 bp, Homo sapiens; identical to SEQ ID NO: 74369
  misc_feature 1..152: note = chr12:133464403-133464555
  misc_feature 1..152: note = Hyper
  source 1..152: mol_type = genomic DNA

SEQ ID NO: 108670 - DNA, 147 bp, Homo sapiens; identical to SEQ ID NO: 74370
  misc_feature 1..147: note = chr12:133464773-133464920
  misc_feature 1..147: note = Hyper
  source 1..147: mol_type = genomic DNA

SEQ ID NO: 108671 - DNA, 287 bp, Homo sapiens
  misc_feature 1..287: note = chr12:133481368-133481655
  misc_feature 1..287: note = Hyper
  source 1..287: mol_type = genomic DNA
gaagcttttcctcaccgaagacgcggcctcaagtcatccccaagccggggctcctgggtggcttctcaggaagccaagctccctcaccctgtggcgacgccgcgggcggaatgcgcatgcgcgccacgagccacaatcgtagggttgggcgcgccctgccggccaccaggggcagcgcaggagctgagcgcaccccatcagcgaaagaagcgcgcctccccgctcttttctgaaccgtatctcctaaactataattttggagatcaaaagtgcggtggagcctcctc

SEQ ID NO: 108672 - DNA, 34 bp, Homo sapiens; identical to SEQ ID NO: 74374
  misc_feature 1..34: note = chr12:133483182-133483216
  misc_feature 1..34: note = Hypo
  source 1..34: mol_type = genomic DNA

SEQ ID NO: 108673 - DNA, 1284 bp, Homo sapiens
  misc_feature 1..1284: note = chr12:133484586-133485870
  misc_feature 1..1284: note = Hyper
  source 1..1284: mol_type = genomic DNA
cgcccggcctcagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtcacgagtagatgaacacatttaaagtttgtagttaagaggaaaacaacgccaacgacacaaatgccccaagcgctggatgaagcagcgacctaggatggggctggcctggaacgggaaccaagacgcccgcccggacgaaaacgagcagggaaacccgggccggggtcggccgccccacacgacgcactgcgcagagaccacgcggctccgggtctcgcctgcgccggcgcatccctcgcagacgcgctcctcccacgcgagggccccttccccgaagcgcacgcctaagactgcgcgccgcagcccgccctgtctagctgaggcgcagacccggatgggtcccagaggggcgggtcggggcggagagccgcgcccaaaggcaatgggagccgcacgctgctaggcaacatgctgtctcccggcaacgtagaggcggggaattcgccaacgtgtctgaaacagacaacaattttagccaacggctgcgtgggccttgggcgtcctggccaatgggaatagtgaggggcctgtcactaagaaacctgtccctgagcaacgcataggaggggtggaacccagcagcgctgactgagccgccgcgaagtgccggaacgtattacctgggagccaaatttcagagcgtcgtttgtcttcccaagcccaccagctttcagcgttctccagcctcgccacacccccgcctcgggccgtccccgcccagacgcttgtccccgcgagaagctgagcgcactgaagtgagcccggcggctgccgccggaggaggagcccggctctggacacggccgtcaggaagctcagaggctgcagcaccgcttctgcgttgatttccgcttgacttttactcttttcttgggttaaaaatcaaacgccgacccgaggcgtcagagatgggcggtcgttaggcgcagtggcggcccccggatgtttgcgatgggacggcgggctcggaacgtgtggacgtgggctttggaggtgcgagccccattgggccagggctgggtccgggcagtggtacggggtctcagctgtccgtcacaggagatgtgcaggcctcgtcatctggggtcttacgtgtcagtgatgtggggtctgccgggtcagtgagggg

SEQ ID NO: 108674 - DNA, 91 bp, Homo sapiens; identical to SEQ ID NO: 74379
  misc_feature 1..91: note = chr12:133705743-133705834
  misc_feature 1..91: note = Hypo
  source 1..91: mol_type = genomic DNA

SEQ ID NO: 108675 - DNA, 231 bp, Homo sapiens; identical to SEQ ID NO: 74380
  misc_feature 1..231: note = chr12:133757970-133758201
  misc_feature 1..231: note = Hyper
  source 1..231: mol_type = genomic DNA

SEQ ID NO: 108676 - DNA, 49 bp, Homo sapiens; identical to SEQ ID NO: 74381
  misc_feature 1..49: note = chr12:133758523-133758572
  misc_feature 1..49: note = Hyper
  source 1..49: mol_type = genomic DNA

SEQ ID NO: 108677 - DNA, 30 bp, Homo sapiens; identical to SEQ ID NO: 74382
  misc_feature 1..30: note = chr12:133808200-133808230
  misc_feature 1..30: note = Hypo
  source 1..30: mol_type = genomic DNA

SEQ ID NO: 108678 - DNA, 259 bp, Homo sapiens; identical to SEQ ID NO: 75729
  misc_feature 1..259: note = chr13:19517655-19517914
  misc_feature 1..259: note = Hypo
  source 1..259: mol_type = genomic DNA

SEQ ID NO: 108679 - DNA, 44 bp, Homo sapiens; identical to SEQ ID NO: 75730
  misc_feature 1..44: note = chr13:19537201-19537245
  misc_feature 1..44: note = Hypo
  source 1..44: mol_type = genomic DNA

SEQ ID NO: 108680 - DNA, 106 bp, Homo sapiens; identical to SEQ ID NO: 75731
  misc_feature 1..106: note = chr13:19756080-19756186
  misc_feature 1..106: note = Hypo
  source 1..106: mol_type = genomic DNA

SEQ ID NO: 108681 - DNA, 30 bp, Homo sapiens; identical to SEQ ID NO: 75732
  misc_feature 1..30: note = chr13:19964867-19964897
  misc_feature 1..30: note = Hypo
  source 1..30: mol_type = genomic DNA

SEQ ID NO: 108682 - DNA, 101 bp, Homo sapiens; identical to SEQ ID NO: 43749
  misc_feature 1..101: note = chr13:20078200-20078301
  misc_feature 1..101: note = Hypo
  source 1..101: mol_type = genomic DNA

SEQ ID NO: 108683 - DNA, 30 bp, Homo sapiens; identical to SEQ ID NO: 75734
  misc_feature 1..30: note = chr13:20138821-20138851
  misc_feature 1..30: note = Hypo
  source 1..30: mol_type = genomic DNA

SEQ ID NO: 108684 - DNA, 78 bp, Homo sapiens; identical to SEQ ID NO: 75735
  misc_feature 1..78: note = chr13:20312627-20312705
  misc_feature 1..78: note = Hypo
  source 1..78: mol_type = genomic DNA

SEQ ID NO: 108685 - DNA, 87 bp, Homo sapiens; identical to SEQ ID NO: 43750
  misc_feature 1..87: note = chr13:20392358-20392445
  misc_feature 1..87: note = Hypo
  source 1..87: mol_type = genomic DNA

SEQ ID NO: 108686 - DNA, 63 bp, Homo sapiens; identical to SEQ ID NO: 75737
  misc_feature 1..63: note = chr13:20500420-20500483
  misc_feature 1..63: note = Hypo
  source 1..63: mol_type = genomic DNA

SEQ ID NO: 108687 - DNA, 30 bp, Homo sapiens; identical to SEQ ID NO: 75738
  misc_feature 1..30: note = chr13:20531916-20531946
  misc_feature 1..30: note = Hyper
  source 1..30: mol_type = genomic DNA

SEQ ID NO: 108688 - DNA, 27 bp, Homo sapiens
  misc_feature 1..27: note = chr13:20692250-20692277
  misc_feature 1..27: note = Hypo
  source 1..27: mol_type = genomic DNA
cgtgagccactgcgcctggccacattt

SEQ ID NO: 108689 - DNA, 166 bp, Homo sapiens; identical to SEQ ID NO: 75740
  misc_feature 1..166: note = chr13:20692809-20692975
  misc_feature 1..166: note = Hyper
  source 1..166: mol_type = genomic DNA

SEQ ID NO: 108690 - DNA, 151 bp, Homo sapiens; identical to SEQ ID NO: 75741
  misc_feature 1..151: note = chr13:20701930-20702081
  misc_feature 1..151: note = Hyper
  source 1..151: mol_type = genomic DNA

SEQ ID NO: 108691 - DNA, 129 bp, Homo sapiens; identical to SEQ ID NO: 75742
  misc_feature 1..129: note = chr13:20702784-20702913
  misc_feature 1..129: note = Hyper
  source 1..129: mol_type = genomic DNA

SEQ ID NO: 108692 - DNA, 128 bp, Homo sapiens; identical to SEQ ID NO: 75743
  misc_feature 1..128: note = chr13:20734542-20734670
  misc_feature 1..128: note = Hyper
  source 1..128: mol_type = genomic DNA

SEQ ID NO: 108693 - DNA, 678 bp, Homo sapiens
  misc_feature 1..678: note = chr13:20735432-20736110
  misc_feature 1..678: note = Hyper
  source 1..678: mol_type = genomic DNA
ggggctcttccctgccgcctacgcactccggggcatgcccgcgcgggacgtgagaggagagccgagggctgttggggcgggcccgacccgcttgcggggcgcccaccgcacgcagatgcgccagcccgcgccccgctcgcgcctgtcctgggcttcgcaggcccggcgaggtagctgctctccgggcgctcccacggtcggaggcgcgtgggcgtcgggcacctaggtctcgcccgcctgcagccgcctggggacgcgggttccggacggctggcgcggggcggggcggggaccaccgagcaggaagtccccgcggaagcgccgccgggcacagcgtgggtgctgtcgaggagtggcgcccgggcggggcgggaggttataaatagcggccgccatcctgcttctcttcagacacacttaatttagccggcaggcacacggatgcttatttttaaaaaaagaacttgttttattgcgctcgaggtgaccgggaaggtgtccccgcgggtcactcgctccatctggtcctggagacgagatgccagggcgaggcctaacctgcctgctggcgcccaacgaagattttaacgttttctgttcccttcggggtggttttaccacgcttgagagggacgcctaccgcggaaggccgcggaccgagggcggcatcgcgtcctt

SEQ ID NO: 108694 - DNA, 90 bp, Homo sapiens; identical to SEQ ID NO: 75746
  misc_feature 1..90: note = chr13:20766251-20766341
  misc_feature 1..90: note = Hyper
  source 1..90: mol_type = genomic DNA

SEQ ID NO: 108695 - DNA, 714 bp, Homo sapiens; identical to SEQ ID NO: 75747
  misc_feature 1..714: note = chr13:20805970-20806684
  misc_feature 1..714: note = Hyper
  source 1..714: mol_type = genomic DNA

SEQ ID NO: 108696 - DNA, 332 bp, Homo sapiens
  misc_feature 1..332: note = chr13:20875611-20875943
  misc_feature 1..332: note = Hyper
  source 1..332: mol_type = genomic DNA
gggctggtccgattgcgccggctgcgcagcgcttcccagaaaccgcgcttggtgatgttggaggcctggatcgggctctggtggagggtgtttaccaccaggccccacgccctgggtcttgccctctggaacggcagcaggcgcgctcccggcgaatctgcctgaatcgccgtgaatgcggtggggtgcagggcaggggctggttttctcagccggtcttggcttttctctttctctcctgctccaccagcagcccctccgcgggtcccatgggctccgcgctcagaacagcccggaaccaggcgccgctcgccgctcgctgggggccaccc

SEQ ID NO: 108697 - DNA, 154 bp, Homo sapiens; identical to SEQ ID NO: 75749
  misc_feature 1..154: note = chr13:21057336-21057490
  misc_feature 1..154: note = Hypo
  source 1..154: mol_type = genomic DNA

SEQ ID NO: 108698 - DNA, 33 bp, Homo sapiens; identical to SEQ ID NO: 75750
  misc_feature 1..33: note = chr13:21057550-21057583
  misc_feature 1..33: note = Hypo
  source 1..33: mol_type = genomic DNA

SEQ ID NO: 108699 - DNA, 30 bp, Homo sapiens; identical to SEQ ID NO: 75751
  misc_feature 1..30: note = chr13:21475790-21475820
  misc_feature 1..30: note = Hypo
  source 1..30: mol_type = genomic DNA

SEQ ID NO: 108700 - DNA, 95 bp, Homo sapiens
  misc_feature 1..95: note = chr13:21520313-21520408
  misc_feature 1..95: note = Hyper
  source 1..95: mol_type = genomic DNA
agggtgtgaagagatcgggagtcctctgcgaggctctggagcacccggcgcctaagaggctagtgcgccccgtgccgctgcggtaggacctggcg

SEQ ID NO: 108701 - DNA, 30 bp, Homo sapiens; identical to SEQ ID NO: 75753
  misc_feature 1..30: note = chr13:21549397-21549427
  misc_feature 1..30: note = Hypo
  source 1..30: mol_type = genomic DNA

SEQ ID NO: 108702 - DNA, 181 bp, Homo sapiens; identical to SEQ ID NO: 75754
  misc_feature 1..181: note = chr13:21634356-21634537
  misc_feature 1..181: note = Hyper
  source 1..181: mol_type = genomic DNA

SEQ ID NO: 108703 - DNA, 218 bp, Homo sapiens; identical to SEQ ID NO: 75755
  misc_feature 1..218: note = chr13:21634747-21634965
  misc_feature 1..218: note = Hyper
  source 1..218: mol_type = genomic DNA

SEQ ID NO: 108704 - DNA, 419 bp, Homo sapiens; identical to SEQ ID NO: 11520
  misc_feature 1..419: note = chr13:21649623-21650042
  misc_feature 1..419: note = Hyper
  source 1..419: mol_type = genomic DNA

SEQ ID NO: 108705 - DNA, 30 bp, Homo sapiens; identical to SEQ ID NO: 43753
  misc_feature 1..30: note = chr13:21711382-21711412
  misc_feature 1..30: note = Hypo
  source 1..30: mol_type = genomic DNA

SEQ ID NO: 108706 - DNA, 34 bp, Homo sapiens; identical to SEQ ID NO: 75758
  misc_feature 1..34: note = chr13:21713712-21713746
  misc_feature 1..34: note = Hypo
  source 1..34: mol_type = genomic DNA

SEQ ID NO: 108707 - DNA, 23 bp, Homo sapiens
  misc_feature 1..23: note = chr13:22049000-22049023
  misc_feature 1..23: note = Hypo
  source 1..23: mol_type = genomic DNA
tttttttttttgagacggagtct

SEQ ID NO: 108708 - DNA, 23 bp, Homo sapiens
  misc_feature 1..23: note = chr13:22049278-22049301
  misc_feature 1..23: note = Hypo
  source 1..23: mol_type = genomic DNA
accgcgcccggctgtttctgcat

SEQ ID NO: 108709 - DNA, 33 bp, Homo sapiens; identical to SEQ ID NO: 75761
  misc_feature 1..33: note = chr13:22122977-22123010
  misc_feature 1..33: note = Hypo
  source 1..33: mol_type = genomic DNA

SEQ ID NO: 108710 - DNA, 620 bp, Homo sapiens; identical to SEQ ID NO: 75762
  misc_feature 1..620: note = chr13:22243244-22243864
  misc_feature 1..620: note = Hyper
  source 1..620: mol_type = genomic DNA

SEQ ID NO: 108711 - DNA, 176 bp, Homo sapiens; identical to SEQ ID NO: 75763
  misc_feature 1..176: note = chr13:22247052-22247228
  misc_feature 1..176: note = Hyper
  source 1..176: mol_type = genomic DNA

SEQ ID NO: 108712 - DNA, 42 bp, Homo sapiens; identical to SEQ ID NO: 75764
  misc_feature 1..42: note = chr13:22336937-22336979
  misc_feature 1..42: note = Hypo
  source 1..42: mol_type = genomic DNA

SEQ ID NO: 108713 - DNA, 30 bp, Homo sapiens; identical to SEQ ID NO: 43756
  misc_feature 1..30: note = chr13:22391874-22391904
  misc_feature 1..30: note = Hypo
  source 1..30: mol_type = genomic DNA

SEQ ID NO: 108714 - DNA, 16 bp, Homo sapiens
  misc_feature 1..16: note = chr13:22707389-22707405
  misc_feature 1..16: note = Hypo
  source 1..16: mol_type = genomic DNA
gcgcctggccaggtta

SEQ ID NO: 108715 - DNA, 42 bp, Homo sapiens; identical to SEQ ID NO: 75767
  misc_feature 1..42: note = chr13:22766880-22766922
  misc_feature 1..42: note = Hypo
  source 1..42: mol_type = genomic DNA

SEQ ID NO: 108716 - DNA, 31 bp, Homo sapiens; identical to SEQ ID NO: 75768
  misc_feature 1..31: note = chr13:23174977-23175008
  misc_feature 1..31: note = Hypo
  source 1..31: mol_type = genomic DNA

SEQ ID NO: 108717 - DNA, 352 bp, Homo sapiens; identical to SEQ ID NO: 75769
  misc_feature 1..352: note = chr13:23489676-23490028
  misc_feature 1..352: note = Hyper
  source 1..352: mol_type = genomic DNA

SEQ ID NO: 108718 - DNA, 108 bp, Homo sapiens; identical to SEQ ID NO: 75770
  misc_feature 1..108: note = chr13:23507321-23507429
  misc_feature 1..108: note = Hypo
  source 1..108: mol_type = genomic DNA

SEQ ID NO: 108719 - DNA, 30 bp, Homo sapiens; identical to SEQ ID NO: 43757
  misc_feature 1..30: note = chr13:23717527-23717557
  misc_feature 1..30: note = Hypo
  source 1..30: mol_type = genomic DNA

SEQ ID NO: 108720 - DNA, 1374 bp, Homo sapiens
  misc_feature 1..1374: note = chr13:23733447-23734821
  misc_feature 1..1374: note = Hyper
  source 1..1374: mol_type = genomic DNA
cactatttcccagctcgcctccaagagctaactaaagtgcagcataaactgcatgcagcattgttttcaccacagcaaacccttcggggtgcctcctagcggcggatggagaactagcattgcgcgagagtgagtaaactgtgataaacccaaggggtttgcgggggacaggctgggtggcaagacttttaaaggctcgcaaatggaaccactccctccagagggactatctaaatctcctcaggtgctgaccctttctgacagtaaaggacgagggccagaagtgtaaagattgtggtcccgcgctccaagcccaagatgcgttcagcaggagtagttgggttggaaagaaggcacccagcgtctgcagcgaaggactcgcgtgggagcgagaaatgtccctgcccagtgccccgcgcgctggatcgcgggggcgagtctgagggtggagaggccgccgggtggaggcgcgcaggggtgcgtgggtgggtgcggaaggagtgcagggtatggaggggaatcttggggcggcgcgaaggaggagcgcttggaaaggcgcggtgtttggtcacagaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggagtggtgggcccggcccgtcgcgggaaggacacagagggacataggctgccctggagaggcgctttcggacatctggaggggcgcatagtgctgggacttggcggcgcctggggcggaggggcgcgccggatccagccgggcgcgctcgggggccgggcgcagtgggagttgacgggcgtccagccggcggcgccctgggctcggctaggcgcaggacggccctggcagcggtgcagcagcccaggctagttcctggggggtccctggtccccgcctccccgcgcgccccggccagcaccgcccggagtccgggcggggaagtgggcgcccgcggcttgggaagctgctcccccgccctggagcagagtcgtcgctgcggtcgctgaggaaggacggagcagaggcccgcgctgtctggggagaagactgtggtgtcatcccgtcgggaatgaagggaaatgcagcggctgtttgcgccccgggactccaagaagtacagcaggtaaagagaatagccacggcccgccacttcgccttc

SEQ ID NO: 108721 - DNA, 115 bp, Homo sapiens; identical to SEQ ID NO: 75774
  misc_feature 1..115: note = chr13:23896852-23896967
  misc_feature 1..115: note = Hypo
  source 1..115: mol_type = genomic DNA

SEQ ID NO: 108722 - DNA, 20 bp, Homo sapiens
  misc_feature 1..20: note = chr13:23920566-23920586
  misc_feature 1..20: note = Hypo
  source 1..20: mol_type = genomic DNA
gccaccgagcctggccccct

SEQ ID NO: 108723 - DNA, 288 bp, Homo sapiens; identical to SEQ ID NO: 75776
  misc_feature 1..288: note = chr13:23949125-23949413
  misc_feature 1..288: note = Hyper
  source 1..288: mol_type = genomic DNA

SEQ ID NO: 108724 - DNA, 29 bp, Homo sapiens
  misc_feature 1..29: note = chr13:23961293-23961322
  misc_feature 1..29: note = Hypo
  source 1..29: mol_type = genomic DNA
tcgatttgttaaaaacgaatgtcggccgg

SEQ ID NO: 108725 - DNA, 30 bp, Homo sapiens; identical to SEQ ID NO: 34801
  misc_feature 1..30: note = chr13:24007814-24007844
  misc_feature 1..30: note = Hyper
  source 1..30: mol_type = genomic DNA

SEQ ID NO: 108726 - DNA, 641 bp, Homo sapiens; identical to SEQ ID NO: 75779
  misc_feature 1..641: note = chr13:24040375-24041016
  misc_feature 1..641: note = Hyper
  source 1..641: mol_type = genomic DNA

SEQ ID NO: 108727 - DNA, 154 bp, Homo sapiens; identical to SEQ ID NO: 75780
  misc_feature 1..154: note = chr13:24153182-24153336
  misc_feature 1..154: note = Hyper
  source 1..154: mol_type = genomic DNA

SEQ ID NO: 108728 - DNA, 213 bp, Homo sapiens; identical to SEQ ID NO: 75781
  misc_feature 1..213: note = chr13:24153538-24153751
  misc_feature 1..213: note = Hyper
  source 1..213: mol_type = genomic DNA

SEQ ID NO: 108729 - DNA, 70 bp, Homo sapiens; identical to SEQ ID NO: 34805
  misc_feature 1..70: note = chr13:24154053-24154123
  misc_feature 1..70: note = Hyper
  source 1..70: mol_type = genomic DNA

SEQ ID NO: 108730 - DNA, 30 bp, Homo sapiens; identical to SEQ ID NO: 75783
  misc_feature 1..30: note = chr13:24155137-24155167
  misc_feature 1..30: note = Hypo
  source 1..30: mol_type = genomic DNA

SEQ ID NO: 108731 - DNA, 70 bp, Homo sapiens; identical to SEQ ID NO: 75784
  misc_feature 1..70: note = chr13:24289608-24289678
  misc_feature 1..70: note = Hypo
  source 1..70: mol_type = genomic DNA

SEQ ID NO: 108732 - DNA, 607 bp, Homo sapiens
  misc_feature 1..607: note = chr13:24477427-24478034
  misc_feature 1..607: note = Hyper
  source 1..607: mol_type = genomic DNA
ggtttccccagatgccgcggtgcaccgagcaggagcagaggccacgcgggagccgggtgtgcgggtgggtaccggccgcgcccctgctcggaggcggcgactccctcccccgccttactcacaccgtgcctcagtttccccgtcagtgcagcggacaagacaatgccgaggtcccaggcgggcggcaggatccaattagtccgtgtaaaatgagaggcatctggcttctcccgggcaccccgcagcctgccccgcctcttagtggctaaaggcagggagcccctgagtcccagcgcggctgggggctctcagcagttctggccgagctccctcccgcccgcgtcgcctggcctcgaaccgctgcaccgcgggcggccccgacgggttcccgacctcccgctggggacacctgtcccgccgcccggcccttccccgcctcccgcgcctccgccccaggggagctccgggacaggcccacctaggcagcctgccggcgcagacccagcgagggaaggccagtctcgggcctccaaccggacacgcgctccccattccgggctctcccacgtctgcacactccagcccagccacgcggagtggcttccag

SEQ ID NO: 108733 - DNA, 284 bp, Homo sapiens
  misc_feature 1..284: note = chr13:24553829-24554113
  misc_feature 1..284: note = Hyper
  source 1..284: mol_type = genomic DNA
ctgagttctgctgggcggggagccagagactgattcgctgcggtcctgggcccagcggctgggaggtcccgccctggccgaggaaatgaagagggcgcagggcatgggggcggcgcgcacccgggacagtttccagtcggcttctccgtgaccttcctcccccttccagctcggagcgggatgctgggatccctccaaggaccctctgaggacgtaggagggatgctgagacaggcaagtgggatttctctacatattgtcacctcgcccgcacttttggagaa

SEQ ID NO: 108734 - DNA, 53 bp, Homo sapiens; identical to SEQ ID NO: 75788
  misc_feature 1..53: note = chr13:24554519-24554572
  misc_feature 1..53: note = Hyper
  source 1..53: mol_type = genomic DNA

SEQ ID NO: 108735 - DNA, 68 bp, Homo sapiens; identical to SEQ ID NO: 75789
  misc_feature 1..68: note = chr13:24931992-24932060
  misc_feature 1..68: note = Hypo
  source 1..68: mol_type = genomic DNA

SEQ ID NO: 108736 - DNA, 138 bp, Homo sapiens
  misc_feature 1..138: note = chr13:25115633-25115771
  misc_feature 1..138: note = Hyper
  source 1..138: mol_type = genomic DNA
gtccagtctgtttcccgcggtcttcctccgtctgaccctggcagcccgctcctctggccccgggctgtgtggggaccgctttcccccaggcccgtcgtcagtgtcctgagctccgccgactcccgcccattggcgtcg

SEQ ID NO: 108737 - DNA, 250 bp, Homo sapiens; identical to SEQ ID NO: 75792
  misc_feature 1..250: note = chr13:25254947-25255197
  misc_feature 1..250: note = Hyper
  source 1..250: mol_type = genomic DNA

SEQ ID NO: 108738 - DNA, 2401 bp, Homo sapiens
  misc_feature 1..2401: note = chr13:25319824-25322225
  misc_feature 1..2401: note = Hyper
  source 1..2401: mol_type = genomic DNA
tggcgaccagaacaacgagggcgacgaagacaggactgaggaacatgcgcccctgccgccctcacccggaaccagggctcccggctggcagcgccaacgtgctcaaccccaaggctcgctcttgggtctggccaaggaggtcccagagcctggctgcaggcgccggttagccccagcgctgcagcgggcggcctgcagggtgagccacgcggggaagtccaagatctggtggctgcctagggcagcctcgcgcccgcagggcccgcccaccgctttgcttacgccgctgcccgtgggccaccccggcgcgcagggtccccagcccgcgcctccgccacagccggctttcccgcgcagccacggactgcactgccgccacgccggcaagggctccagctggacggagggggccttcctcgctccgggatccctgtcccactgtgtggcttcccgaggcctccccttcctgcgccaccaccaccgcagccgcccgtcgcggtggtcaggggcgctccgcggagaccgagaccaggccccggcccgcagctccgcgcgttcccaggcgcagctcctgatgccaagttcacttggaccccggctgagattagagaggcctggcgaggtgtgggggtgcgcagggagaatgggctgtggtcgccatggtgcgtgttggtcttgtggagatggatgctcctccgggtcaatctctgccttctcggggtcgccctcagtgtcgctgctgaaaaggcctccgtcctcctggtccttgctgtgcgctccccacgtcaccgcgttctccttgaggggccggcgggcgttggcgaaggtggtggggactgtcgtgaggatcatcatgggcagggaagggcgcgcggcagtggcctcgagccctgggtcttctccttcctgaatttgcaaagccaggcgaaggccctcgtgctctcccagagagctgcgctccacccgcgggcctgcctgcgcgtggggagagcggggaggcggggacaggagacctgagcccctgggcgcccctaccacgtgtcccccgtcccaacactggacctcttcagattccttgccgagaggggcctcgtcccaaggctggatgcgccgcgcagcggtgaaagccgccctcgcagcccgcaggcgaccagtgggtgctgttggctttcgccccggggagggaacgggcttgggggcactggcggcggcggagcgcggcggggaagctgtgggggtcgtgcgatggttatggagagtgctccatccgccaggcctgggctctgggcgagctgaggagaccggagtttttccccaggagggagccgcgcaggccggcgacctcttcccaaggctctactgctggaccgcgcccgcggcgccgctcccgccccccttcagcgcactctgcgcctctcgctgggtatggccagctcgcagtgcgcgtttatgctgcggtaaacgcattgaaggaacgcacagcttatctaatagggttttgaaataattttcggtatgccagctggggtgtggtttgcccaattctgatcctgtttccagagaacacagctgcttagacaatctgttatcttcgcgtcctgtcttccttttgacgccagaacatcctagggatcaggggcctctcccatgccctggaaccatcctctcacggtgctgctcttcactggtgccaataacagagctcccgcaggcaggcctggatcagtggggactggggccctgaagtgagatggagcaagacagagcggcccttgggagaggggcatggggcggccctgtgctttagactcggcaccctatggcttgaggaggtgacactgtgtcgacgtgcgtttgaagggaggacggctgaaggtacatgcagtctcccggacgtcacaaactccgcggacgcgggtcacacccgcgcgcacgcgcagcaggggtcttagccacacaggcgcacggcggggcacggcggggcacgggccctgctgcaaacgggcgcgctcccttctgggcaagcaggtgcgaggcgcgcgccatggaacagcccttagctgagtttcggtttgcgcgcaaacggccggcctggccgcccaacgcagcatttccagccagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctctcgcatccgcactgatccgagctttaacattt

SEQ ID NO: 108739 - DNA, 43 bp, Homo sapiens; identical to SEQ ID NO: 75798
  misc_feature 1..43: note = chr13:25561078-25561121
  misc_feature 1..43: note = Hypo
  source 1..43: mol_type = genomic DNA

SEQ ID NO: 108740 - DNA, 382 bp, Homo sapiens
  misc_feature 1..382: note = chr13:25592243-25592625
  misc_feature 1..382: note = Hyper
  source 1..382: mol_type = genomic DNA
cccgcccaacaggcccgaggcagagaaaccgccttagcagctctcgcggcgcccagtacaggcggcggttgctgcgcaggtgccgcgggctggcagggctccctggagccgcaaggcgcgccctgccccagggcctgtttgactgtggcccgcgccctcttctcctcttccaacggctcccgatgctcagagacccccgcgctgggccctctgcagcccagggatggggttgagtggtgcttctccacctggtgccgccgctgggcccacagcccgacttcgccactgcgtcgcccccggggtccgcgctgatgggcgcgaggcggaaggacgggatccggggttgccaccgctgcagtcagcccaccgcttgcaggtggca

SEQ ID NO: 108741 - DNA, 261 bp, Homo sapiens
  misc_feature 1..261: note = chr13:25592860-25593121
  misc_feature 1..261: note = Hyper
  source 1..261: mol_type = genomic DNA
tccatgtgctggtggcggctgcagctgcagcgcccatgggctgatgtggcttaccggagctgcggccggccacgcccaagggcctcacaggctgcgctgcccttgccagctgctcctgacccgcgcccagagagcaggacctggcgcttggcactgtgcagccacggggatgaggctgagcgccggttatcggcctcgtggcgccactggggccacagcctgacttcacctccccgtcgcccaagtcgtgtgatgggcaca

SEQ ID NO: 108742 - DNA, 30 bp, Homo sapiens; identical to SEQ ID NO: 75803
  misc_feature 1..30: note = chr13:25607882-25607912
  misc_feature 1..30: note = Hypo
  source 1..30: mol_type = genomic DNA

SEQ ID NO: 108743 - DNA, 751 bp, Homo sapiens
  misc_feature 1..751: note = chr13:25620899-25621650
  misc_feature 1..751: note = Hyper
  source 1..751: mol_type = genomic DNA
attgagaaagagacccgggtccagtgaagcatcagacacgctggcgcatggggacgaggagccctggagactcagggcccgtctggtgcggcccgggctttgctccgcgctcgccccctgcagctgccggggccgccgcaacttttcaaacctcaccgcaccgacagctctgtcccttcttttatctggagacgctgagcctcatcaactctcacctgcgtttcaggaaaaataataataataataaatgttccacggacacaggatttcggccaaatgctgcttagctctaccttccccaaaagggcgggaggggtggcaaccagtagcgaaaccccgcttgcctgtctcagcaactctcccacgtccgcaggaggccttgcggggatccgagcatcccgctccgagatggaagtggtaggacagtccgggagaagccgacgggaaactgtcctgggcgcgcaccgcccccgtgccctgcgccctcctcatttgctcggccagcgcgggacctcccagccgctgggcccgcgaccgcggcgaatcagtctccgcttccccgcccagcagagctcagatctgctctggagggctctcgggatgtcgcctttccctggagatgagcagttctgcgtcaccctccgtggccagcgcggcttccagggctgggctggtctattgtttgctgttcttgaaaggacgtggggagggtgggagggtgggagggtgggagggccggggctgagccggg

SEQ ID NO: 108744 - DNA, 24 bp, Homo sapiens
  misc_feature 1..24: note = chr13:25642802-25642826
  misc_feature 1..24: note = Hypo
  source 1..24: mol_type = genomic DNA
acatgcatgcatgcacgtggacac

SEQ ID NO: 108745 - DNA, 27 bp, Homo sapiens
  misc_feature 1..27: note = chr13:25668696-25668723
  misc_feature 1..27: note = Hypo
  source 1..27: mol_type = genomic DNA
ctactctaggctaggcgcggcggctca

SEQ ID NO: 108746 - DNA, 38 bp, Homo sapiens; identical to SEQ ID NO: 75809
  misc_feature 1..38: note = chr13:25669254-25669292
  misc_feature 1..38: note = Hypo
  source 1..38: mol_type = genomic DNA

SEQ ID NO: 108747 - DNA, 71 bp, Homo sapiens; identical to SEQ ID NO: 15753
  misc_feature 1..71: note = chr13:25670585-25670656
  misc_feature 1..71: note = Hypo
  source 1..71: mol_type = genomic DNA

SEQ ID NO: 108748 - DNA, 1333 bp, Homo sapiens
  misc_feature 1..1333: note = chr13:25744637-25745970
  misc_feature 1..1333: note = Hyper
  source 1..1333: mol_type = genomic DNA
ttttcagtgaagtcacgtcagaaaacatcaaacaaatacgatctgccgacgggtctgagggtggatcgacagaggcagggtctggggcggcgggcgcccggccgctgccgccttcggagtcgacaagggggaccgtctttacgggaacggcccccgtcctggaagcgtcctctgccgtgcggacctccccgggccccggctcggcgcgccgatgccccgcggcgtcctctccccgggcgccggtgtcgccggggtgcgcgaggccctctgcctctcggcagctccgcgctggggcgcggtcggcgggggcgggcacctcctctccccctgcgggctcacctgctgggtctcgcggggcgtcctggctgggctcctccggctcgcgcgcggctctgggcgtctcctccttgacgcactccaggctggcggtgagcgagccgggtaggatcaagccgcccccgggcgcgcgcccctccgcggcctccgccttggcccgcttgtctttcctgtgccagcgcatgccgctgaacagcccccgcagcccccgcttttgtttgccgccggccttgctcgcgtccacaggctctcccttgccgttttccgagcgcccgttcttcttcagcagcgagaagaagctgtgcgacttggccaccgagctgctggcgagggagcccccgccgggccctgcggctctggggggccccgggttcggccgccccccgccgcccccgccgctgtcgcccccgccgcgcggctcctccttcctgccgctctccagcaccagcacctcggcaagtccgtcgtgggtcctgctcctcaccagccccgtcggacccgagcttttcccgtcccctttgtttttgaccccaaaaatgctgggcatggtgccacccgatttcctcttcttgaataatttgaaggcagctttattaatcttccccgacggcggctcggcggccggcgtttcggcggcacagtcacaatgcaagtccatgtctgccgcgagggtcccggtcccggccccggcctccgccttcctcctgcagacccccacggacgcgccagctccgccgcgctcgctgacagccccgccgccgccgcggctccggctcgtctccatggaaaccgcgcgggataagccgctttcgtcagcagtgggctcgcgccaggccactgtcacccgtattctaaatcaacctgagccgcgctcgccgccgccgctgcaaaagaaacacacataaaagaccatcttccctcccgcaagggcttatataataccctaacccacttccatccgacttggctcggcgctgcatggcgtttttgtggcagg

SEQ ID NO: 108749 - DNA, 67 bp, Homo sapiens; identical to SEQ ID NO: 75814
  misc_feature 1..67: note = chr13:25862385-25862452
  misc_feature 1..67: note = Hypo
  source 1..67: mol_type = genomic DNA

SEQ ID NO: 108750 - DNA, 962 bp, Homo sapiens
  misc_feature 1..962: note = chr13:25945896-25946858
  misc_feature 1..962: note = Hyper
  source 1..962: mol_type = genomic DNA
gacaggcagagactccgagtcccccaggtgcacccctctcctggaagagcccccgaaagtacaggcccaatctcccaccccaccaagccctccccatcgccttccccgacacctaaaagccccggtcctgcgtaatattgcggatccctcccagcctcccgtccgctcctcctcccgcggggctccgctcagggccggtcccccgcccccacgccgcagcccgggccagcggggcccgccgcggtggcgttcgcggatgctgccgcattggccgctgcggcacggacggcgcagcctcgggcgcggcccggcacaggcgccggcggtccccgccagctagcagcccggcgaggcgctggcccacccatggtcctcgggcggcggcccctgcgcccagccctgcgcgtagcctccgtctctcgcccggggccgccgagcccccgacacgggcgagatgctgaacggcgcaggcctggacaaagctcttaagatgtccctgccgcggaggtcgaggatccgctcgtccgtgggtgagctgggaggggcgcggcgagggagggtgggcccggggcgggggcggcgcggggcgcgcctgcggttatgcgacactgccccgcccgcgccccgctcccctccctgggctccctgggctctctgggctgcaggatccgccgacgcggcgcgctggccgcacgggggctgggcgtcgctgcacctgcggggccaaaaggctccaggccggggcgaggtgagcggcgggcgtcagagacccccggctcgtccctgtacagatgtgtgtgtgtgtgtgcggcctccctgtgcgcgtgcccgtgcgcccctacgcgcggatgcggctcagggatgcgacctaggcggcagtcaccgcgatggtgggcacggtttggcggcgcagagaagatgcagccttccctgccggcggccggcaccgctgtgctgcagag

SEQ ID NO: 108751 - DNA, 78 bp, Homo sapiens; identical to SEQ ID NO: 75818
  misc_feature 1..78: note = chr13:26041957-26042035
  misc_feature 1..78: note = Hypo
  source 1..78: mol_type = genomic DNA

SEQ ID NO: 108752 - DNA, 899 bp, Homo sapiens
  misc_feature 1..899: note = chr13:26042600-26043499
  misc_feature 1..899: note = Hyper
  source 1..899: mol_type = genomic DNA
tggctgcttgcagggcgcattcccattgctgctgtctctgttcctaaggaagatcaaaggatcccagaaaacccagttccagagctcagttcccgggactagagggtacgctcggccagatggctgggggtgccgctggccttggcgcccccgccgtccccgcgcggtcgcccaccccggcccgacaagcagcttgggcgtccagcccggcccggtccctgcagggagggagcgcaggagctgggggcggctctcccggggcggggctcgctccacaagcgccaggggccgcgcggggcgtgggcgtgggcggggccgggggcggggccggccttggctgccgcggcacaggcggcggcgtctccagggggagccaaggtacgtaggcggcgtccgcctcacccgagcatccttccccgccggtggccgcccgcccgcggcccgcgctcgcagcctcccgcctggcggttgacttctttgtgtcgtattctctgcctgcgccctgtctctgcaggacctgttcgttcttctttgggctataagaaggcagaggatgagatgtcccgggccacgtctgttggagaccagctggaggcacccgcccgcaccatttacctcaaccaaccgcatctcaacaaattccgcgacaaccagatcaggtaggagaaggcggccggctcgcgcggaaggcggtggagtcacagctgggaaggggctcgtcctcctgcgcggggcttggccgcgcacctggccggcccccgtccatctcccccagagccttcccctgccccctccccaccccactagcccgcggtgcagccccgcgcttccagtagggtcatgcgaatgcagccctcaccgttctctcctgcgcatccgttctgcgcccagcctgcctc

SEQ ID NO: 108753 - DNA, 30 bp, Homo sapiens; identical to SEQ ID NO: 75822
  misc_feature 1..30: note = chr13:26157703-26157733
  misc_feature 1..30: note = Hypo
  source 1..30: mol_type = genomic DNA

SEQ ID NO: 108754 - DNA, 30 bp, Homo sapiens; identical to SEQ ID NO: 75823
  misc_feature 1..30: note = chr13:26317471-26317501
  misc_feature 1..30: note = Hypo
  source 1..30: mol_type = genomic DNA

SEQ ID NO: 108755 - DNA, 30 bp, Homo sapiens; identical to SEQ ID NO: 75824
  misc_feature 1..30: note = chr13:26323546-26323576
  misc_feature 1..30: note = Hypo
  source 1..30: mol_type = genomic DNA

SEQ ID NO: 108756 - DNA, 89 bp, Homo sapiens; identical to SEQ ID NO: 75825
  misc_feature 1..89: note = chr13:26355034-26355123
  misc_feature 1..89: note = Hypo
  source 1..89: mol_type = genomic DNA

SEQ ID NO: 108757 - DNA, 322 bp, Homo sapiens; identical to SEQ ID NO: 75826
  misc_feature 1..322: note = chr13:26624595-26624917
  misc_feature 1..322: note = Hyper
  source 1..322: mol_type = genomic DNA

SEQ ID NO: 108758 - DNA, 1191 bp, Homo sapiens
  misc_feature 1..1191: note = chr13:26625198-26626389
  misc_feature 1..1191: note = Hyper
  source 1..1191: mol_type = genomic DNA
cgtcactgactgtcccgcggcgctttccgcgcgggccactcccctctgccgcgacgcccaggaggcgacgacgccgggccctaggtccaggagctcctaagccatccccgtcctcagccggtggcccggtccccttagggactgccttatgagttgcactcgctgatggaaatctcgggatgcagtcagaaggcccccggggctgtcgtccggaagcctctggaggtttcactggcaaccggaccctccctgagcatccccgaagggatgctcactcgagccgaatgaccgctgggcgcgccgccgcggacctggagccagggctctgcgcagggtttaagcctcagggtcccgcgcgcgaatcagggcccgtctcccctcctttattccctcctcgggcgggtagaaggggcgaaggcgggcagtgcacgcaaggctctgggcagcaagtgacgcagccggccgcgctcagcctcctctgccccgaacttggtccgcatggctccggccgggccgcccgggcagcccacgggggtgcagccccgacgctccactcggcggggccgacggccaatcttcccagcacgtcgccgagggagcgctcctgaccccgggaacgtccaggacgcaggcgagggtcctgcgcgcccccagccgcagtcccgggagcctgcccagctggcggcggccgcggctgctgctgggcgcggatccaggcgggcggctcgccccggttccccttctccgcctccccggctgcagcgcggtcccacaggagcccggcagcctccggccggctctccctctcccggtcgctgcctcgccctcgggaggtgtgcgcaccgatggaagcctcccacggaagtttctttcctccgggctacgggagaagccgagcgcagcagccgcccacagcctcgcctcgccccgcccggcgccagaccagctccgactccgctcgctgccgcgctgagccgcgctcttatagaggccggcggctccccggcgcgcatgcgcgctgcgcggctcccccccacccccgacctcagggacgcccgcgggcgccgggcagcccctcactttcctaccccgggcaaggagaaaggtgtggccaagggcggggtctgcctgctggaataggcgcgggaggaaacccaacctaagcaatccaggcctcgctaacacaaataa

SEQ ID NO: 108759 - DNA, 30 bp, Homo sapiens; identical to SEQ ID NO: 75829
  misc_feature 1..30: note = chr13:26693061-26693091
  misc_feature 1..30: note = Hypo
  source 1..30: mol_type = genomic DNA

SEQ ID NO: 108760 - DNA, 86 bp, Homo sapiens; identical to SEQ ID NO: 34830
  misc_feature 1..86: note = chr13:27050496-27050582
  misc_feature 1..86: note = Hyper
  source 1..86: mol_type = genomic DNA

SEQ ID NO: 108761 - DNA, 1234 bp, Homo sapiens
  misc_feature 1..1234: note = chr13:27131553-27132787
  misc_feature 1..1234: note = Hyper
  source 1..1234: mol_type = genomic DNA
atccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtgaagcggccccgtgagttggccctggttggtggagccggcactgagcccccctcctgctccggccgagcccccccgccgggagggggcgtggccgcggccgtggacgggccggaggcggcgtcgctcgcgccgctgcgtgcggtgtggtgcgaggcgggtgcgccgggcggccgcggcgcggcgggaccatggagctcagagcgcagccccggcgccggcggcgggaccgcggaccggtgagtgagggctgcggtcgccccggctctccgctgtaggctgctgtggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtggcgcccgggcctccgctcgcgccccacgcacgacgccccgggccgctccgcgtccgggaccttcgcatccgttcagtgtctgcgcgccctcgctggttctggtccagctccgcgtgccccccggccccattcggccctcgccgccctggcctgtgccctcttggtgcccgcgtgcgtgttggttgcgggcgtcctctccctcgaggctgcggtgccgcgtggctcccggcctcggagaccaggccggactcttggagtgcaggggaggaggtggggcggcccgcgagtgcgggggaccgcgcgcacggagccgcggcgcgcggggtatcatccccgggggtctttacccgcgcgcctgggctttagcgagggcagaagcttcctctcagtttgtggtgctgacgtgcaatggcgattgcttcttgatttggcccctctgcaagggagagttccctggtggagacgagagttcttaatt

SEQ ID NO: 108762 - DNA, 18 bp, Homo sapiens
  misc_feature 1..18: note = chr13:27144128-27144146
  misc_feature 1..18: note = Hypo
  source 1..18: mol_type = genomic DNA
tataccttgatcagccgg

SEQ ID NO: 108763 - DNA, 30 bp, Homo sapiens; identical to SEQ ID NO: 43763
  misc_feature 1..30: note = chr13:27278150-27278180
  misc_feature 1..30: note = Hypo
  source 1..30: mol_type = genomic DNA

SEQ ID NO: 108764 - DNA, 32 bp, Homo sapiens; identical to SEQ ID NO: 75836
  misc_feature 1..32: note = chr13:27319461-27319493
  misc_feature 1..32: note = Hypo
  source 1..32: mol_type = genomic DNA

SEQ ID NO: 108765 - DNA, 769 bp, Homo sapiens
  misc_feature 1..769: note = chr13:27334211-27334980
  misc_feature 1..769: note = Hyper
  source 1..769: mol_type = genomic DNA
acttcaaaacaccagcgtgagcgaggcaggcacacacggactcgcggcggtctgtttgcaacagcgctgggaatgcacattggaaaatcacatcttgcatgctgaaaacgaacaactgtttgacatctgggctgctgccgagaaaaccacgcggcagcggcaggtctcgagccaggggccgccatcctcgatggaatatttaaatcgcctatttccatcgaactcccaccctccaaacgcatcccccgcgcgcgtgcacatcctcaaacgcacccccgaccggaacaaagaggggctccagactccccccgtgcgcacggggcagtcgggagggccacgagagggaggtgtgtgcaatggaagtaccgagacagacagacagacagatgcccatgcactgctgccgattccctggcggcggggacgggagtcggacgcgagggggacagacagggtgcggggacaggcggcccgcgggggcgggggggtcatcgagggggtcaccttggctcgcccaggccgagggggctcctccggtgcttccgaagcgcgtgggctactcgtgtcgcatgtcggcgcagttgcccgctgtggcaaggggggggcggccgggctccggagcgggccgggagggcgcggggcgcgcactccgcggcaggtgagcggcgcggctgcaggtgagcagcagcctcggctcgcgcgcccagctttccccgccgcgcccgcccggcccacacgctccccgcgcgcgcgccgcccccgccccgcg

SEQ ID NO: 108766 - DNA, 30 bp, Homo sapiens; identical to SEQ ID NO: 75839
  misc_feature 1..30: note = chr13:27390853-27390883
  misc_feature 1..30: note = Hypo
  source 1..30: mol_type = genomic DNA

SEQ ID NO: 108767 - DNA, 38 bp, Homo sapiens; identical to SEQ ID NO: 75840
  misc_feature 1..38: note = chr13:27553623-27553661
  misc_feature 1..38: note = Hypo
  source 1..38: mol_type = genomic DNA

SEQ ID NO: 108768 - DNA, 208 bp, Homo sapiens; identical to SEQ ID NO: 75841
  misc_feature 1..208: note = chr13:27610050-27610258
  misc_feature 1..208: note = Hypo
  source 1..208: mol_type = genomic DNA

SEQ ID NO: 108769 - DNA, 30 bp, Homo sapiens; identical to SEQ ID NO: 75842
  misc_feature 1..30: note = chr13:27811290-27811320
  misc_feature 1..30: note = Hypo
  source 1..30: mol_type = genomic DNA

SEQ ID NO: 108770 - DNA, 67 bp, Homo sapiens; identical to SEQ ID NO: 75843
  misc_feature 1..67: note = chr13:27845541-27845608
  misc_feature 1..67: note = Hyper
  source 1..67: mol_type = genomic DNA

SEQ ID NO: 108771 - DNA, 108 bp, Homo sapiens; identical to SEQ ID NO: 43764
  misc_feature 1..108: note = chr13:28239991-28240099
  misc_feature 1..108: note = Hypo
  source 1..108: mol_type = genomic DNA

SEQ ID NO: 108772 - DNA, 609 bp, Homo sapiens
  misc_feature 1..609: note = chr13:28363673-28364282
  misc_feature 1..609: note = Hyper
  source 1..609: mol_type = genomic DNA
gaaagaaggaaagcccgggacaacagaaattctttcaatgttgaactgtccctgatggacacttgaaaaccggctccggcagcagagccgacccgccaggcccaggggctcccgggcccctcctggggctgtcaggctaatccggcagccgcctcccaccccgccccgctctgggggacttttgctcgggtgactaaagttcaaactcggctaaagcaagccctgggaggcgctttaaacaggaaagtggcgcggccgcccgagagagcccgggtagcggcccccggaaaccaggcggcgggcagaggccgcggggtggggaggccgggttggctgggtggggaggccgggttggcggggcggcccggacctcccggctgcccgcgctagcacctgcccaaggctcgggtctctcagaggcacggagctttctctgcggaaatggccaggctcctgggcgcgctggcggccctggaccgccaagcagggagccccctctccggccgcggcccgccgggctgagagaccacagattaagtgcgccttggttctctcagggatgctattttgctccggcccgggtctctcccgcgccgagttgcacaacaa

SEQ ID NO: 108773 - DNA, 351 bp, Homo sapiens
  misc_feature 1..351: note = chr13:28364644-28364995
  misc_feature 1..351: note = Hyper
  source 1..351: mol_type = genomic DNA
agctttggccttgctcgcattcaggggctcttaaccccttcctccccgggcacgcggggcggctgccagtggagctccacgctggccactcgcgggctcccagctccgggtgcagtgcccgccccttgcacccctgggccccgcccgcccttgcgcccctccagcctgcctctgcccagcggaaagcccctctccccgcccgggtctcgctcttcgcttcctctcagcgacccagcccagctcaaatttcccagagagcaattagaacgggaattaggctgcattgatgcgttccggctggtttgcaggcaccaccctagagtgggggagccttggcgctgagactctgtc

SEQ ID NO: 108774 - DNA, 609 bp, Homo sapiens; identical to SEQ ID NO: 75849
  misc_feature 1..609: note = chr13:28365486-28366095
  misc_feature 1..609: note = Hyper
  source 1..609: mol_type = genomic DNA

SEQ ID NO: 108775 - DNA, 3674 bp, Homo sapiens
  misc_feature 1..3674: note = chr13:28366393-28370067
  misc_feature 1..3674: note = Hyper
  source 1..3674: mol_type = genomic DNA
agggagaggagggggcgagggcgcctgttacggcgtgggtggggttgacaagaatagagtacattatgcagttcatttagttaacaagtgaaataatgaggaagcgtgcagagtgaatgccaagagaaaaggcacaaaaaccctattgagaggccccggccgctcctggcgtagtccatcacatggcaatagtcctatttaagccgcgccgccggcgcctttcagcaccactagcgctggccagcaccccgcgctctttgggcggtgcccacggcagcagaggctactgtttcagcctaggtctcagccgcgcgttcagcctcctgggcagaggcagctgcgggataccgcggccagggaaagcgcgtggagagccgaaaggtgcggtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgcagctgcatgggccccccgggccgcccgcgctgcctctactcaaggcttccttcccacccttcggctcgcagtactgccacgcgcccctgggccgccagcactctgctgtgtcgcccggggtcgctcacggcccggccgccgctgctgctgccgccgcgctctaccagacctcctacccgctgcctgaccccaggcagttccactgcatctctgtgggtaagcggggccgccgcgcagagggaccgggcagaggtgatccgaagcaggatggagagccagagatggaggaagagggaccctgggctttctgggggcggtgagggtcatgtcggggactaaggggggcgcttggggtggagtgaggatagagggccgggacacaacgccaggaggcggatgagggcagacgtccaggtcctggagtgtgggccggggtaagtgagggctgggatccaaggctctccatgaaggggaaggggttccagggctgcatgactccgggagaatcaggatctcggagctggacaaggagcgctcactgtagctctgctgtggattgtgttggggcgaagagatgggtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcgacctacctgaatctgtccgagaagcaggtgaagatctggtttcagaaccgccgagtgaagcacaagaaggagggcaagggcagcaaccatcgtggcggcggcggcgggggtgccggtggtggcgggagcgcaccgcaaggctgcaagtgcgcatcgctctcctcagccaagtgctccgaggatgacgacgaattgcccatgtctccgtcctcctcagggaaggacgaccgggatcttacggtcactccctaggcgcgtgtctccctaggtcgcccaccccaagacctccctgcgcctcggagactagtcctgggactcagcgctgattcccaggcacccgcagccaaaccactgcctggcatggatttggcactgctttgcagaggtcccgggcctgggcagggctgagagcttggcagagactggaccatggcgtccccgccccagggctcgctcgtgtccaaagccaactccaagctgtgaacactgtaagcgctcgagtcctcctgggcagtgcagcaccgcggcccccgcccgcaagcctgcttggcgcagcgccttgctggcagccggcgcctcctagcccgccctctctgggctggcttgggcttcctcgcttactctactctcctccgctctcggtcaaggtcggcggccttggatgctcgttcgcttctctttttaaaatgtctttttgtccctccccacctctttcctgtgatcatttattcactcggcccccgcccgccaacacacacatttatgaacccccactttttttttccttctccttttcccttcccctcctcagggagcctcctccttcagtcagtccatttgtcccttgatctggccttgctgtcctcagtccccacggctcctctcacagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttttttcttagaaatgcccgtggctctgagcccagaggccttcgctctggagtagacaggcgccaacccggattgggcctcccttctgggaagggttggggatccagttgcagggtccgagccggctcctcgccttacagctcagccagtgcctctcggaaccctcagctccgctgagagcccgccttgcatgccagccaggtgcgcgctaacgattgtcccgctccggcgtggcgcacaagcgtcgcggagctcagagagctaagccggaagggaaggagagcgctctccttggactgcaccatgggtcccaacccctgcagcgcctccttctcacctgggatccagccccacctccatccctcaccatttcgctgtcctggccaacagccgggagggcagaaaccactccctccataagcacaagaaatccgtccttcactgcgcttggattgataacgattcgttagggacaaatttccattctgcgggatggtgcagacttctctcagagggccctcctctctttgttttaaggcaaattcccttagccgagtccctggtcgcggaacattccgggcaaggaatccgagaatccgaagtgatcctgccccagggagtccccgagagggactctgcatagctggagccagtggctctgggacctcatgttctcaccaattctcgttaaaatcctatatccccctacgacttagaatccacaccccagctccctttgaggacatatgcgggtttttttactctctaagatggatgaggagaaggaagtgcgtgaggttctgcagaaacggagagcgcacagctgcgggaggagtatttctgcagtcagtatttctgcagtcagacctgggaagctaatatccgcgttctcgccgctcccattctgtgtccaggaaacctgatagaccttcttttcctgccagacccctacacacacacacagacacacacacacatacacaccctggggagcgctgaactccccgtgtctaggcaaagcaaatgcgtcttttccagcaggaaagacggtccacctgaggttgcttaacatttttgaagctcatttcctcccccccacaaaacggctttattgagct

SEQ ID NO: 108776 - DNA, 1052 bp, Homo sapiens
  misc_feature 1..1052: note = chr13:28370409-28371461
  misc_feature 1..1052: note = Hyper
  source 1..1052: mol_type = genomic DNA
tagtcccagtctaaccggcctaagaaccagcggagccgatggtgtaactcctagtcggaggccaaaagcctgagaacctgggaagccgctaatcgaagacccagactacaaggccccggaaccaggagcttgtggggcttagttctaaaatcttccatcttttccttcaaatcaagctgaggatgggggtgggagggtctctctccagttcccctggaacaagggcaggcacgatctagctccccatggagaaactcttgccggttcttcctggagctaggcatctgagttgtgctctagactgatgaggatctccatcagtctgaacctcactttagacggggaccaattctccaccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactcttagctccagcaggaccggcccagcctccgtttggctgggatttgggggcgggcggcagcacgattttctggcaacgagttcgttgtgggtctgaaggaccggcttagaactagcacctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 108777 - DNA, 305 bp, Homo sapiens; identical to SEQ ID NO: 75857
  misc_feature 1..305: note = chr13:28394662-28394967
  misc_feature 1..305: note = Hyper
  source 1..305: mol_type = genomic DNA

SEQ ID NO: 108778 - DNA, 481 bp, Homo sapiens; identical to SEQ ID NO: 75858
  misc_feature 1..481: note = chr13:28395176-28395657
  misc_feature 1..481: note = Hyper
  source 1..481: mol_type = genomic DNA

SEQ ID NO: 108779 - DNA, 75 bp, Homo sapiens; identical to SEQ ID NO: 34851
  misc_feature 1..75: note = chr13:28395998-28396073
  misc_feature 1..75: note = Hyper
  source 1..75: mol_type = genomic DNA

SEQ ID NO: 108780 - DNA, 182 bp, Homo sapiens; identical to SEQ ID NO: 75860
  misc_feature 1..182: note = chr13:28396536-28396718
  misc_feature 1..182: note = Hyper
  source 1..182: mol_type = genomic DNA

SEQ ID NO: 108781 - DNA, 292 bp, Homo sapiens; identical to SEQ ID NO: 34853
  misc_feature 1..292: note = chr13:28397177-28397469
  misc_feature 1..292: note = Hyper
  source 1..292: mol_type = genomic DNA

SEQ ID NO: 108782 - DNA, 760 bp, Homo sapiens
  misc_feature 1..760: note = chr13:28491793-28492553
  misc_feature 1..760: note = Hyper
  source 1..760: mol_type = genomic DNA
gtcccttctataggtcgcaggcagcagaaaatgctaattgtgaaagtgagaacgcgcctccatggaatacccccggcgatcccctcctcctcccccacagccgcgggtacccgggtttttgccggcgaccgcaaccggcggatttgctttctgctgagagcctcttttctttctgcagggccgagcaaaaatattaaatggaagcaaatgaagcatcgaaatggagaccaatttacagaaatgtgcaattagttgagaagtgcaaagtaaacactccgggggtggcaggcgaggcagggagcaggggagggagagtggggcgcagactgagtccagagtgggtgtaggggtgcccagggaggaggggaagggggaggaaaaggagggggaggggaaaagtggccgatctttgtcctgagcggagcttgccgtccgctcataaccgcgtcgccaagtcaaccctcggcgactcggcagattatctccaagggtcaacacgccgcggccaggcaaccccctccagcctgccctcctgatcgatgtggtcactcgcggccagggtgatagggtagagttctccgcggccgcagacaatggactcattgacgcgggcgcacagagattaggtgcccgggccccacggcctttcactctctgcccccaccaaaactgcaggtggcacttttccctgaagaaatcaccgaaactctccccgcccgccgccgtgcttcccttggcctgtcttcggtgacagcaaggg

SEQ ID NO: 108783 - DNA, 58 bp, Homo sapiens; identical to SEQ ID NO: 75864
  misc_feature 1..58: note = chr13:28494207-28494265
  misc_feature 1..58: note = Hyper
  source 1..58: mol_type = genomic DNA

SEQ ID NO: 108784 - DNA, 981 bp, Homo sapiens
  misc_feature 1..981: note = chr13:28494773-28495754
  misc_feature 1..981: note = Hyper
  source 1..981: mol_type = genomic DNA
cgccttggattatcccgggtcggactaaactacatcagggagctaccgagcccatccctcacagcagtgcttctctagtccagtttgaagcatctttcccacccagctctcctgggagtgtacactccttccttccctgttcgctgagcccatcttcgccccaggagcccgcgctcccagcgccatccttagagagccgaggctgagtcctgctcagggcttcggacactacagatcctcctccagcaggggatccgggaacccaggactccttggtagtgcacatcgaggaagccgagtagggacatgggtgcctcggacccaggccccagatcgccttcggagccccggagcccctcacttcccgcgcttcgttaaggaagggcaggcatctaggggcgccaggtaggtgcagaaaggcagggagggaaaggaaactgcacccaacccagcagtgtccggctgccctggttgtggaaacaggataggagtaaagaggaaggggctggggcaaggcgggggctcaccgcgaggctgaaagccggcctctcaacgtcagagcctggcagctaggagagcaatctgagaagcgaattcgtttttcaccaaccgaaagcaattgaagctgtctccccgcaccgcttcccaggaagtaatttttcaggagatgggcgctccctgcctagctggtggggaggcgagaggcctggttcctgcggccctccgcgccggcagagaacagaaggtctttcccggagccgggagccggaggcacggggtagcccccgggtcctttgcggccccgcgcgagcggcaagttccggcgcggcctgtgtcgtcgccgctactcactgtcatcgctgccgtgcctcagccacttctggtcacacctgcaccgcaaatagttgccttttcctttcaactggcagccgggagtagggggaagcagctcgagccggcgtcccccggcccaccccgaaa

SEQ ID NO: 108785 - DNA, 30 bp, Homo sapiens; identical to SEQ ID NO: 34857
  misc_feature 1..30: note = chr13:28503435-28503465
  misc_feature 1..30: note = Hyper
  source 1..30: mol_type = genomic DNA

SEQ ID NO: 108786 - DNA, 145 bp, Homo sapiens; identical to SEQ ID NO: 34858
  misc_feature 1..145: note = chr13:28527239-28527384
  misc_feature 1..145: note = Hyper
  source 1..145: mol_type = genomic DNA

SEQ ID NO: 108787 - DNA, 1150 bp, Homo sapiens; identical to SEQ ID NO: 75869
  misc_feature 1..1150: note = chr13:28527845-28528995
  misc_feature 1..1150: note = Hyper
  source 1..1150: mol_type = genomic DNA

SEQ ID NO: 108788 - DNA, 108 bp, Homo sapiens; identical to SEQ ID NO: 75870
  misc_feature 1..108: note = chr13:28534446-28534554
  misc_feature 1..108: note = Hyper
  source 1..108: mol_type = genomic DNA

SEQ ID NO: 108789 - DNA, 313 bp, Homo sapiens
  misc_feature 1..313: note = chr13:28535260-28535573
  misc_feature 1..313: note = Hyper
  source 1..313: mol_type = genomic DNA
cccgaccccacgccccgcactcctccctctggcttcgaggccaggcgcccgcgggccgggccaccggagcccctttcccaatcctggagctgtatacgccacccggaagggccgcggaattggagaggtgctgcagagggtctatacctcttgctgtttcccggctctgctcatcttccccaactgcccttaaggcgcctccgtgggcgcgctgattaggctctcggatgttggtgggaagatcgaaacgaagggctaagcccccctcgcccgggtcctgccggaaagttcagctcggcggcctccaggatca

SEQ ID NO: 108790 - DNA, 810 bp, Homo sapiens
  misc_feature 1..810: note = chr13:28540473-28541283
  misc_feature 1..810: note = Hyper
  source 1..810: mol_type = genomic DNA
taacgcgactttctccgcggtggacgctcggacacgcgtgaccgcctcaaacccactccaggctgccattggtactcgcccctttttacagatgaggaaatggagaatcagaccgggtcacgcagatagtatcaggcggggttggcaccggagcctggctggagccacagaggacacctccggagctgaggcgcagggcagttccctcagccgaacaccccgggagggagactcgcctggaagtgtctcggagcgacccttgctcgggtgctgccccttcagtgtcccggacgtgccgggcaacgcgatgaccagaccctgagcgctcttcgacccatgccccaagggccttggaggcgccccacaccccctgggaacctaggagcggggctatggaggggagggatgagagggacttgtcagaattcattattgactgcgaaagtcaccaccctctttccgggccctaaaagagacaatggcagggctgggaaggtgtatatcaaagcaagccaggccgcgtccccccctccacccccacaccttgacagatgacgctccgcagaggagcccggctccggcccgcgggctgcggccaccccacattaacatcacaagggcacccggcgccgactgcggccttgccacctcggcgcaggacttcacagcggcctctcatctgctgaccccgcggcctgggctctggcggcttccctcccgcccccttcccggccctcaccccgcggccgctctcccgggacacgcaaaggtcttccttagggcgtgcgccacccccgccaaccgcgcccc

SEQ ID NO: 108791 - DNA, 172 bp, Homo sapiens; identical to SEQ ID NO: 75875
  misc_feature 1..172: note = chr13:28541956-28542128
  misc_feature 1..172: note = Hyper
  source 1..172: mol_type = genomic DNA

SEQ ID NO: 108792 - DNA, 40 bp, Homo sapiens; identical to SEQ ID NO: 75876
  misc_feature 1..40: note = chr13:28542355-28542395
  misc_feature 1..40: note = Hyper
  source 1..40: mol_type = genomic DNA

SEQ ID NO: 108793 - DNA, 783 bp, Homo sapiens
  misc_feature 1..783: note = chr13:28542653-28543436
  misc_feature 1..783: note = Hyper
  source 1..783: mol_type = genomic DNA
tccgccgctggccgccgggagacagctgctcggcggcagcggtggcggcgggcccaggagggccggggttgagcgtttgcagcagcccagaagcgcaggaaggcgcggcggccgggtggtgcgggtggtgatgcgggtggtggtgcggatggtagtctgcggggctgctgtagcccatggctgcggccggggagccaccgttgaggccgtgagccacggcgttggcggcggccgcggcgcctccgggcgcgtagccattccagtcctcccggagtggggcgccatacgctgccggccaggatggccccggggactgcgcgctgtccaagttcgctgccgctgcagctgcggccgccacgtggtaaccgccgtagtccgggtactgcggggggctgacgaagttctgcggcgccaggttgaggccgccagagtggcgcacggagctagggtacatgctcacgtccttgtccaggaggtagctcacgtacatggtggcgagggtccgggagcagacctcaccatgctgcctggggaccgacgctggaggctgccggggggcacgaagggaaaggggcgaggggactcgaggagcggcgggtggctgcgccccagcccgcggtgctccgctggctcctcgcggctcttctgcctccgaggcggtccctccctctggcctgcctcctccctccctccctttcttccttctttcctcccacctccttcccactaggctgcagaggcggggaagacccgccacaggctggcgtgcggagccccaggccg

SEQ ID NO: 108794 - DNA, 734 bp, Homo sapiens
  misc_feature 1..734: note = chr13:28544169-28544903
  misc_feature 1..734: note = Hyper
  source 1..734: mol_type = genomic DNA
gctagtggttattggcgtgcataactggaggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttacaaagggaaacgttctccgaagaaatttatttctcatttccaggagatgataaggcaactcagggccattattaacgactgctaatgaaaagctctgagttgagaaaggatctctcttggtttgggaagcgctgcggccaaggggcctagggctggaagtggccgtcttggggaccgaagccgcgcagcccgggatcgggagctgccccgacaggagcgcggaggcggcgagattcggcccccgcgcgcgcccagctcggtttcagcaaccgcgtggagtgggcctgcggccgccgttcacctcctaatacaagcctttgacagcgctgccagattcgggaatgaggatcactgcggcgaggcccggcgggctgggcagcctgactcggcggctttgagcgctctcagaacccgcgggcgctcgcggcactcctggagacctgcacttgtctgttctcattgtcaagcgtttcgctcggatatttgtcaccatcgccttcatcctgtc

SEQ ID NO: 108795 - DNA, 30 bp, Homo sapiens; identical to SEQ ID NO: 34869
  misc_feature 1..30: note = chr13:28545247-28545277
  misc_feature 1..30: note = Hyper
  source 1..30: mol_type = genomic DNA

SEQ ID NO: 108796 - DNA, 1055 bp, Homo sapiens
  misc_feature 1..1055: note = chr13:28549497-28550552
  misc_feature 1..1055: note = Hyper
  source 1..1055: mol_type = genomic DNA
gaggaggccccattccgtatcccagttaagttacacaggtgagtgacaagcccgggtcggctcctgagttctcatccggagctgcgctctcccgtctctttactgggagcgttctcctgccggggcttggacatttccaagggaagtgaaaatccacaaagctgcccccacttcgtaagggcctgtgcctggagggtcgtcgggttacagaaattgaaatcagctctttgccttccaactcttcttggccttgccaccgcgattggttttgttttctttgtttttaacgaattggtaagtaaaatattagttgttcaccctgaaatctgccctaaccacttccgtaccccctgaagctcgctgggcgcgccctgggctgtccttccctgagcagccgggcctagagtcaaggcgcgatgattgccgcgcaagctagggtccacgcggccggggctcctctcccgcctcgggcgcaccagaggccagaaagcggaaagcggctctgccaggccaaggccgacagaaaccgagagcatgtcgctatttgccggagagaactgccctgccaggctgccacaggtgacttgcccgcgcgagccacggcctctgcgcagagctcctcccgaaggggagagtcagagccacccgcgggtttggtcggggctcttcccagcccggcgtccacgccccgcgtcctgcgctcgcccttgcggctgcttatgctcaggtgtttcggaagaggcgccgcgcagccagctctctgtcccttcagctccagctccttctaaagggacagactcagcgtctgcccccatctgcaccccttcccgcaggaataaaatcattttccggacaagcttggaactgttgaaatgtaactatgtaattggagacaccggggtcgtgtctgggagattctgagctcatctacactcttgctaaactgcggggaacccagccctggtgggatctgtgcatctcacatgagcttttttacataaagagcacagacgctgcatttggggcctggtttatctaagcgtggggtttacccc

SEQ ID NO: 108797 - DNA, 2044 bp, Homo sapiens
  misc_feature 1..2044: note = chr13:28551129-28553173
  misc_feature 1..2044: note = Hyper
  source 1..2044: mol_type = genomic DNA
gccacctctggccttcgcctattaccttgtctttgttggggagaccatgggtgtttcatttctcctctgccaatagaagcctaagtagtatttgttggggctctttacaccttccctgtgttggggggggcgggggggtgtcgacgggtggtagaatgtggtgggctcctccgcaggatgctaatgtactttcccccagtggacagtctggctgctggtacaggaagctgcccagcctaataggggtctgaaactccagggctgacaagcaaagatttctatgggcacttccctccatttaatcgacactgcaatctcgcttcattctggggtccaaatacccagcgctgctcaatgttactattttaataactgatgggtttcccggggcagtcgagccacccccccaaagccgacctccgggagagatctttagctggacgcctcccgccttttaggagcgatggctgcaactattccgtccgtccccacggggcgccttcccaacccttcggttggctcttcccttcgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccacaaaggccggtggtgtcgggggccgcaaagggagtgaagaattgaagcagtgagctggataaatccggggcaaagcactaaacaatatggatattttggcaacgcgtgcgcgtgtgggtgggcggacaaaaggactcattactcgtatgattgcctcaattctccacttcctttgtgcacgtgtgtggacgctgttccaggcccgagtccgcctcccgcccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggtcgctgaagcgcgcggcgagcacgaaggggaaaccgaagcgcgcgcggtactgcgcgttgagctcggccagccgcagccgctcgtccgcgcccaggctcctcaggcctgcgccgctctgttcccgctgcgactcggccgtgagcgtgccccgctgcagctcgctgcccgccaggtccgggtggcagcgcaggatgccctcctggcctgcggagaagcacagacaccggcgggagcgcgtcaaccgcgcccgtcccgcaccgcgcactcgagggggcgcgtaggccgcgcccggcccccctgccccgccccgccccgcccggccccaaagaaggctgcgggagggtgaagtagagtacccaggcggtgatgtcctggcggaacaggggcgcccttggcgcgcccctctaacaagtcctggaccttgcgcttctcggtccccactacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcgataaggatcctgagcttttcctatctttcaaagtcctttgctctcagggggggctttgatgtctaaaggggccggacgcaagggcctgaagacttcctgcaaaagctctggaatgggtttcgttctgctccaaaggagaacggacaggggcggggtgcatccatagggataacatccatggggctcggcaaataaatgcc

SEQ ID NO: 108798 - DNA, 30 bp, Homo sapiens; identical to SEQ ID NO: 75887
  misc_feature 1..30: note = chr13:28576403-28576433
  misc_feature 1..30: note = Hypo
  source 1..30: mol_type = genomic DNA

SEQ ID NO: 108799 - DNA, 30 bp, Homo sapiens; identical to SEQ ID NO: 75888
  misc_feature 1..30: note = chr13:28599972-28600002
  misc_feature 1..30: note = Hypo
  source 1..30: mol_type = genomic DNA

SEQ ID NO: 108800 - DNA, 133 bp, Homo sapiens; identical to SEQ ID NO: 75889
  misc_feature 1..133: note = chr13:28613123-28613256
  misc_feature 1..133: note = Hypo
  source 1..133: mol_type = genomic DNA

SEQ ID NO: 108801 - DNA, 1283 bp, Homo sapiens
  misc_feature 1..1283: note = chr13:28673900-28675183
  misc_feature 1..1283: note = Hyper
  source 1..1283: mol_type = genomic DNA
tttggggacagtcctcggagtccttgaaaacccctttggggtttatgccaggataagaagagactagaagaaagggacagctagtattttaatatgtaaatctgtttgcataatatttcctaggtaaactattcgttgatccaaccaaaattcggcggggctggggggtatcgttattgaggatgactcgctctaggggagaacgcggacgcattttcccatcagagttccctccataaatcaaaacctcaaaagaagagttaaagacgacacccaggtgtctacagtatccaagggccgggccaggagaggtccttggccacctggcgccgagttcgcggccgcagactcccacggacggcccagcacccgagcgcgcgggccgagctgccccagacccggcgcagcgcctcggcgaggccgtctgcgaagtccgggccgccactcgggaccgcggcccgagccagaggagagacttcggagaagagggaagaggacgcggggtgggaaacgccggggccgcaggcaagtagtgggcgagtccggagggcgcgaaagaggggaggggcgcgggaggcaatggaaggagcgagcgcggggaggagcgaggcggctgggccggaggaggcgcgcgcccgggtccacactgcggggtgggggctgagggaccgcgaggggctgcgagcgagcgagcggggccttaccgagcagcggcagctggccgccgtcgcgcgccaacgccggcatggcctccggagcccggggtccccaggccgcgccggcccagccctgcgatgccgcctggagcggcgcgcctcgcgctgcaggtggctctcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaa

SEQ ID NO: 108802 - DNA, 2078 bp, Homo sapiens
  misc_feature 1..2078: note = chr13:29067773-29069851
  misc_feature 1..2078: note = Hyper
  source 1..2078: mol_type = genomic DNA
tgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagccgagggcgggggcgatttataacctttccccagcccacttcctaccccggcacctccttctggtgacgtcaaggggtcccccacccctcatccgcctccccacctaccctcttcttcctcccaggctcgcttccctgcggctacggagaggggcgggggccgacgagggcgggtggcccggggccgagcgcgcgtggggaggtgctggcgacgcgggcccgggagcgcggccccggcaggttcagggtctttgctccgcgccctcttgcccttgcccctcctcctgcccatcgcgctcaggaaatccttgcagactccctccacccggcttactcagctctgggggccgcccgaaactggggaagggacaaggctgaagctccgccgcctggccctaggggcggaaagtccgatccaagggaagctggccgcgcctccgcgacggtgttcttggcacggaggactgaggcgcagtccggctgtctccccttgcctgctcttcccgcgctgtcccgccgctcctgaccccttcagactgtcccgagaagtctaggaaggcaccggagaccctcggca

SEQ ID NO: 108803 - DNA, 440 bp, Homo sapiens; identical to SEQ ID NO: 75894
  misc_feature 1..440: note = chr13:29105249-29105689
  misc_feature 1..440: note = Hyper
  source 1..440: mol_type = genomic DNA

SEQ ID NO: 108804 - DNA, 1016 bp, Homo sapiens
  misc_feature 1..1016: note = chr13:29106308-29107324
  misc_feature 1..1016: note = Hyper
  source 1..1016: mol_type = genomic DNA
gtctccccagaggctcgtttcgaacccgcagctagccaagggcaaatgcatactcgaaagtgccacgcctctcgtccaccctgcgccgcgtccagtccacccccttcatcccgcgccccatgtccacccgcccgctgtccaccctgcgccccatgtccatgcgccccctgtccacccgctcactgtccaacccgcgccccatgtccacccgcctgctgcccaccccgcgcccccagtgcacccgcccagccccgagcgcccgcggagccgagtggagagcagcggccgcagcgcggcgccaggctcgggctgggctggccggcgcgaacccccgggggcgtctgggcggccaggccgggtggcggctgcgcacgtaggagtaccccctgagcccagccgctcggccggcctgacccgcgggtgaccggatacgagtaacgcgtgcgccccgatctgtgccctgcgcggggtcgggcggggaccggccgggggcgccgcgcgcccggtcgggttgactgtcgggggcgatttccgcggggcaaggcgggggcgcgggagcagcgcgcagctgcggggccattccacctgagcgccctgaggtcagggccggggcctgaggacacggcgctgggctccgggggacgcgggttcacgccggcgcccgagcgccacctccccgccctccgccggctcacgtagtcccggggttcggtacgtgaagtgccggcgcgaggctgctcaggccaccgcatgggccgggcgataaacaatcgcacaggatacacaacaccctggactgtcacaagcccctcgcaggaaaagataaataacatctgaggcgctgcggcgcggcttccccgggctgaacaaaaactaggaggtggggggcggtggggcgaagtaaacaacagaaccgaagaattgccgcacggagcctgggccggcggagaaaatcagatgcagtctccttccctttggtgactatccgtgggggtttctcccggtggaaatgagcg

SEQ ID NO: 108805 - DNA, 651 bp, Homo sapiens
  misc_feature 1..651: note = chr13:29292691-29293342
  misc_feature 1..651: note = Hyper
  source 1..651: mol_type = genomic DNA
gcctcggatgccctgcgctcgtgcgcgcccgggttcaagggcagcctctggactggggcaacagaggacgcgccggggacagtaacctcggactacgcggccggcgctggggtggggagagtactttcccgtcgaactcgaccaaattacgcttgtcggggagtctcaagcgtattgtaaagcaaacctcggcaagcgcacttccgcgtcccgagtgacacctgcagggttctccggcagccctcggcttccccgcggccctgcggacctcggcctcagcgcggcgcggcggggcgcggagcagctgctccttctgcgcagtggacaatcggccaatcggcgcctccgtcggtcggtcagcggccctgccagcgctaggcgatgactcggccgcagccagctgagcatcgctgtccgccgaggaggcggggtcggctgccgcggcgctgtcactgttctacccggctctcctgcgattgggcccagcggtcggtgccccagcggcgattggtccacccggacgtcactctcccctggagagtggctagtggatcgtgcacccaccctcggaggcccggagtggatcccgcgcgaccgagcagccactcagcaccgctgttgagtggtgggccgcgccgcaggctcaacagc

SEQ ID NO: 108806 - DNA, 70 bp, Homo sapiens; identical to SEQ ID NO: 75901
  misc_feature 1..70: note = chr13:29352560-29352630
  misc_feature 1..70: note = Hypo
  source 1..70: mol_type = genomic DNA

SEQ ID NO: 108807 - DNA, 208 bp, Homo sapiens; identical to SEQ ID NO: 34886
  misc_feature 1..208: note = chr13:29393656-29393864
  misc_feature 1..208: note = Hyper
  source 1..208: mol_type = genomic DNA

SEQ ID NO: 108808 - DNA, 894 bp, Homo sapiens
  misc_feature 1..894: note = chr13:29394080-29394974
  misc_feature 1..894: note = Hyper
  source 1..894: mol_type = genomic DNA
gaggcgcctgggtctcggcgagtgcgtctccgggcggccgggagggggtgcgcgcatcagctgccccgcgccgcctaccgctcgggcccgctcgccgcccggccactgtcaccgcggacggcacctcgcgggcgaggcgcgccggctgcgtggcgcgctgcgaaggttgggctgggcggccgccggccccgcggcttctctttgtccaggcgaggcggctggaggagcagccgcggccgcggcggagccgggagcgcctgggcgtcgtgcgggcggctccggtccccggctgcgccccggccctcgagcgggggcggcggcctgggcggtgcctgcgccgaggtgagtgcgggggcgcggagcggagcgcagccgcggcgcgggcgtgggcgggcagaggtgatagcgagcgccggcggctccaggtgcgggggcgcccctcgcgctccacctgcgccgccgccgccggctctcagggcaagtttatctccccccttctgcggaaacccttgaccgcttagcggagtacagacctgtcggtaaatagaaaactcgagctggagaggaggaggaagcagcgtggcggaacccggcccgagatgagcgtctccgtgagggcagtggtggcctcttggacattacatctttcttggctctttttgacccaggtgagcgaatcctctgctgcgcggtccggtggggtcggctggctctgctgccgccctctggacccgccggagacaggtgagcggagttggggagcgcgcagccgggctcggggcagcgccgggctggttcggcttctcgtctccagagcgctgatgcttcctgcccacatcacctgctctggcttagggactgcagctcttttggcaccttcgcttgctgccaggt

SEQ ID NO: 108809 - DNA, 182 bp, Homo sapiens; identical to SEQ ID NO: 75905
  misc_feature 1..182: note = chr13:29738377-29738559
  misc_feature 1..182: note = Hypo
  source 1..182: mol_type = genomic DNA

SEQ ID NO: 108810 - DNA, 208 bp, Homo sapiens; identical to SEQ ID NO: 75906
  misc_feature 1..208: note = chr13:29914008-29914216
  misc_feature 1..208: note = Hypo
  source 1..208: mol_type = genomic DNA

SEQ ID NO: 108811 - DNA, 214 bp, Homo sapiens; identical to SEQ ID NO: 75907
  misc_feature 1..214: note = chr13:29933425-29933639
  misc_feature 1..214: note = Hypo
  source 1..214: mol_type = genomic DNA

SEQ ID NO: 108812 - DNA, 40 bp, Homo sapiens; identical to SEQ ID NO: 75908
  misc_feature 1..40: note = chr13:29954759-29954799
  misc_feature 1..40: note = Hypo
  source 1..40: mol_type = genomic DNA

SEQ ID NO: 108813 - DNA, 19 bp, Homo sapiens
  misc_feature 1..19: note = chr13:30031261-30031280
  misc_feature 1..19: note = Hypo
  source 1..19: mol_type = genomic DNA
acagcgagactccattcaa

SEQ ID NO: 108814 - DNA, 30 bp, Homo sapiens; identical to SEQ ID NO: 75910
  misc_feature 1..30: note = chr13:30057559-30057589
  misc_feature 1..30: note = Hypo
  source 1..30: mol_type = genomic DNA

SEQ ID NO: 108815 - DNA, 81 bp, Homo sapiens; identical to SEQ ID NO: 75911
  misc_feature 1..81: note = chr13:30098898-30098979
  misc_feature 1..81: note = Hypo
  source 1..81: mol_type = genomic DNA

SEQ ID NO: 108816 - DNA, 123 bp, Homo sapiens; identical to SEQ ID NO: 75912
  misc_feature 1..123: note = chr13:30106999-30107122
  misc_feature 1..123: note = Hypo
  source 1..123: mol_type = genomic DNA

SEQ ID NO: 108817 - DNA, 144 bp, Homo sapiens; identical to SEQ ID NO: 75913
  misc_feature 1..144: note = chr13:30123237-30123381
  misc_feature 1..144: note = Hypo
  source 1..144: mol_type = genomic DNA

SEQ ID NO: 108818 - DNA, 21 bp, Homo sapiens
  misc_feature 1..21: note = chr13:30149067-30149088
  misc_feature 1..21: note = Hypo
  source 1..21: mol_type = genomic DNA
accgtgcgtggccagagcagc

SEQ ID NO: 108819 - DNA, 64 bp, Homo sapiens; identical to SEQ ID NO: 43771
  misc_feature 1..64: note = chr13:30574503-30574567
  misc_feature 1..64: note = Hypo
  source 1..64: mol_type = genomic DNA

SEQ ID NO: 108820 - DNA, 592 bp, Homo sapiens
  misc_feature 1..592: note = chr13:30707178-30707770
  misc_feature 1..592: note = Hypo
  source 1..592: mol_type = genomic DNA
aggtccaggccatagcgacggggacccggaggcaggaccgagagcccagagagttggtggcgctgccgtccctgcactgggtgggccgtgctgggagaaggtcccggggatcactcctcctaggccgccggggcagtctctccagccaccctctttccccagagccagcgggctggggttcttggtttagactctcttctctcctgtcctggaggaccagccatttgacgcccttgtccactgggaggatgttttccatgattccacttcttcccttcctcggccacctaaggcaggccggcttatgcgtgactgtcaaccgaggcaggccacagcgctgtgggcaggcggttttgcacgtatccttagtgaccctgaaggcccagcctctgctggctgcctgagccgagggttttacttcttttcatttaatcactttattggtccttgccgggagggagcccatgggtcctggtaaaagtgcatctccctgtggttctggggctgatcctccttctggagcagaagacagagctcagtgaggaccgcctgtgctgcctgcctgggacgccccagccgcagggccgcgcag

SEQ ID NO: 108821 - DNA, 186 bp, Homo sapiens; identical to SEQ ID NO: 43775
  misc_feature 1..186: note = chr13:30761001-30761187
  misc_feature 1..186: note = Hypo
  source 1..186: mol_type = genomic DNA

SEQ ID NO: 108822 - DNA, 30 bp, Homo sapiens; identical to SEQ ID NO: 75919
  misc_feature 1..30: note = chr13:31003108-31003138
  misc_feature 1..30: note = Hypo
  source 1..30: mol_type = genomic DNA

SEQ ID NO: 108823 - DNA, 175 bp, Homo sapiens; identical to SEQ ID NO: 75920
  misc_feature 1..175: note = chr13:31385108-31385283
  misc_feature 1..175: note = Hypo
  source 1..175: mol_type = genomic DNA

SEQ ID NO: 108824 - DNA, 41 bp, Homo sapiens; identical to SEQ ID NO: 75921
  misc_feature 1..41: note = chr13:31415119-31415160
  misc_feature 1..41: note = Hypo
  source 1..41: mol_type = genomic DNA

SEQ ID NO: 108825 - DNA, 230 bp, Homo sapiens; identical to SEQ ID NO: 75922
  misc_feature 1..230: note = chr13:31742917-31743147
  misc_feature 1..230: note = Hypo
  source 1..230: mol_type = genomic DNA

SEQ ID NO: 108826 - DNA, 89 bp, Homo sapiens; identical to SEQ ID NO: 43777
  misc_feature 1..89: note = chr13:31821217-31821306
  misc_feature 1..89: note = Hypo
  source 1..89: mol_type = genomic DNA

SEQ ID NO: 108827 - DNA, 27 bp, Homo sapiens
  misc_feature 1..27: note = chr13:32159215-32159242
  misc_feature 1..27: note = Hypo
  source 1..27: mol_type = genomic DNA
ggcatgagccaccgcgcacggcccatg

SEQ ID NO: 108828 - DNA, 25 bp, Homo sapiens
  misc_feature 1..25: note = chr13:32244681-32244706
  misc_feature 1..25: note = Hypo
  source 1..25: mol_type = genomic DNA
acaggctaggctgggcgcggtggct

SEQ ID NO: 108829 - DNA, 30 bp, Homo sapiens; identical to SEQ ID NO: 75926
  misc_feature 1..30: note = chr13:32605107-32605137
  misc_feature 1..30: note = Hyper
  source 1..30: mol_type = genomic DNA

SEQ ID NO: 108830 - DNA, 34 bp, Homo sapiens; identical to SEQ ID NO: 75927
  misc_feature 1..34: note = chr13:32605459-32605493
  misc_feature 1..34: note = Hyper
  source 1..34: mol_type = genomic DNA

SEQ ID NO: 108831 - DNA, 191 bp, Homo sapiens; identical to SEQ ID NO: 75928
  misc_feature 1..191: note = chr13:32605725-32605916
  misc_feature 1..191: note = Hyper
  source 1..191: mol_type = genomic DNA

SEQ ID NO: 108832 - DNA, 91 bp, Homo sapiens; identical to SEQ ID NO: 75929
  misc_feature 1..91: note = chr13:32670558-32670649
  misc_feature 1..91: note = Hypo
  source 1..91: mol_type = genomic DNA

SEQ ID NO: 108833 - DNA, 171 bp, Homo sapiens; identical to SEQ ID NO: 75930
  misc_feature 1..171: note = chr13:32752857-32753028
  misc_feature 1..171: note = Hypo
  source 1..171: mol_type = genomic DNA

SEQ ID NO: 108834 - DNA, 76 bp, Homo sapiens; identical to SEQ ID NO: 75931
  misc_feature 1..76: note = chr13:32755306-32755382
  misc_feature 1..76: note = Hypo
  source 1..76: mol_type = genomic DNA

SEQ ID NO: 108835 - DNA, 30 bp, Homo sapiens; identical to SEQ ID NO: 75932
  misc_feature 1..30: note = chr13:32798473-32798503
  misc_feature 1..30: note = Hypo
  source 1..30: mol_type = genomic DNA

SEQ ID NO: 108836 - DNA, 160 bp, Homo sapiens; identical to SEQ ID NO: 34889
  misc_feature 1..160: note = chr13:33001068-33001228
  misc_feature 1..160: note = Hyper
  source 1..160: mol_type = genomic DNA

SEQ ID NO: 108837 - DNA, 121 bp, Homo sapiens; identical to SEQ ID NO: 75934
  misc_feature 1..121: note = chr13:33113918-33114039
  misc_feature 1..121: note = Hypo
  source 1..121: mol_type = genomic DNA

SEQ ID NO: 108838 - DNA, 17 bp, Homo sapiens
  misc_feature 1..17: note = chr13:33410944-33410961
  misc_feature 1..17: note = Hypo
  source 1..17: mol_type = genomic DNA
ctcggcctcccaaagtg

SEQ ID NO: 108839 - DNA, 86 bp, Homo sapiens; identical to SEQ ID NO: 75936
  misc_feature 1..86: note = chr13:33590122-33590208
  misc_feature 1..86: note = Hyper
  source 1..86: mol_type = genomic DNA

SEQ ID NO: 108840 - DNA, 974 bp, Homo sapiens
  misc_feature 1..974: note = chr13:33590467-33591441
  misc_feature 1..974: note = Hyper
  source 1..974: mol_type = genomic DNA
gagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggatacgttcacccaccaccccctggcacccccgggagactcccggaacgccagtctgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacaga

SEQ ID NO: 108841 - DNA, 105 bp, Homo sapiens; identical to SEQ ID NO: 75939
  misc_feature 1..105: note = chr13:33924609-33924714
  misc_feature 1..105: note = Hyper
  source 1..105: mol_type = genomic DNA

SEQ ID NO: 108842 - DNA, 30 bp, Homo sapiens; identical to SEQ ID NO: 75940
  misc_feature 1..30: note = chr13:34345129-34345159
  misc_feature 1..30: note = Hypo
  source 1..30: mol_type = genomic DNA

SEQ ID NO: 108843 - DNA, 42 bp, Homo sapiens; identical to SEQ ID NO: 75941
  misc_feature 1..42: note = chr13:35516493-35516535
  misc_feature 1..42: note = Hyper
  source 1..42: mol_type = genomic DNA

SEQ ID NO: 108844 - DNA, 41 bp, Homo sapiens; identical to SEQ ID NO: 34893
  misc_feature 1..41: note = chr13:35517132-35517173
  misc_feature 1..41: note = Hyper
  source 1..41: mol_type = genomic DNA

SEQ ID NO: 108845 - DNA, 101 bp, Homo sapiens
  misc_feature 1..101: note = chr13:36045265-36045366
  misc_feature 1..101: note = Hyper
  source 1..101: mol_type = genomic DNA
ccacccccttgtaatcgcgacagaagccagcccagccctctgtgttcccgcagcctcgggaacggcccggcattgtgcaggacggtcgcagattgggtgtg

SEQ ID NO: 108846 - DNA, 836 bp, Homo sapiens
  misc_feature 1..836: note = chr13:36704800-36705636
  misc_feature 1..836: note = Hyper
  source 1..836: mol_type = genomic DNA
cacacatcactggcccgggcacacggaaaagcacacacacaataagaggccgggcccggccactccttccttggttcccgctccgcagccagttctgacaatgacaagcacctctcccagctcctccgccctggctctccatctccactaacaacgcgaaaagcctgggagggcccgctcgcctgactccaggtttaaagccccatggcaccaaacaaaagaggcaggtgccagcagccccggggccgcccgcacgcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctcggcccgtcctcattgaaatgcggcgcttcgcacagcctcactccagcctctctctccagaggagggcggcggcggcggcggcggcgggcgcgctcccttttcttgtctcactcgctcacacgccctcccgtctccctcctcctcctcctcctccgcgtgcgcgccccgtcgcccccgcccttcttggcag

SEQ ID NO: 108847 - DNA, 244 bp, Homo sapiens
  misc_feature 1..244: note = chr13:36729093-36729337
  misc_feature 1..244: note = Hyper
  source 1..244: mol_type = genomic DNA
aagggcagaggtcagcgcggggtctccccggagcaggagtgagcggcgagtgacaggtgcagccgcgccatccccaagcatcccggaacctggcccggaggctgctgtgggatccacagccctgcgcgctggggaggcgctgcaatgaccctgcggcggcgccttcccccggcgtccccaaatagaaacagcactagtgccctctctccgaccccaccagggccgctgccgggctcctccttac

SEQ ID NO: 108848 - DNA, 30 bp, Homo sapiens; identical to SEQ ID NO: 75947
  misc_feature 1..30: note = chr13:36788716-36788746
  misc_feature 1..30: note = Hypo
  source 1..30: mol_type = genomic DNA

SEQ ID NO: 108849 - DNA, 30 bp, Homo sapiens; identical to SEQ ID NO: 75948
  misc_feature 1..30: note = chr13:36878705-36878735
  misc_feature 1..30: note = Hypo
  source 1..30: mol_type = genomic DNA

SEQ ID NO: 108850 - DNA, 29 bp, Homo sapiens
  misc_feature 1..29: note = chr13:36883103-36883132
  misc_feature 1..29: note = Hypo
  source 1..29: mol_type = genomic DNA
aggtgtggtggctcacgcctgtaatccca

SEQ ID NO: 108851 - DNA, 44 bp, Homo sapiens; identical to SEQ ID NO: 75950
  misc_feature 1..44: note = chr13:36885927-36885971
  misc_feature 1..44: note = Hypo
  source 1..44: mol_type = genomic DNA

SEQ ID NO: 108852 - DNA, 1332 bp, Homo sapiens
  misc_feature 1..1332: note = chr13:36919856-36921188
  misc_feature 1..1332: note = Hyper
  source 1..1332: mol_type = genomic DNA
taaagagtaaaatcacgcgcaatccatcccaatataaccgcagttgttcgtgggccttcttgcagagaaaggctgcccaaccttgacggggccatgggcgctgcgggagggcaaaagaccacagagatctgcgaagccaaagtaaacaacggggttggggcggcgagaatgatcaatagcgatgctccgaaaggactccgcgataggaatcgagcgggaaggattccctccatcctaacagtccatgggttaagaggccgaagcttccctaaataccacactcccgcgagagaagggactgagaacaacttctcaaactattctctctcgaaatcgctcccttcctcgaaaattccatctctgagactcggatgaggtccccaccccctccacccttgtcccgtgaccgtcgcccgctcagcctcccagccgagtccgcggggcctggggcgcccaccccgcccacccaagggaccgcgcaggggtgaactcccccgcgccccacctgcgccttccagacctcgggcgccccggcgttgcctcgagagctccctgcgcggccgccgcggcacggaccagctcccactcccttacactgggcgccgctgcgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccgccgcagcctaggtcacgtgagtacccacgcgcgcgtcttgccagcggattcatcaccggcctgctcagactaggttctgcccactctgaccttctaaatggtacgtgggaggacgtccgtccccttcggacccaagagtcaccgtaacactctagaaggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtcttggtgtgtgtgtaaagtctatatcactatcataaaactgttagttcctgattccgggatacaaagagt

SEQ ID NO: 108853 - DNA, 161 bp, Homo sapiens; identical to SEQ ID NO: 75955
  misc_feature 1..161: note = chr13:37004731-37004892
  misc_feature 1..161: note = Hyper
  source 1..161: mol_type = genomic DNA

SEQ ID NO: 108854 - DNA, 1398 bp, Homo sapiens
  misc_feature 1..1398: note = chr13:37005473-37006871
  misc_feature 1..1398: note = Hyper
  source 1..1398: mol_type = genomic DNA
agtcacctatgcaggcgtctgagcccccgggtttccaggagccccccgtataaggaccccagggactcctctccccacgcggccgggccgcccgcccggcccccagcccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccgcctcccaggctggaatccctcgacacttggtccttcccgccccgcccttccgtgccctgcccttccctgcccttccccgccctgccccgcccggcccggcccggccctgcccaaccctgccccgccctgccccgcccagccggccacctcttaaccgcgatcctccagtgcacttgccagttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccaggtaac

SEQ ID NO: 108855 - DNA, 265 bp, Homo sapiens
  misc_feature 1..265: note = chr13:37247973-37248238
  misc_feature 1..265: note = Hyper
  source 1..265: mol_type = genomic DNA
attttccaatggtggcgcaagctcctccctcgcccgagctgggcgccgtcctagagccaagcgcccgctagagccgagactagggggcggtgaggagtgggacccgctcgcggccattggttgtgcggccaggaggggcggagggacgacgcgcgggctgtgcggggccggcagcccggatccactcccgctgcgcctgctgtccgccgtgcgcccagactgcgcgccgcgccgctgcgcccaacattcccgaggacggcttcgc

SEQ ID NO: 108856 - DNA, 542 bp, Homo sapiens
  misc_feature 1..542: note = chr13:37248512-37249054
  misc_feature 1..542: note = Hyper
  source 1..542: mol_type = genomic DNA
gtgtccttactgtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggcgttttccctagctcccggaaacccagtaggtaactgcgccagcgacccttcccctcttcccgggtctgatgagac

SEQ ID NO: 108857 - DNA, 67 bp, Homo sapiens; identical to SEQ ID NO: 75963
  misc_feature 1..67: note = chr13:37493463-37493530
  misc_feature 1..67: note = Hyper
  source 1..67: mol_type = genomic DNA

SEQ ID NO: 108858 - DNA, 118 bp, Homo sapiens
  misc_feature 1..118: note = chr13:37494004-37494122
  misc_feature 1..118: note = Hyper
  source 1..118: mol_type = genomic DNA
cccgggaacaacgaccgccaaaagccaagcctcacgccgaggagcctcccaggctgccccgaggacgaacaacttcgccctccactcaatgcgctcacacgcacgcacacaagcagcg

SEQ ID NO: 108859 - DNA, 29 bp, Homo sapiens
  misc_feature 1..29: note = chr13:37633989-37634018
  misc_feature 1..29: note = Hyper
  source 1..29: mol_type = genomic DNA
ctggagtccgagtccgcaaagtgggaggg

SEQ ID NO: 108860 - DNA, 461 bp, Homo sapiens; identical to SEQ ID NO: 75965
  misc_feature 1..461: note = chr13:37643689-37644150
  misc_feature 1..461: note = Hypo
  source 1..461: mol_type = genomic DNA

SEQ ID NO: 108861 - DNA, 488 bp, Homo sapiens
  misc_feature 1..488: note = chr13:38443222-38443710
  misc_feature 1..488: note = Hyper
  source 1..488: mol_type = genomic DNA
gacgcagaatgtaatcgatcggtagaacattgatcactctccttccttcgttaccctactttaagtgccggagagctaaggcctcacttatatgcacccagatgcccccgagatctccattttccccaaatgcataaaaggctaaaaacggccacattccccagcaccacggcgtggctgcagctcctttgtttaccatataagtcacaccgggggttcactcctcgccctctcccctgctttaaagccgagtgcggcggaagactgaggagcacccccaaactcctgctcagcccgagtcaagcaccgaaagcttcacaggtttttttcctgagccttgaagagaaaccacatagccagaaccttttgaactcctaaccccgcagggatgtccgcctcccagaagagagccggcttcccaggcagcttaggaaacttaaccgagatcccagaaagaaggcgaggtgtagctccggtcgaacggagcc

SEQ ID NO: 108862 - DNA, 291 bp, Homo sapiens; identical to SEQ ID NO: 75969
  misc_feature 1..291: note = chr13:39260356-39260647
  misc_feature 1..291: note = Hyper
  source 1..291: mol_type = genomic DNA

SEQ ID NO: 108863 - DNA, 389 bp, Homo sapiens; identical to SEQ ID NO: 75970
  misc_feature 1..389: note = chr13:39261007-39261396
  misc_feature 1..389: note = Hyper
  source 1..389: mol_type = genomic DNA

SEQ ID NO: 108864 - DNA, 623 bp, Homo sapiens
  misc_feature 1..623: note = chr13:39261689-39262312
  misc_feature 1..623: note = Hyper
  source 1..623: mol_type = genomic DNA
aggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagg

SEQ ID NO: 108865 - DNA, 231 bp, Homo sapiens; identical to SEQ ID NO: 75974
  misc_feature 1..231: note = chr13:40020679-40020910
  misc_feature 1..231: note = Hypo
  source 1..231: mol_type = genomic DNA

SEQ ID NO: 108866 - DNA, 30 bp, Homo sapiens; identical to SEQ ID NO: 75975
  misc_feature 1..30: note = chr13:40211522-40211552
  misc_feature 1..30: note = Hypo
  source 1..30: mol_type = genomic DNA

SEQ ID NO: 108867 - DNA, 86 bp, Homo sapiens; identical to SEQ ID NO: 75976
  misc_feature 1..86: note = chr13:41103265-41103351
  misc_feature 1..86: note = Hypo
  source 1..86: mol_type = genomic DNA

SEQ ID NO: 108868 - DNA, 48 bp, Homo sapiens; identical to SEQ ID NO: 75977
  misc_feature 1..48: note = chr13:41238485-41238533
  misc_feature 1..48: note = Hyper
  source 1..48: mol_type = genomic DNA

SEQ ID NO: 108869 - DNA, 35 bp, Homo sapiens; identical to SEQ ID NO: 75978
  misc_feature 1..35: note = chr13:41241688-41241723
  misc_feature 1..35: note = Hyper
  source 1..35: mol_type = genomic DNA

SEQ ID NO: 108870 - DNA, 30 bp, Homo sapiens; identical to SEQ ID NO: 75979
  misc_feature 1..30: note = chr13:41496219-41496249
  misc_feature 1..30: note = Hypo
  source 1..30: mol_type = genomic DNA

SEQ ID NO: 108871 - DNA, 53 bp, Homo sapiens; identical to SEQ ID NO: 15760
  misc_feature 1..53: note = chr13:41681520-41681573
  misc_feature 1..53: note = Hypo
  source 1..53: mol_type = genomic DNA

SEQ ID NO: 108872 - DNA, 30 bp, Homo sapiens; identical to SEQ ID NO: 43786
  misc_feature 1..30: note = chr13:41705935-41705965
  misc_feature 1..30: note = Hypo
  source 1..30: mol_type = genomic DNA

SEQ ID NO: 108873 - DNA, 53 bp, Homo sapiens; identical to SEQ ID NO: 75982
  misc_feature 1..53: note = chr13:41859167-41859220
  misc_feature 1..53: note = Hypo
  source 1..53: mol_type = genomic DNA

SEQ ID NO: 108874 - DNA, 30 bp, Homo sapiens; identical to SEQ ID NO: 75983
  misc_feature 1..30: note = chr13:42021853-42021883
  misc_feature 1..30: note = Hypo
  source 1..30: mol_type = genomic DNA

SEQ ID NO: 108875 - DNA, 30 bp, Homo sapiens; identical to SEQ ID NO: 75984
  misc_feature 1..30: note = chr13:42022516-42022546
  misc_feature 1..30: note = Hypo
  source 1..30: mol_type = genomic DNA

SEQ ID NO: 108876 - DNA, 231 bp, Homo sapiens; identical to SEQ ID NO: 75985
  misc_feature 1..231: note = chr13:42031162-42031393
  misc_feature 1..231: note = Hyper
  source 1..231: mol_type = genomic DNA

SEQ ID NO: 108877 - DNA, 153 bp, Homo sapiens; identical to SEQ ID NO: 75986
  misc_feature 1..153: note = chr13:42032496-42032649
  misc_feature 1..153: note = Hyper
  source 1..153: mol_type = genomic DNA

SEQ ID NO: 108878 - DNA, 29 bp, Homo sapiens
  misc_feature 1..29: note = chr13:42063589-42063618
  misc_feature 1..29: note = Hypo
  source 1..29: mol_type = genomic DNA
ggcgtgagccaccgcgcctggccactcct

SEQ ID NO: 108879 - DNA, 181 bp, Homo sapiens; identical to SEQ ID NO: 43787
  misc_feature 1..181: note = chr13:42540722-42540903
  misc_feature 1..181: note = Hypo
  source 1..181: mol_type = genomic DNA

SEQ ID NO: 108880 - DNA, 118 bp, Homo sapiens
  misc_feature 1..118: note = chr13:43149215-43149333
  misc_feature 1..118: note = Hyper
  source 1..118: mol_type = genomic DNA
gtgggcagaatgacacggcgcgaccagagaggcgcgggctcgggatgggggctctgcggctgtggcgctgtcctgtgggggtgaaggaagagggacagccccacgtgcctgctaggga

SEQ ID NO: 108881 - DNA, 51 bp, Homo sapiens; identical to SEQ ID NO: 75991
  misc_feature 1..51: note = chr13:43543176-43543227
  misc_feature 1..51: note = Hypo
  source 1..51: mol_type = genomic DNA

SEQ ID NO: 108882 - DNA, 637 bp, Homo sapiens; identical to SEQ ID NO: 75992
  misc_feature 1..637: note = chr13:43565939-43566576
  misc_feature 1..637: note = Hyper
  source 1..637: mol_type = genomic DNA

SEQ ID NO: 108883 - DNA, 30 bp, Homo sapiens; identical to SEQ ID NO: 75993
  misc_feature 1..30: note = chr13:43728041-43728071
  misc_feature 1..30: note = Hypo
  source 1..30: mol_type = genomic DNA

SEQ ID NO: 108884 - DNA, 199 bp, Homo sapiens; identical to SEQ ID NO: 75994
  misc_feature 1..199: note = chr13:43985951-43986150
  misc_feature 1..199: note = Hypo
  source 1..199: mol_type = genomic DNA

SEQ ID NO: 108885 - DNA, 1406 bp, Homo sapiens
  misc_feature 1..1406: note = chr13:44359820-44361226
  misc_feature 1..1406: note = Hyper
  source 1..1406: mol_type = genomic DNA
ggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggccgtgcagggggaggacgtggggtggtctgggaggggccgcgtccgtgggaggctcgcacgtgtcgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcccgcagcagagcggagtccgccaaggctggaggaaaagggatgcagagcgggagggtgaaaacctgaaagaagagggcagcgggaacactgtgtgggcaggaacgggtcccgggggcgacgcccgcagggggagacgggtgcggggtgcgctgtccaaggtgcaggggaggtgactggcgcgcggcgggcgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggccgccgtatggggagcggaggcaacccgctgcgcggagtggggcgccgggcgcggcgcggctcctcctagcctcggcgtcctcctcctcctttgcttctcccggactctgtcccgggcacggagctgggagacgcggccgggctgcagtcgccgttccctctgctgccgccgccgctgcagcagacagaggacgccccgtggcggctggaagcctgtgtgagtagcggcgcccgggagagcggggatctgctgaggggcgctggagactccgcggctggaggcgcgcgggcgtgcgcacgcgcgcctgcgagtgtgagtgtatgggtgcgcgcgcgcccacggggtgggggagtcgcgaggggagggggagagaggccgagagatgctcgtagggaccgaggcaaaattctacgaccccggaaatccgtaaac

SEQ ID NO: 108886 - DNA, 34 bp, Homo sapiens; identical to SEQ ID NO: 75999
  misc_feature 1..34: note = chr13:44361544-44361578
  misc_feature 1..34: note = Hyper
  source 1..34: mol_type = genomic DNA

SEQ ID NO: 108887 - DNA, 834 bp, Homo sapiens
  misc_feature 1..834: note = chr13:44947708-44948542
  misc_feature 1..834: note = Hyper
  source 1..834: mol_type = genomic DNA
aaacacaggaggggccgcgtccccgtccccgacgcgctcacaaacgccgtggtcgcccgaaccttcggccccgcagcattcggctacaggaccgcgacactgcagggccccggctctgcgcgctgcgctccggccgctcggcgcgggaggacgtgcggtcgcgcctgcctcggtggccgcgcggggtaggtggctgcggggaccggaaggatggcgaggaagtcggaaagggtttcctgagatgagagattacttccgtccgggctgcggcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctcctccccgacccgcaccccctgtccc

SEQ ID NO: 108888 - DNA, 56 bp, Homo sapiens; identical to SEQ ID NO: 76001
  misc_feature 1..56: note = chr13:45165560-45165616
  misc_feature 1..56: note = Hypo
  source 1..56: mol_type = genomic DNA

SEQ ID NO: 108889 - DNA, 38 bp, Homo sapiens; identical to SEQ ID NO: 76002
  misc_feature 1..38: note = chr13:45491139-45491177
  misc_feature 1..38: note = Hypo
  source 1..38: mol_type = genomic DNA

SEQ ID NO: 108890 - DNA, 26 bp, Homo sapiens
  misc_feature 1..26: note = chr13:45562261-45562287
  misc_feature 1..26: note = Hypo
  source 1..26: mol_type = genomic DNA
ctgcactacctggcccggcgtggtgg

SEQ ID NO: 108891 - DNA, 26 bp, Homo sapiens
  misc_feature 1..26: note = chr13:45562467-45562493
  misc_feature 1..26: note = Hypo
  source 1..26: mol_type = genomic DNA
ttgcttgaactcgggaggcagaggtt

SEQ ID NO: 108892 - DNA, 260 bp, Homo sapiens; identical to SEQ ID NO: 76005
  misc_feature 1..260: note = chr13:45564543-45564803
  misc_feature 1..260: note = Hypo
  source 1..260: mol_type = genomic DNA

SEQ ID NO: 108893 - DNA, 281 bp, Homo sapiens; identical to SEQ ID NO: 76006
  misc_feature 1..281: note = chr13:45885713-45885994
  misc_feature 1..281: note = Hyper
  source 1..281: mol_type = genomic DNA

SEQ ID NO: 108894 - DNA, 22 bp, Homo sapiens
  misc_feature 1..22: note = chr13:45905242-45905264
  misc_feature 1..22: note = Hypo
  source 1..22: mol_type = genomic DNA
cttttgtcgatttgtcttttgt

SEQ ID NO: 108895 - DNA, 34 bp, Homo sapiens; identical to SEQ ID NO: 76008
  misc_feature 1..34: note = chr13:45926312-45926346
  misc_feature 1..34: note = Hypo
  source 1..34: mol_type = genomic DNA

SEQ ID NO: 108896 - DNA, 30 bp, Homo sapiens; identical to SEQ ID NO: 43794
  misc_feature 1..30: note = chr13:45939250-45939280
  misc_feature 1..30: note = Hypo
  source 1..30: mol_type = genomic DNA

SEQ ID NO: 108897 - DNA, 34 bp, Homo sapiens; identical to SEQ ID NO: 43795
  misc_feature 1..34: note = chr13:45950905-45950939
  misc_feature 1..34: note = Hypo
  source 1..34: mol_type = genomic DNA

SEQ ID NO: 108898 - DNA, 30 bp, Homo sapiens; identical to SEQ ID NO: 76011
  misc_feature 1..30: note = chr13:45992804-45992834
  misc_feature 1..30: note = Hyper
  source 1..30: mol_type = genomic DNA

SEQ ID NO: 108899 - DNA, 174 bp, Homo sapiens
  misc_feature 1..174: note = chr13:46189788-46189962
  misc_feature 1..174: note = Hyper
  source 1..174: mol_type = genomic DNA
ggagcgcattgctaacgtgcgcagcccttacccaagccaggctcccgcgcgtgcatccaccgcgatctcaggccccggcgtttgtggcagctctcggttaccatgggaaccgcactccgcagcctccctgggccccatctaatctgcgtgtgtgcgtggcggagaattctaagc

SEQ ID NO: 108900 - DNA, 30 bp, Homo sapiens; identical to SEQ ID NO: 76013
  misc_feature 1..30: note = chr13:46424993-46425023
  misc_feature 1..30: note = Hyper
  source 1..30: mol_type = genomic DNA

SEQ ID NO: 108901 - DNA, 331 bp, Homo sapiens
  misc_feature 1..331: note = chr13:46425360-46425691
  misc_feature 1..331: note = Hyper
  source 1..331: mol_type = genomic DNA
ctctcaggttgacagcgtcggggaaagacatcagaccatcaatccagcttttcctgccagctggggaaacaacactcggtcactaacagcacccaatcacctagagagcgagagtgagccgaggcaaacacgccgggttccagacaccgtcccagcccccgagacccgggtttgcaaagggctgcacacgttcgccggagggtcgctgccgcctccgagaaaggacttgaacctgagcccggtgaaggtaaaatgacacagagactcacctttaggttgtgtgtggggttgacgacacagacaagttgcccggcagcggagaaaacccgtt

SEQ ID NO: 108902 - DNA, 90 bp, Homo sapiens; identical to SEQ ID NO: 76016
  misc_feature 1..90: note = chr13:46659250-46659340
  misc_feature 1..90: note = Hypo
  source 1..90: mol_type = genomic DNA

SEQ ID NO: 108903 - DNA, 20 bp, Homo sapiens
  misc_feature 1..20: note = chr13:46660849-46660869
  misc_feature 1..20: note = Hypo
  source 1..20: mol_type = genomic DNA
tcctacggctatttatggca

SEQ ID NO: 108904 - DNA, 147 bp, Homo sapiens; identical to SEQ ID NO: 76018
  misc_feature 1..147: note = chr13:46661276-46661423
  misc_feature 1..147: note = Hypo
  source 1..147: mol_type = genomic DNA

SEQ ID NO: 108905 - DNA, 406 bp, Homo sapiens; identical to SEQ ID NO: 76019
  misc_feature 1..406: note = chr13:46785697-46786103
  misc_feature 1..406: note = Hyper
  source 1..406: mol_type = genomic DNA

SEQ ID NO: 108906 - DNA, 30 bp, Homo sapiens; identical to SEQ ID NO: 76020
  misc_feature 1..30: note = chr13:46896454-46896484
  misc_feature 1..30: note = Hypo
  source 1..30: mol_type = genomic DNA

SEQ ID NO: 108907 - DNA, 172 bp, Homo sapiens; identical to SEQ ID NO: 15765
  misc_feature 1..172: note = chr13:46920144-46920316
  misc_feature 1..172: note = Hypo
  source 1..172: mol_type = genomic DNA

SEQ ID NO: 108908 - DNA, 21 bp, Homo sapiens
  misc_feature 1..21: note = chr13:46926247-46926268
  misc_feature 1..21: note = Hypo
  source 1..21: mol_type = genomic DNA
ccaccacgcccactgcacttt

SEQ ID NO: 108909 - DNA, 599 bp, Homo sapiens; identical to SEQ ID NO: 76023
  misc_feature 1..599: note = chr13:46961084-46961683
  misc_feature 1..599: note = Hyper
  source 1..599: mol_type = genomic DNA

SEQ ID NO: 108910 - DNA, 158 bp, Homo sapiens; identical to SEQ ID NO: 76024
  misc_feature 1..158: note = chr13:47043913-47044071
  misc_feature 1..158: note = Hypo
  source 1..158: mol_type = genomic DNA

SEQ ID NO: 108911 - DNA, 29 bp, Homo sapiens
  misc_feature 1..29: note = chr13:47468139-47468168
  misc_feature 1..29: note = Hyper
  source 1..29: mol_type = genomic DNA
tatgggggaagccacgctctgtctgttcg

SEQ ID NO: 108912 - DNA, 16 bp, Homo sapiens
  misc_feature 1..16: note = chr13:47526166-47526182
  misc_feature 1..16: note = Hypo
  source 1..16: mol_type = genomic DNA
tcgctatcttttaacc

SEQ ID NO: 108913 - DNA, 142 bp, Homo sapiens; identical to SEQ ID NO: 43800
  misc_feature 1..142: note = chr13:47528522-47528664
  misc_feature 1..142: note = Hypo
  source 1..142: mol_type = genomic DNA

SEQ ID NO: 108914 - DNA, 30 bp, Homo sapiens; identical to SEQ ID NO: 76027
  misc_feature 1..30: note = chr13:47685252-47685282
  misc_feature 1..30: note = Hypo
  source 1..30: mol_type = genomic DNA

SEQ ID NO: 108915 - DNA, 29 bp, Homo sapiens
  misc_feature 1..29: note = chr13:48318948-48318977
  misc_feature 1..29: note = Hypo
  source 1..29: mol_type = genomic DNA
ggagttggccgggcgcggtggctcacgcc

SEQ ID NO: 108916 - DNA, 30 bp, Homo sapiens; identical to SEQ ID NO: 15766
  misc_feature 1..30: note = chr13:48667877-48667907
  misc_feature 1..30: note = Hypo
  source 1..30: mol_type = genomic DNA

SEQ ID NO: 108917 - DNA, 30 bp, Homo sapiens; identical to SEQ ID NO: 76030
  misc_feature 1..30: note = chr13:49254587-49254617
  misc_feature 1..30: note = Hypo
  source 1..30: mol_type = genomic DNA

SEQ ID NO: 108918 - DNA, 1271 bp, Homo sapiens
  misc_feature 1..1271: note = chr13:49794117-49795388
  misc_feature 1..1271: note = Hyper
  source 1..1271: mol_type = genomic DNA
gcagacatcgctcaccggaccgggtagggctcgtgcgctaagggcgccgggtattccagttagtggagagggaagcgccctggaactgcatgggcccgggagagggcgcgggagcggagcagggccgggccggggcgggccgcggccgtgggcggagactgcgcgcagctagctcgggagcgcctcggagcccaccccgcagagccgcttctcgcgccccgcagcgcagcgcagcgctccgccgtctgacctgccgcgcccgcagcgtgcgggctgggaaaggaggcgctcaccgagagggaccacgcgccaggctcccagcccgacccgggacgcggcggccgcgcggagcacccatgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgcgtaagtggagccgc

SEQ ID NO: 108919 - DNA, 30 bp, Homo sapiens; identical to SEQ ID NO: 76032
  misc_feature 1..30: note = chr13:49877160-49877190
  misc_feature 1..30: note = Hypo
  source 1..30: mol_type = genomic DNA

SEQ ID NO: 108920 - DNA, 63 bp, Homo sapiens; identical to SEQ ID NO: 43802
  misc_feature 1..63: note = chr13:49922188-49922251
  misc_feature 1..63: note = Hypo
  source 1..63: mol_type = genomic DNA

SEQ ID NO: 108921 - DNA, 138 bp, Homo sapiens; identical to SEQ ID NO: 76034
  misc_feature 1..138: note = chr13:49922941-49923079
  misc_feature 1..138: note = Hypo
  source 1..138: mol_type = genomic DNA

SEQ ID NO: 108922 - DNA, 297 bp, Homo sapiens
  misc_feature 1..297: note = chr13:50070420-50070717
  misc_feature 1..297: note = Hyper
  source 1..297: mol_type = genomic DNA
ggccagaggacagggcgcggcccaggccagttccacaggtggctctgactgcccatggtttcgcgcgagtggtgggcacgcttcggtttacctcccccgcgggtgacagcccagtgcttccaccacaaccgatgtcaactctcctagcgcccctccgctcaccggtaaaccaggacagtggaggggcgccctgatgcggtgaggcagggggcggccctgagggaagagctgggtctcacgttcacggaggacgtgactggaacccgtctccccttctccagtcgttccagtcctccc

SEQ ID NO: 108923 - DNA, 21 bp, Homo sapiens
  misc_feature 1..21: note = chr13:50367842-50367863
  misc_feature 1..21: note = Hypo
  source 1..21: mol_type = genomic DNA
ataaagagctgctttcggccg

SEQ ID NO: 108924 - DNA, 311 bp, Homo sapiens; identical to SEQ ID NO: 76038
  misc_feature 1..311: note = chr13:50704489-50704800
  misc_feature 1..311: note = Hyper
  source 1..311: mol_type = genomic DNA

SEQ ID NO: 108925 - DNA, 52 bp, Homo sapiens; identical to SEQ ID NO: 76039
  misc_feature 1..52: note = chr13:50705047-50705099
  misc_feature 1..52: note = Hyper
  source 1..52: mol_type = genomic DNA

SEQ ID NO: 108926 - DNA, 92 bp, Homo sapiens; identical to SEQ ID NO: 76040
  misc_feature 1..92: note = chr13:51086819-51086911
  misc_feature 1..92: note = Hyper
  source 1..92: mol_type = genomic DNA

SEQ ID NO: 108927 - DNA, 104 bp, Homo sapiens; identical to SEQ ID NO: 76041
  misc_feature 1..104: note = chr13:51796701-51796805
  misc_feature 1..104: note = Hyper
  source 1..104: mol_type = genomic DNA

SEQ ID NO: 108928 - DNA, 231 bp, Homo sapiens; identical to SEQ ID NO: 76042
  misc_feature 1..231: note = chr13:51797015-51797246
  misc_feature 1..231: note = Hyper
  source 1..231: mol_type = genomic DNA

SEQ ID NO: 108929 - DNA, 30 bp, Homo sapiens; identical to SEQ ID NO: 76043
  misc_feature 1..30: note = chr13:52389910-52389940
  misc_feature 1..30: note = Hypo
  source 1..30: mol_type = genomic DNA

SEQ ID NO: 108930 - DNA, 30 bp, Homo sapiens; identical to SEQ ID NO: 76044
  misc_feature 1..30: note = chr13:52390252-52390282
  misc_feature 1..30: note = Hypo
  source 1..30: mol_type = genomic DNA

SEQ ID NO: 108931 - DNA, 84 bp, Homo sapiens; identical to SEQ ID NO: 76045
  misc_feature 1..84: note = chr13:52532586-52532670
  misc_feature 1..84: note = Hypo
  source 1..84: mol_type = genomic DNA

SEQ ID NO: 108932 - DNA, 35 bp, Homo sapiens; identical to SEQ ID NO: 76046
  misc_feature 1..35: note = chr13:52928634-52928669
  misc_feature 1..35: note = Hypo
  source 1..35: mol_type = genomic DNA

SEQ ID NO: 108933 - DNA, 706 bp, Homo sapiens; identical to SEQ ID NO: 76047
  misc_feature 1..706: note = chr13:52979745-52980451
  misc_feature 1..706: note = Hyper
  source 1..706: mol_type = genomic DNA

SEQ ID NO: 108934 - DNA, 36 bp, Homo sapiens; identical to SEQ ID NO: 43806
  misc_feature 1..36: note = chr13:53025686-53025722
  misc_feature 1..36: note = Hypo
  source 1..36: mol_type = genomic DNA

SEQ ID NO: 108935 - DNA, 32 bp, Homo sapiens; identical to SEQ ID NO: 76049
  misc_feature 1..32: note = chr13:53055615-53055647
  misc_feature 1..32: note = Hypo
  source 1..32: mol_type = genomic DNA

SEQ ID NO: 108936 - DNA, 658 bp, Homo sapiens
  misc_feature 1..658: note = chr13:53174056-53174714
  misc_feature 1..658: note = Hyper
  source 1..658: mol_type = genomic DNA
ctagtccccagagcccgggctttagggcgcccggatgcaaaccagttttgccgccaaggaacccggacaggcgcgcctcctccccggcctcgcaaggaacaggttaaggagacatttcccactttctctgcccggccctgaacgctcgccgcccctgcccagccgcccactgtctggcagcctgcaagtctccattcagaagcggctccgtgctgcccagcgatggcgccctggcggcgcggaagcccgcggccaaatgacacgacttgggggcaaaggaggacaacagttcccaccaggtaggcactgggggaaggaggccgatgaccctgagattctccagcgaccccggcgggccatccctgggcggcgcgcgggtcccgcggcacgtgcgtggcagctctcgccgcttccctggacgcccgggaaggtcacgccgcctgggcgccgaggcccgccccgcgcccctctccctccgcccggggcgctccgcagctgccgaggagcggaagtgggcgccaggccgcggcgcgcccagcccagcccagcccagcccagtcggcgaccccgcgcagcgctgcctgcagaccctggagaaggcggaggcctgcgtctccgggtgctttcctacctctgggctccccgagaccctttctga

SEQ ID NO: 108937 - DNA, 1126 bp, Homo sapiens
  misc_feature 1..1126: note = chr13:53312856-53313982
  misc_feature 1..1126: note = Hyper
  source 1..1126: mol_type = genomic DNA
gacgtgccttccccacggtcgcgccactgcttagtgggagatgagccgagaacggcctttctcggaccgtccactacattctcccctactctacgcttcaatcttctcccgtgaaaccttcacttgcttttctacaacgttgacctaaggcggaaagccgcgtgccagagtgggatgggagaggggagctcacgctgggcccgaggggcccgccggcagccgcgcgcccctcgccggcccgcgctcgggctccccctaggggcaccatgggcgacacgggggtccccgcgcgccgccctctggacttacgtgactgtcgctccccttccagaagtagaaggccccgatggccccaaagagcagcagcacagctcccgaaatgaggaccacggctcccaccttgagcagccgcgcggggctggagggcttcaccgtcagcgtagcgtacgcctgcgggccggggcgggagagggaccgtcgcgtttgtgccgccagcacctgcggcccccagcgcacccgggccccacgcggtagcccccagggagtggggagtcgggcgggaaacagctcgcccgggctcctacgggtgcccctttcgccgcgctccctcccgagggtcctttgcagtcgggcgtggaagtgggatgagcaaaccccgcagcacagggccttcgccccaggacctgcaccctctaccggccacgggacgtccctccgcacccgcctgtggatgccgtgacccctgcacactcatacgcgtggggcgacatcccacccacacatttgggacccaaatttatccccccgccaacacacccattcggtggcacgcacccctgagtccgaactgtggaacctgatactcacacaacccaggccctgcgtgtggaatccctggcggtactcaccggggggctgcagaattccacgtcatcaggtcccaccagggcaatgggaactttgtcggagttctctgtcatgtttgcggcgggaggagtgaggcacttggagactccctgggcaccctgggatctgtcccgctgccccgacgtgcagggcatttcaacgccgcgcgcacacacggtgcacggtcccgcctgggccagcccagcggtccccacccctt

SEQ ID NO: 108938 - DNA, 30 bp, Homo sapiens; identical to SEQ ID NO: 76056
  misc_feature 1..30: note = chr13:53353373-53353403
  misc_feature 1..30: note = Hypo
  source 1..30: mol_type = genomic DNA

SEQ ID NO: 108939 - DNA, 1063 bp, Homo sapiens
  misc_feature 1..1063: note = chr13:53419713-53420776
  misc_feature 1..1063: note = Hyper
  source 1..1063: mol_type = genomic DNA
caccgccacagggggcgccggctcctttccaaaacccggggaggcaccgtagggctgcagcagggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagcccggcacttcggccgcggcgaccgcaggcggaggcgcgtccgccgcggggctgccaaagggcgctttgccggtgccagggaaggtgagcacgtcgaacatgttgggcctgggcccggctccccgggcggcctcctccggggagccgggagccgaggctccgccgcccgccgccccgggccgctcttcccggagggccccccctttgcgcacctccttcttgcggcggttgcaggtggtggcgatggcgatgatggcggccagcagcagcgtgcagctcccggccagcacgatgatgacgatcagcggcgtgtcccattgcagcaccgacccggacaccccgagccgagagccaggcgggcgggaacgctccgggcttcctgcactggcaggcgcagccggcccacgcccgccccctgctgttaccacgaagctgacagttgcggtggtggtgagcgggggacggccgccgtcggatatgaccaggagcgccctgaacacgcgaccgggtggctcctgcgagaggtcgccggtgagcagtatctcccccgtgcggcggccgatggcgaaggcttcgcgcggctcctgctgctgcagctcgaacgccagctccccgttggctccctcgtctgcatcccgggcctgcacacgggccacaaccgtgtcctttgcggtgcgcccaggcaccgccacttctagggagccattggctggcgccgggtgcaccaggactggcgcatggtcgttctggtccagca

SEQ ID NO: 108940 - DNA, 55 bp, Homo sapiens
  misc_feature 1..55: note = chr13:53421016-53421071
  misc_feature 1..55: note = Hyper
  source 1..55: mol_type = genomic DNA
ccgtggccaggtaggcgcctggcgggttgttctcgcgcaccgacacctcatagac

SEQ ID NO: 108941 - DNA, 480 bp, Homo sapiens
  misc_feature 1..480: note = chr13:53421377-53421857
  misc_feature 1..480: note = Hyper
  source 1..480: mol_type = genomic DNA
agtggcaccagcctccggcgtcccggctcccgccggcgagctagcgtccgctcccccgagtgcagcggcggcggcggcagcggcgaagggtgaggttgccggcgcgcctggggcggccagcggggtgatggcgatgtcgggtgcgttgtcattgacgtctcggatgcgcacgatgaccttgcaggtggcagcgcggggcccgggtccgcggtcctgcgcccgcacgtccagctcgtaggtgtcctgacgctcgtagtccacgggcccggccagggtgaggcggcctgatcgcgggtcaagccgaaagaggcggcgcgcctccggcggggtgcgggcgccaaatgcgaacaccacgtcgccgttaggtccctcgtcggggtcggctgcgtccaggtcgagaagcagggagcccacgggcgcgtcttccgccagctccacttcggccacggcgccctgcgggaaggccgggctgtggtcatt

SEQ ID NO: 108942 - DNA, 158 bp, Homo sapiens
  misc_feature 1..158: note = chr13:53422237-53422395
  misc_feature 1..158: note = Hyper
  source 1..158: mol_type = genomic DNA
agaagctgaccacatcgaaggccagcacgcactgcggggcctggccacacagccgctcgcggtccaggccggcgtccccgacggtcagctgcccgtcgccttcgcgcacccggagcagagagctgttgaattgcttcatcaggcggaagcttgtgtca

SEQ ID NO: 108943 - DNA, 251 bp, Homo sapiens
  misc_feature 1..251: note = chr13:53422634-53422885
  misc_feature 1..251: note = Hyper
  source 1..251: mol_type = genomic DNA
tcagtctcaggctctcggaatcacgctctttgcgagccctgtgcgggagaagtctgcgggtagcagctccgagcctccagcgggctctgaggacgcgcggacccgccctcactctgcgcctctccgtctcttacagaagctgcgccgcctcgcgccgcctttgcctttatagccgccgatatgctaatcacccgagccgggtagccaatggccgcctccccctcgcgtcgcccctccgcctgcctctgaca

SEQ ID NO: 108944 - DNA, 82 bp, Homo sapiens; identical to SEQ ID NO: 76064
  misc_feature 1..82: note = chr13:53423116-53423198
  misc_feature 1..82: note = Hyper
  source 1..82: mol_type = genomic DNA

SEQ ID NO: 108945 - DNA, 360 bp, Homo sapiens; identical to SEQ ID NO: 76065
  misc_feature 1..360: note = chr13:53423765-53424125
  misc_feature 1..360: note = Hyper
  source 1..360: mol_type = genomic DNA

SEQ ID NO: 108946 - DNA, 1249 bp, Homo sapiens; identical to SEQ ID NO: 76066
  misc_feature 1..1249: note = chr13:53424759-53426008
  misc_feature 1..1249: note = Hyper
  source 1..1249: mol_type = genomic DNA

SEQ ID NO: 108947 - DNA, 18 bp, Homo sapiens
  misc_feature 1..18: note = chr13:53427247-53427265
  misc_feature 1..18: note = Hypo
  source 1..18: mol_type = genomic DNA
gcccggcctgtctgtatc

SEQ ID NO: 108948 - DNA, 76 bp, Homo sapiens; identical to SEQ ID NO: 76068
  misc_feature 1..76: note = chr13:53580906-53580982
  misc_feature 1..76: note = Hypo
  source 1..76: mol_type = genomic DNA

SEQ ID NO: 108949 - DNA, 168 bp, Homo sapiens
  misc_feature 1..168: note = chr13:53775270-53775438
  misc_feature 1..168: note = Hyper
  source 1..168: mol_type = genomic DNA
cctcgggggagcggacgctagctagtcggcgggagccaggacgcccgaggctggcgccgccacgctggtgccggagtgggcggcgcgcgagagtctggtggctctggtcagcacttcggacagggactcgggcgccaaccggcagatgcgctgcgccctctactggca

SEQ ID NO: 108950 - DNA, 30 bp, Homo sapiens; identical to SEQ ID NO: 43808
  misc_feature 1..30: note = chr13:56180149-56180179
  misc_feature 1..30: note = Hypo
  source 1..30: mol_type = genomic DNA

SEQ ID NO: 108951 - DNA, 39 bp, Homo sapiens; identical to SEQ ID NO: 76071
  misc_feature 1..39: note = chr13:57484515-57484554
  misc_feature 1..39: note = Hypo
  source 1..39: mol_type = genomic DNA

SEQ ID NO: 108952 - DNA, 30 bp, Homo sapiens; identical to SEQ ID NO: 76072
  misc_feature 1..30: note = chr13:57861015-57861045
  misc_feature 1..30: note = Hypo
  source 1..30: mol_type = genomic DNA

SEQ ID NO: 108953 - DNA, 881 bp, Homo sapiens; identical to SEQ ID NO: 76073
  misc_feature 1..881: note = chr13:58203571-58204452
  misc_feature 1..881: note = Hyper
  source 1..881: mol_type = genomic DNA

SEQ ID NO: 108954 - DNA, 78 bp, Homo sapiens
  misc_feature 1..78: note = chr13:58204937-58205015
  misc_feature 1..78: note = Hyper
  source 1..78: mol_type = genomic DNA
gggaggaccatgaggcgagagtgaatacgattcgttccgctgcttctgactcatccggcagatcggaacacctgcatt

SEQ ID NO: 108955 - DNA, 1217 bp, Homo sapiens
  misc_feature 1..1217: note = chr13:58205795-58207012
  misc_feature 1..1217: note = Hyper
  source 1..1217: mol_type = genomic DNA
ggggagagccttttccgaggaagagagggaggagcctggtggggagaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaa

SEQ ID NO: 108956 - DNA, 1731 bp, Homo sapiens
  misc_feature 1..1731: note = chr13:58207315-58209046
  misc_feature 1..1731: note = Hyper
  source 1..1731: mol_type = genomic DNA
gctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagccc

SEQ ID NO: 108957 - DNA, 30 bp, Homo sapiens; identical to SEQ ID NO: 76081
  misc_feature 1..30: note = chr13:59118670-59118700
  misc_feature 1..30: note = Hypo
  source 1..30: mol_type = genomic DNA

SEQ ID NO: 108958 - DNA, 30 bp, Homo sapiens; identical to SEQ ID NO: 43809
  misc_feature 1..30: note = chr13:60614880-60614910
  misc_feature 1..30: note = Hypo
  source 1..30: mol_type = genomic DNA

SEQ ID NO: 108959 - DNA, 23 bp, Homo sapiens
  misc_feature 1..23: note = chr13:60710775-60710798
  misc_feature 1..23: note = Hypo
  source 1..23: mol_type = genomic DNA
tataaacaattctgccgggcgcg

SEQ ID NO: 108960 - DNA, 21 bp, Homo sapiens
  misc_feature 1..21: note = chr13:60860933-60860954
  misc_feature 1..21: note = Hypo
  source 1..21: mol_type = genomic DNA
tatgcaaatgccagccgttgg

SEQ ID NO: 108961 - DNA, 38 bp, Homo sapiens; identical to SEQ ID NO: 76085
  misc_feature 1..38: note = chr13:61791028-61791066
  misc_feature 1..38: note = Hypo
  source 1..38: mol_type = genomic DNA

SEQ ID NO: 108962 - DNA, 30 bp, Homo sapiens; identical to SEQ ID NO: 76086
  misc_feature 1..30: note = chr13:61988304-61988334
  misc_feature 1..30: note = Hyper
  source 1..30: mol_type = genomic DNA

SEQ ID NO: 108963 - DNA, 127 bp, Homo sapiens
  misc_feature 1..127: note = chr13:61989202-61989329
  misc_feature 1..127: note = Hyper
  source 1..127: mol_type = genomic DNA
cgccccatatccaggcgcgggtgccaggtcgccgggcaccagctcactcccagggcctgtgagctgcgcgcattccctcggccgcgcattccctgggaggctgcagtcagagcgctcttgaagggag

SEQ ID NO: 108964 - DNA, 30 bp, Homo sapiens; identical to SEQ ID NO: 76088
  misc_feature 1..30: note = chr13:61989554-61989584
  misc_feature 1..30: note = Hyper
  source 1..30: mol_type = genomic DNA

SEQ ID NO: 108965 - DNA, 94 bp, Homo sapiens; identical to SEQ ID NO: 76089
  misc_feature 1..94: note = chr13:64311539-64311633
  misc_feature 1..94: note = Hypo
  source 1..94: mol_type = genomic DNA

SEQ ID NO: 108966 - DNA, 30 bp, Homo sapiens; identical to SEQ ID NO: 76090
  misc_feature 1..30: note = chr13:65360861-65360891
  misc_feature 1..30: note = Hypo
  source 1..30: mol_type = genomic DNA

SEQ ID NO: 108967 - DNA, 30 bp, Homo sapiens; identical to SEQ ID NO: 76091
  misc_feature 1..30: note = chr13:65499779-65499809
  misc_feature 1..30: note = Hypo
  source 1..30: mol_type = genomic DNA

SEQ ID NO: 108968 - DNA, 48 bp, Homo sapiens; identical to SEQ ID NO: 76092
  misc_feature 1..48: note = chr13:65904937-65904985
  misc_feature 1..48: note = Hypo
  source 1..48: mol_type = genomic DNA

SEQ ID NO: 108969 - DNA, 20 bp, Homo sapiens
  misc_feature 1..20: note = chr13:65937832-65937852
  misc_feature 1..20: note = Hypo
  source 1..20: mol_type = genomic DNA
gttgctttatttgtccggtg

SEQ ID NO: 108970 - DNA, 1210 bp, Homo sapiens
  misc_feature 1..1210: note = chr13:67804228-67805438
  misc_feature 1..1210: note = Hyper
  source 1..1210: mol_type = genomic DNA
cataccatttccatccgatgccaatactgcttaagtctctaacttcttgtaggaaacgtcagagttgcggtgatgatgattctctgacagctatccgggtgacagttgcccgaaaaattcctaatcggttatctcttgcgtgcttcagagactctgaggcgctcctttccgtctcgcgtgctctccctctctcccttcccctctgcccctctctccttctccctctcctctctctgaactgaatttcttgatataactctcaataagcccagagggagggcgtgactgcccaggccccgcccccgggctctgattggcctgcatcttgcggcgcgggcggccgcagcccggcgcgagggagggagcgcggaacaaggcgctgactgtctcccagcctcccctcctccgcgccccctcggcagcagcgaaaacccggaaatctgatcctggccccaggagagccgggttccatgaggtgcactgagcatgctctgcagggtccggcgtgggagggacgcgctggcgctccccaggcccgggcggaagcggcgctcgcaggcgctgaaagcgagcgaccctctgagcccgggtggtccggcgggcaagggcggcgcgggagacccgcagggcgcgggcgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagaccggaaagaaaattaatcggagcacttcctacatgcagagccacggaaactgccttggaaagagaaagtggcagcgtctgggtcccctcggtcagcccgggccagtcggctgcgcgtgcgaagtctcctctagcggagcgggaccggccgcggcggtggatcgtggcggtccctgcacttctgctccagccgcgcctggaaacctgagcccggactcgcggctgctgcaaaacccgcttccagcccacc

SEQ ID NO: 108971 - DNA, 51 bp, Homo sapiens; identical to SEQ ID NO: 43812
  misc_feature 1..51: note = chr13:68343951-68344002
  misc_feature 1..51: note = Hypo
  source 1..51: mol_type = genomic DNA

SEQ ID NO: 108972 - DNA, 73 bp, Homo sapiens; identical to SEQ ID NO: 76100
  misc_feature 1..73: note = chr13:68488541-68488614
  misc_feature 1..73: note = Hypo
  source 1..73: mol_type = genomic DNA

SEQ ID NO: 108973 - DNA, 83 bp, Homo sapiens; identical to SEQ ID NO: 76101
  misc_feature 1..83: note = chr13:69619398-69619481
  misc_feature 1..83: note = Hypo
  source 1..83: mol_type = genomic DNA

SEQ ID NO: 108974 - DNA, 728 bp, Homo sapiens
  misc_feature 1..728: note = chr13:70681570-70682298
  misc_feature 1..728: note = Hyper
  source 1..728: mol_type = genomic DNA
agaggaggaagaggacggggaggacgatgaagaggaagaggaggaaggcttcttccagaaagtgctcacaccgcttctctcttggcttttgagcaggcgactctggctgggtccccagtgctcaaagctgccactgccgtcctgttgcaggcagcctccccccgccgggccgccggtggaaggagacgggtggctgaagagtttccagcggagtcgcagaatgtgcttcacatcgaagtcttttcgcccagagcctgacatgctttacgcacagaaggcaaaaggctggcagctcacgcaggagtaggctggtcagcaggtgggggaggacagcggggcccgggggcggaggaagaggcgggatgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttatggcgaggtgggacaacccttaggctggagatgcgcgagggagggaggtctgagcgctccgaagctccggaggcggctgcagctggatacacctcactgggatgcgcttgtggcagagccttagtagggaaggtggtggcgttcttgtccttgc

SEQ ID NO: 108975 - DNA, 30 bp, Homo sapiens; identical to SEQ ID NO: 76104
  misc_feature 1..30: note = chr13:71068811-71068841
  misc_feature 1..30: note = Hypo
  source 1..30: mol_type = genomic DNA

SEQ ID NO: 108976 - DNA, 30 bp, Homo sapiens; identical to SEQ ID NO: 76105
  misc_feature 1..30: note = chr13:71158391-71158421
  misc_feature 1..30: note = Hypo
  source 1..30: mol_type = genomic DNA

SEQ ID NO: 108977 - DNA, 30 bp, Homo sapiens; identical to SEQ ID NO: 76106
  misc_feature 1..30: note = chr13:72408836-72408866
  misc_feature 1..30: note = Hypo
  source 1..30: mol_type = genomic DNA

SEQ ID NO: 108978 - DNA, 93 bp, Homo sapiens; identical to SEQ ID NO: 76107
  misc_feature 1..93: note = chr13:72438470-72438563
  misc_feature 1..93: note = Hyper
  source 1..93: mol_type = genomic DNA

SEQ ID NO: 108979 - DNA, 259 bp, Homo sapiens; identical to SEQ ID NO: 76108
  misc_feature 1..259: note = chr13:72438769-72439028
  misc_feature 1..259: note = Hyper
  source 1..259: mol_type = genomic DNA

SEQ ID NO: 108980 - DNA, 30 bp, Homo sapiens; identical to SEQ ID NO: 76109
  misc_feature 1..30: note = chr13:72439538-72439568
  misc_feature 1..30: note = Hyper
  source 1..30: mol_type = genomic DNA

SEQ ID NO: 108981 - DNA, 113 bp, Homo sapiens; identical to SEQ ID NO: 76110
  misc_feature 1..113: note = chr13:72439959-72440072
  misc_feature 1..113: note = Hyper
  source 1..113: mol_type = genomic DNA

SEQ ID NO: 108982 - DNA, 37 bp, Homo sapiens; identical to SEQ ID NO: 76111
  misc_feature 1..37: note = chr13:72440704-72440741
  misc_feature 1..37: note = Hyper
  source 1..37: mol_type = genomic DNA

SEQ ID NO: 108983 - DNA, 191 bp, Homo sapiens; identical to SEQ ID NO: 76112
  misc_feature 1..191: note = chr13:72441499-72441690
  misc_feature 1..191: note = Hyper
  source 1..191: mol_type = genomic DNA

SEQ ID NO: 108984 - DNA, 29 bp, Homo sapiens
  misc_feature 1..29: note = chr13:72469378-72469407
  misc_feature 1..29: note = Hypo
  source 1..29: mol_type = genomic DNA
acataatacatttcacgcattttttaaaa

SEQ ID NO: 108985 - DNA, 21 bp, Homo sapiens
  misc_feature 1..21: note = chr13:73253695-73253716
  misc_feature 1..21: note = Hypo
  source 1..21: mol_type = genomic DNA
aggcgcagtggctcacgcctg

SEQ ID NO: 108986 - DNA, 30 bp, Homo sapiens; identical to SEQ ID NO: 76115
  misc_feature 1..30: note = chr13:73545132-73545162
  misc_feature 1..30: note = Hypo
  source 1..30: mol_type = genomic DNA

SEQ ID NO: 108987 - DNA, 30 bp, Homo sapiens; identical to SEQ ID NO: 76116
  misc_feature 1..30: note = chr13:73619593-73619623
  misc_feature 1..30: note = Hypo
  source 1..30: mol_type = genomic DNA

SEQ ID NO: 108988 - DNA, 30 bp, Homo sapiens; identical to SEQ ID NO: 76117
  misc_feature 1..30: note = chr13:73636816-73636846
  misc_feature 1..30: note = Hypo
  source 1..30: mol_type = genomic DNA

SEQ ID NO: 108989 - DNA, 30 bp, Homo sapiens; identical to SEQ ID NO: 76118
  misc_feature 1..30: note = chr13:73653014-73653044
  misc_feature 1..30: note = Hypo
  source 1..30: mol_type = genomic DNA

SEQ ID NO: 108990 - DNA, 207 bp, Homo sapiens; identical to SEQ ID NO: 76119
  misc_feature 1..207: note = chr13:73664304-73664511
  misc_feature 1..207: note = Hypo
  source 1..207: mol_type = genomic DNA

SEQ ID NO: 108991 - DNA, 153 bp, Homo sapiens; identical to SEQ ID NO: 76120
  misc_feature 1..153: note = chr13:74707261-74707414
  misc_feature 1..153: note = Hyper
  source 1..153: mol_type = genomic DNA

SEQ ID NO: 108992 - DNA, 43 bp, Homo sapiens; identical to SEQ ID NO: 34971
  misc_feature 1..43: note = chr13:74707625-74707668
  misc_feature 1..43: note = Hyper
  source 1..43: mol_type = genomic DNA

SEQ ID NO: 108993 - DNA, 30 bp, Homo sapiens; identical to SEQ ID NO: 43813
  misc_feature 1..30: note = chr13:74987640-74987670
  misc_feature 1..30: note = Hypo
  source 1..30: mol_type = genomic DNA

SEQ ID NO: 108994 - DNA, 211 bp, Homo sapiens; identical to SEQ ID NO: 76123
  misc_feature 1..211: note = chr13:75149904-75150115
  misc_feature 1..211: note = Hyper
  source 1..211: mol_type = genomic DNA

SEQ ID NO: 108995 - DNA, 261 bp, Homo sapiens; identical to SEQ ID NO: 76124
  misc_feature 1..261: note = chr13:77459367-77459628
  misc_feature 1..261: note = Hyper
  source 1..261: mol_type = genomic DNA

SEQ ID NO: 108996 - DNA, 105 bp, Homo sapiens; identical to SEQ ID NO: 76125
  misc_feature 1..105: note = chr13:77553641-77553746
  misc_feature 1..105: note = Hypo
  source 1..105: mol_type = genomic DNA

SEQ ID NO: 108997 - DNA, 120 bp, Homo sapiens; identical to SEQ ID NO: 76126
  misc_feature 1..120: note = chr13:77935896-77936016
  misc_feature 1..120: note = Hypo
  source 1..120: mol_type = genomic DNA

SEQ ID NO: 108998 - DNA, 23 bp, Homo sapiens
  misc_feature 1..23: note = chr13:78081911-78081934
  misc_feature 1..23: note = Hypo
  source 1..23: mol_type = genomic DNA
attacaggcgtaactcatagtaa

SEQ ID NO: 108999 - DNA, 161 bp, Homo sapiens; identical to SEQ ID NO: 76128
  misc_feature 1..161: note = chr13:78271464-78271625
  misc_feature 1..161: note = Hyper
  source 1..161: mol_type = genomic DNA

SEQ ID NO: 109000 - DNA, 338 bp, Homo sapiens; identical to SEQ ID NO: 76129
  misc_feature 1..338: note = chr13:78271894-78272232
  misc_feature 1..338: note = Hyper
  source 1..338: mol_type = genomic DNA

SEQ ID NO: 109001 - DNA, 44 bp, Homo sapiens; identical to SEQ ID NO: 76130
  misc_feature 1..44: note = chr13:78273206-78273250
  misc_feature 1..44: note = Hyper
  source 1..44: mol_type = genomic DNA

SEQ ID NO: 109002 - DNA, 30 bp, Homo sapiens; identical to SEQ ID NO: 76131
  misc_feature 1..30: note = chr13:78335732-78335762
  misc_feature 1..30: note = Hypo
  source 1..30: mol_type = genomic DNA

SEQ ID NO: 109003 - DNA, 1223 bp, Homo sapiens; identical to SEQ ID NO: 76132
  misc_feature 1..1223: note = chr13:78492801-78494024
  misc_feature 1..1223: note = Hyper
  source 1..1223: mol_type = genomic DNA

SEQ ID NO: 109004 - DNA, 16 bp, Homo sapiens
  misc_feature 1..16: note = chr13:78567988-78568004
  misc_feature 1..16: note = Hypo
  source 1..16: mol_type = genomic DNA
gcgcctggcatgtagt

SEQ ID NO: 109005 - DNA, 149 bp, Homo sapiens; identical to SEQ ID NO: 76134
  misc_feature 1..149: note = chr13:79160947-79161096
  misc_feature 1..149: note = Hyper
  source 1..149: mol_type = genomic DNA

SEQ ID NO: 109006 - DNA, 1571 bp, Homo sapiens
  misc_feature 1..1571: note = chr13:79169673-79171244
  misc_feature 1..1571: note = Hyper
  source 1..1571: mol_type = genomic DNA
ggactgggacacgggcgcttcttctctccagcccttggttcgccggagcaggatgctggtctcaacactagggctatgtcggcttctcaccgaaccgagattttcaatttcagctttgcgattcaggattccacttgaattccccaggacgaaagcctagcggccaggctgcatttcgccccgggtataaatccctgccggataaattcaaatctgtagcagggttttggtaatatgcatcttagcaacaaaacaaaaaccaacctcgtatgccttccagttctttttaaaacgtgtacggcagttgtgaaagttttgtggtgcttgagactgttgacttatgcaactggggagagggtttttttaaccgctttgagatattggtccatcccttttctctcagaacgtcctcaagggcacgtaagagttggaggtgacctccgggagcgcctaattttgagccgcggaacttcggcccacttctccgaggggaccaggcgcgcgccaatacgcatgtgcgggctctgagcgctcagagcgcgcctcttccttcccggctccccgcggtgcgcacccgctggccactctgcgcacgcgcgccgggtgccccggcctaaggccgttgacctcgggttctccccggcacagtcgaatccacgccagggccctcaggccggtagctgtcctgcagtccgagcggagctgcgacctcgggcagctggaagcctgtgggctgctgcttctccaggcaggcggcggagggatgcaggcaggatgagcggcggtcccttcgccgccacccggagaaccgcggctggtgcccttgaaggccctgggatgcctgggttgggtgggtgagtgaacgagaaccctgagtgagtgaggggagggcgggtcccctcctggcttcaaattcaacccaatcagctctgccgatggtttgaaactgcacacgccgacccacccgccccgaagtctgaaagttatgccctggagacctgcgagctgcggagtgcagctggagagggagctgccccacgaggaggcctccagaataactcccggagtcggaacagcgctgggctgctgaagtttgcagcctccggatccgcgccccgccctgcagatccaccggatttcggggagggaatcggggggctgcccgtcctcccgtaaagctgacttgacaacaattacgaaagtttttaattagctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaagtggaaaagaggacctcgcgagaattagaattcggctgctattttaaaaaatcaattaagcttgcggtcttttttgaaacagctcgaaaggactgcgtggctatcatcgtggcgctaagactgagat

SEQ ID NO: 109007 - DNA, 220 bp, Homo sapiens; identical to SEQ ID NO: 76139
  misc_feature 1..220: note = chr13:79171448-79171668
  misc_feature 1..220: note = Hyper
  source 1..220: mol_type = genomic DNA

SEQ ID NO: 109008 - DNA, 2668 bp, Homo sapiens
  misc_feature 1..2668: note = chr13:79175595-79178263
  misc_feature 1..2668: note = Hyper
  source 1..2668: mol_type = genomic DNA
ttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcaggcttgttcattttctcgcgctgggcgccctcggcctcctcgagccacgcctgcaggatgggcttgagcgcgatcatgttgttgtgcgagagcgtgagcgactcgaacctgcagatggtgctctggctgagtgagcccacgcccgggatcttgaggttggccagcgccgagcccacgtcggcctgcgtcacgcccagcttgatgcgccgctgcttgaagcgctccgcgaacgcctcgagctcgcgcgggtccgtgtccgagtcgcagatggacgccaggcccgctgcgcccaccacggccgccgccgccgatgccgctgccacctgcccggccgccgccgccgccgctgccgctgccgcgccgtggtgcgccgccgccgccaccagcccggggtgcggcagcccggacggcatgttcatggcggccgccgccgcggggtgcgacaggtggcccaggctgtgcatatgcgggtgagggtgcgcggagccgcccaggagcccgccgcccgggccgccgccgccgccccccgggccgccaccgccgcctcccccggggccgccgcccgggccgccgccgccgcccgggccgccaccgccccccgggccgtcgtgggcgccgccgccgccggccgccgcgcccgcgccgcccgcgccggccatgagcgcgagcgacggcgaggagatgtggtccagcagatcgccgggttcgagcgcctggtggtggtggtggtggtggtggtggtgcgccagaggcaccgtggaagtggacgtgcacggcacgctgttcatcgtgtggtacgtggcgtccggcttgaaaggatggctcttgccctgggacacggcgatgtccacggccgccagcgcctcggcccgcgccagcagcgtctcgtccaggctggcgaagaggttgctctgcagctgcaggcgacacaaaccaaaccaaaaaaaccacaaaaccaaaagagcaaaacaaaacaacagaagaaacacacacacaggccggaaagcacagcatgcgaagggcaaacacaaagcaaccaaaataacaacgggtttgggggcagtggagagcgggaaagacggagagggggcacattgacgaccagggagggggcagacgagaagggatgggagcgtggagagggggacagaagtagggagaaagggggacacaagaacacattccggaaacgggcgtgggagacgaaaaagagggaaaagaagaaatggaaatgtaactcgcagctggggacccgtgtcacacacccgagcacgcacagagactgcctttctgaggcgtgaaattaacagagaaagtagagggaagtcgagagtcctggccccagcgctccctactccgatcgcaggcgcctgacgcggaggcagaggcagacaggaacacgacattaagggccgccggacaaaacgtgcctcgctgcgggactgctctacaccccctgcccgcagttccccgcaccgggacctgcacacaccagcccccgacatgcagcgtttcggagacggggaggggcgggcgcgcgggccggggccgcgggcgtggggcgcttaccggcggcgtgggcaggcaggcccgccggatggcctcggagctggagtgcagcgacgggtacttgtgctcagggagggtgggatgcatggcaaagtgaggctgcttgctgttcatggacatcatcgtggcggcttggcatgtatatccacaaacactccgaaagtccgcgggaaagtgcgtacgccggctcacccggcctcccttcggaggctgcagccgcggcggtcgcggcggctggcggcggccccgccgcgggctgctgctgctgctcctgctgctgccaggcgctccctctgaccgcgcagagcgccgcgcgccggcctcgcggtcccgcttctccgacagctctagccccgcgcgccgacgggatgcactcctctaacacctgagccccacttctcgcggccgtcccggggagctctcgcgagagctcgcggccccaccgcgctgacaggcatcagctgtctccgtctgtctgacgcgcgctctccttctcggcggccccgtgcgtctgcgcgcgcgcgcgctcgtccggccgcgaccagcgcgtgggagccgctcttatagtgaccaccagcaaggacagcgcaggtgatgcacctgtagctacccgggcatgcgcactgcccgcctcacctttcccaccgtggtctggaaagatcagaaggtccagctattgtctaagggtgggcaccttttagaataaaaaagacgagatgcgcgcacgcccctctatgtgtgtgtgtgtgtgtgtgtgtgcgtgcgtgtgtgtgtatgtgtgtatgtttcttctccctgatagcaagccttgaatatatgagcattacttaggcattcctcctcttcgggatgcctaacaagctgttgtataatgtatacagctggacatttctacgttaaattatgcccgcgcattcctctgtat

SEQ ID NO: 109009 - DNA, 216 bp, Homo sapiens; identical to SEQ ID NO: 76146
  misc_feature 1..216: note = chr13:79179534-79179750
  misc_feature 1..216: note = Hyper
  source 1..216: mol_type = genomic DNA

SEQ ID NO: 109010 - DNA, 974 bp, Homo sapiens
  misc_feature 1..974: note = chr13:79182684-79183658
  misc_feature 1..974: note = Hyper
  source 1..974: mol_type = genomic DNA
caggaggagcagagacgtccccgccccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggaggtagtcaatgggcagcaggggacccccagcccccacaagcgcggctccgaggacctggaagcgggtgcctgtcgctctccgcaggctccgctctgcctccaggagcaagatccccaaaagggtctggaagctgtggagaaaaccgcaaggacgcgagtccaaacccgagagtgcggagctgggtcctgtcacccggctccaacgctcgccggcgccgccgccagccgcccctccttcccgccgcccgcacaaatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaaactctttgttggtttcgcgtcttaatcgccaggtttcacgagtaataataaaatgaaaggaaaccgcagggcgggccgttcgggtggagcttgggcgggaccagcccggagcgcccccgagaaagtgggaaaatcgggctggaagggctagggcgcgtctgtcttcccgagactggggagtgggggtccggtgggggctagaggggaagggaagagcgggcaccggcggcgggaatccgagaaggccgagtt

SEQ ID NO: 109011 - DNA, 150 bp, Homo sapiens; identical to SEQ ID NO: 76148
  misc_feature 1..150: note = chr13:80015563-80015713
  misc_feature 1..150: note = Hypo
  source 1..150: mol_type = genomic DNA

SEQ ID NO: 109012 - DNA, 65 bp, Homo sapiens; identical to SEQ ID NO: 76149
  misc_feature 1..65: note = chr13:80914079-80914144
  misc_feature 1..65: note = Hyper
  source 1..65: mol_type = genomic DNA

SEQ ID NO: 109013 - DNA, 32 bp, Homo sapiens; identical to SEQ ID NO: 76150
  misc_feature 1..32: note = chr13:80914581-80914613
  misc_feature 1..32: note = Hyper
  source 1..32: mol_type = genomic DNA

SEQ ID NO: 109014 - DNA, 41 bp, Homo sapiens; identical to SEQ ID NO: 76151
  misc_feature 1..41: note = chr13:80915541-80915582
  misc_feature 1..41: note = Hyper
  source 1..41: mol_type = genomic DNA

SEQ ID NO: 109015 - DNA, 30 bp, Homo sapiens; identical to SEQ ID NO: 76152
  misc_feature 1..30: note = chr13:81279635-81279665
  misc_feature 1..30: note = Hypo
  source 1..30: mol_type = genomic DNA

SEQ ID NO: 109016 - DNA, 19 bp, Homo sapiens
  misc_feature 1..19: note = chr13:82399492-82399511
  misc_feature 1..19: note = Hypo
  source 1..19: mol_type = genomic DNA
actccgtctaaaaaaaaag

SEQ ID NO: 109017 - DNA, 30 bp, Homo sapiens; identical to SEQ ID NO: 76154
  misc_feature 1..30: note = chr13:82646591-82646621
  misc_feature 1..30: note = Hypo
  source 1..30: mol_type = genomic DNA

SEQ ID NO: 109018 - DNA, 30 bp, Homo sapiens; identical to SEQ ID NO: 76155
  misc_feature 1..30: note = chr13:82797186-82797216
  misc_feature 1..30: note = Hypo
  source 1..30: mol_type = genomic DNA

SEQ ID NO: 109019 - DNA, 17 bp, Homo sapiens
  misc_feature 1..17: note = chr13:84382511-84382528
  misc_feature 1..17: note = Hypo
  source 1..17: mol_type = genomic DNA
gggtgcggtggcttacg

SEQ ID NO: 109020 - DNA, 196 bp, Homo sapiens; identical to SEQ ID NO: 34986
  misc_feature 1..196: note = chr13:84455560-84455756
  misc_feature 1..196: note = Hyper
  source 1..196: mol_type = genomic DNA

SEQ ID NO: 109021 - DNA, 369 bp, Homo sapiens; identical to SEQ ID NO: 76158
  misc_feature 1..369: note = chr13:84456111-84456480
  misc_feature 1..369: note = Hyper
  source 1..369: mol_type = genomic DNA

SEQ ID NO: 109022 - DNA, 77 bp, Homo sapiens; identical to SEQ ID NO: 76159
  misc_feature 1..77: note = chr13:84456706-84456783
  misc_feature 1..77: note = Hyper
  source 1..77: mol_type = genomic DNA

SEQ ID NO: 109023 - DNA, 30 bp, Homo sapiens; identical to SEQ ID NO: 76160
  misc_feature 1..30: note = chr13:85406594-85406624
  misc_feature 1..30: note = Hypo
  source 1..30: mol_type = genomic DNA

SEQ ID NO: 109024 - DNA, 24 bp, Homo sapiens
  misc_feature 1..24: note = chr13:87738892-87738916
  misc_feature 1..24: note = Hypo
  source 1..24: mol_type = genomic DNA
tttatttttttgagacggagtctc

SEQ ID NO: 109025 - DNA, 1631 bp, Homo sapiens
  misc_feature 1..1631: note = chr13:88323342-88324973
  misc_feature 1..1631: note = Hyper
  source 1..1631: mol_type = genomic DNA
ttaacagtaagtacacgagacagcagcattctgaatggcaggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgccgccctagcccagggacgccttcgccctcggctgccatctatcggccaccgagcgcccgcttcgccccgggcccatcatgtctgctgcagcttggctcgcaccagaggcgcgacaataaacaagtgcactggactgggccctgcacccgctccggagcagctgtctcagagacccggtgttgcttaccgcgttgccacctcctcggcgcccgggaggaagacgcaactttctcggagttttttttagagccaccgggctgccaggacaagccacaggcatagaacgacgcggttgctgcccgccccccccttcccccagaaaccccaaaggatgtcggtgatagagagttccaactaatgacgattgtgcgccgcatctggggaagggatacagaaaaaaaccctgcaaacaccgtgaggatgaaactgccaaagggatgcaagagcctctcaaatactaattaggggccgcggcggcggcgggctcggcgcggagacagcgtcggcgggatcccagcgcggtggtcgccgctgcgctggggggcggaggacagcgcaggagctgcagccgccgccttcgctggagcagccgaggggccggtgccacctttgctcgccccctcactaccatgtacagtgtgcgctgcaagaagaaggcgggagatgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgcgatcgcgccttaacacgtattggagcgagtgtgcgagtgatcatgagtgtgagcgggtgcgagcgctcggcggggctgaccgtcacgttggcggggccggcggggccaggcagtcttctccgcgtccccctcctcccgctccgtgcctcccctcccagcagctccccctccccgccccgcccggctccggctcccggcccctaccgcgaggcgcctctccagccggacctccgccgccccctcccgccgcctccctatcccgccgctgcagaacgccccccgctctccaccccccaaccctgctgcccgctccgactaccgcggagagcaccggggagagccttttggggagccccggaacccgcggtcgccaccgcggcggcggccccaggctggaggcgtccgggcgcctctttcctccagcctctgggactgcgctgctcgcagtctcctcgcc

SEQ ID NO: 109026 - DNA, 863 bp, Homo sapiens; identical to SEQ ID NO: 76166
  misc_feature 1..863: note = chr13:88325198-88326061
  misc_feature 1..863: note = Hyper
  source 1..863: mol_type = genomic DNA

SEQ ID NO: 109027 - DNA, 812 bp, Homo sapiens
  misc_feature 1..812: note = chr13:88326312-88327124
  misc_feature 1..812: note = Hyper
  source 1..812: mol_type = genomic DNA
tccttcctttaagagtgctgctgttgatcagaagtaggaagtggaaggaagccttcaaggggacaaaaagagagcaagaaaaaaaagggggagggggtcatattgattcctgtgggagatgaaattcggatattaaacaactgacctaagtcgcttacagttcttcctcccacctttctattttgcctcttaatcagcccaggcgtcctttccctgagattaaaaaaaagagagaggggagcgttaacaattaaatgtaataagcaactccaaagatggggatgctgtcgaggtggtagttccgtgcaaaccttgctattaccgttgcaaatagacgcggagcccaaggtaagggaggctttcgtgctgatccttggtgtactgattcccggtaagcggtaggaacgtcctttttaaactctaggcatcgggaggtattcggagattgcggataccttcgctgagttctttgtaatccatcgtgcagaactatttcagtggcttaaagatgcggtttggtagcgtcgctgacatgatcaatgagaagtggtcgcagggcgctctccgggaagcgctgctaagtggtaccgtgcatgcaattaggacgctgatgtgctttaatagcgtggtagtgaagtccaccatcaaagcaaatgcgctctccttttttctccttactcaaagctccgggagacaattggtgatttaagagcttcttggggctcctttgatgcattatattacagcctttttgcctctgaaaagtatcctttaggttcccaccgtggcatttctagcgatggtttaaaata

SEQ ID NO: 109028 - DNA, 29 bp, Homo sapiens
  misc_feature 1..29: note = chr13:88997906-88997935
  misc_feature 1..29: note = Hypo
  source 1..29: mol_type = genomic DNA
cccagcgcatcctccgctgctgctggcct

SEQ ID NO: 109029 - DNA, 32 bp, Homo sapiens; identical to SEQ ID NO: 76169
  misc_feature 1..32: note = chr13:89253759-89253791
  misc_feature 1..32: note = Hypo
  source 1..32: mol_type = genomic DNA

SEQ ID NO: 109030 - DNA, 27 bp, Homo sapiens
  misc_feature 1..27: note = chr13:90047527-90047554
  misc_feature 1..27: note = Hypo
  source 1..27: mol_type = genomic DNA
ccacaacaggccaggcgcggtggctca

SEQ ID NO: 109031 - DNA, 101 bp, Homo sapiens; identical to SEQ ID NO: 76171
  misc_feature 1..101: note = chr13:90685501-90685602
  misc_feature 1..101: note = Hypo
  source 1..101: mol_type = genomic DNA

SEQ ID NO: 109032 - DNA, 30 bp, Homo sapiens; identical to SEQ ID NO: 43817
  misc_feature 1..30: note = chr13:91948489-91948519
  misc_feature 1..30: note = Hypo
  source 1..30: mol_type = genomic DNA

SEQ ID NO: 109033 - DNA, 87 bp, Homo sapiens; identical to SEQ ID NO: 76173
  misc_feature 1..87: note = chr13:92050679-92050766
  misc_feature 1..87: note = Hyper
  source 1..87: mol_type = genomic DNA

SEQ ID NO: 109034 - DNA, 679 bp, Homo sapiens
  misc_feature 1..679: note = chr13:92050975-92051654
  misc_feature 1..679: note = Hyper
  source 1..679: mol_type = genomic DNA
cagtggtggccagagcggatgcttgcgggctccctgcggctccactagttttcttcgccccgcccagccgcccactcttctcggctagggaagaagaccagagggtgctcagctggaaaactctggtgtctcagcttagggcctcctccgggaagagctaactgctcccaggtgaagccggtgcccgcgggcggtccgtacaccccgcagccggctcgcaccgctcgagagcctcggccgctgtgtcttccacgtctgcagctcagccagggcgcgcagggcgagtggggtccactggcgggtaaaggggaccaggacggcgaggatggacgcacagacctggcccgtgggctttcgctgcctcctccttctggccctggttgggtccgcccgcagcgagggcgtgcagacctgcgaagaagttcggaaacttttccagtggcggctgctgggagctgtcagggggctgccggattcgccgcgggcaggtaaggggcaatgagggggtctctggactggcggcgtccgagcccggccttcgctcccccaggctcccttggtggcactcgtgggaagatgacctttcgggccctgcagccgcgcagggtgaatcccggggaggcttccggggatgcttggtgcgggtagcctgagtgcagcgcagcgcagctctggggac

SEQ ID NO: 109035 - DNA, 30 bp, Homo sapiens; identical to SEQ ID NO: 76176
  misc_feature 1..30: note = chr13:92345893-92345923
  misc_feature 1..30: note = Hypo
  source 1..30: mol_type = genomic DNA

SEQ ID NO: 109036 - DNA, 30 bp, Homo sapiens; identical to SEQ ID NO: 76177
  misc_feature 1..30: note = chr13:92857981-92858011
  misc_feature 1..30: note = Hypo
  source 1..30: mol_type = genomic DNA

SEQ ID NO: 109037 - DNA, 1916 bp, Homo sapiens
  misc_feature 1..1916: note = chr13:93879208-93881124
  misc_feature 1..1916: note = Hyper
  source 1..1916: mol_type = genomic DNA
catccccaagaacctcgagctcacaccaacagacacacgcgcgcatacacactcgctctcgcttgtccatctccctcccgggggagccggcgcgcgctcccacctttgccgcacactccggcgagccgagcccgcagcgctccaggattctgcggctcggaactcggattgcagctctgaacccccatggtggttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagccgggcgctcactccgcgttctggttcgggcaaacttggaagaactgcgaccgcagtttgcccagcgccacagtctgagtggcgccttctccactcccgcccttgcgccggcaggggcggtggagagacgcggagggctcccccagcccctctctcccctatccgtccttcgggcgacagagcgcccggcgctcgggccgggggcgggcaaggctgggagggaccctcgccggggacctggcctctggacgccggcgtttcaaggctggtttggggacttcacgggctgcctgtttcagatgtggggcgggctttcccgttagggttcctcagtgcttccccagttgctgttggccactcagggcccggggacaccctgccacccggtctggagccggcctcgtctgccagcgaacagccaactttagcgggtggctcagctggggattcgggtccgggttcgggggccccgtgtcccccgcatgcccggccactggcattgctccaccaagagcttgagagcgcccaccctttctctcggcgccagtgtgtgtagcacttggtctccgacaacttgcgcggcagtctgggtgcttgttttccggctcttagctccaaccgaatccgagcttctctggggctctgtgaatgaaacgtgtcggggagagataatcctttggctgctaaagaacagaactgagagaggccgagggaggccaggagatgctgcgagggcgcgggctgctcaaaccgggcagctgaagtccttagtgacctcagatcgtcaagtcaaaacgctgaatttccaccagcctctgtctgctttttgccaaataactggtggatggatgaaaagcattttgcagatatcttagaacatcacagtttcgatacgttgaggaattact

SEQ ID NO: 109038 - DNA, 79 bp, Homo sapiens; identical to SEQ ID NO: 76184
  misc_feature 1..79: note = chr13:95201260-95201339
  misc_feature 1..79: note = Hyper
  source 1..79: mol_type = genomic DNA

SEQ ID NO: 109039 - DNA, 36 bp, Homo sapiens; identical to SEQ ID NO: 76185
  misc_feature 1..36: note = chr13:95201626-95201662
  misc_feature 1..36: note = Hyper
  source 1..36: mol_type = genomic DNA

SEQ ID NO: 109040 - DNA, 21 bp, Homo sapiens
  misc_feature 1..21: note = chr13:95201891-95201912
  misc_feature 1..21: note = Hyper
  source 1..21: mol_type = genomic DNA
tttaaaagtagctgccgaaac

SEQ ID NO: 109041 - DNA, 20 bp, Homo sapiens
  misc_feature 1..20: note = chr13:95201972-95201992
  misc_feature 1..20: note = Hyper
  source 1..20: mol_type = genomic DNA
cggcacgttctgggttgtct

SEQ ID NO: 109042 - DNA, 30 bp, Homo sapiens; identical to SEQ ID NO: 76187
  misc_feature 1..30: note = chr13:95202314-95202344
  misc_feature 1..30: note = Hyper
  source 1..30: mol_type = genomic DNA

SEQ ID NO: 109043 - DNA, 81 bp, Homo sapiens; identical to SEQ ID NO: 76188
  misc_feature 1..81: note = chr13:95354293-95354374
  misc_feature 1..81: note = Hyper
  source 1..81: mol_type = genomic DNA

SEQ ID NO: 109044 - DNA, 56 bp, Homo sapiens; identical to SEQ ID NO: 76189
  misc_feature 1..56: note = chr13:95355963-95356019
  misc_feature 1..56: note = Hyper
  source 1..56: mol_type = genomic DNA

SEQ ID NO: 109045 - DNA, 1528 bp, Homo sapiens; identical to SEQ ID NO: 76190
  misc_feature 1..1528: note = chr13:95357026-95358554
  misc_feature 1..1528: note = Hyper
  source 1..1528: mol_type = genomic DNA

SEQ ID NO: 109046 - DNA, 787 bp, Homo sapiens; identical to SEQ ID NO: 76191
  misc_feature 1..787: note = chr13:95359626-95360413
  misc_feature 1..787: note = Hyper
  source 1..787: mol_type = genomic DNA

SEQ ID NO: 109047 - DNA, 30 bp, Homo sapiens; identical to SEQ ID NO: 76192
  misc_feature 1..30: note = chr13:95360897-95360927
  misc_feature 1..30: note = Hyper
  source 1..30: mol_type = genomic DNA

SEQ ID NO: 109048 - DNA, 2968 bp, Homo sapiens
  misc_feature 1..2968: note = chr13:95362808-95365776
  misc_feature 1..2968: note = Hyper
  source 1..2968: mol_type = genomic DNA
acaaaaggccagattcgagccggtcactggtcaagaatggatctggttgggagttctgcttgagagaacagagatctgcaaagttcaaatagtacaaacagggaggcgaggctgctcagagccatcccactcccagaaacgaatgacacaagcagcttttcccgtgtgccagccatttcagacctcacatttgaacagcgtgcatgcaacacggaccgggagggggttgggggttggggggctgaggggcgaggaagaagaatgagaaacaaaaacaaaaccgaccatgaaacttccaacaaaactggaaaggccaacatgtcaaaaagttactcctccacctccgtgggtcaaaacgcaacaggttccgaagtgcaaagcaaacgccaactgctgccgcacacaaccgcctgctttcgagttggctgccgaagtgcgggtctgaaatgatcctgcgaattcacaggcctgctcgcccgcgcccttgcgcgcttggccactcctgccccgcctggcctctctgcctctacctggcacctatacattctatgtacatacaaaccgggcccccggtcgcgggagggcgcacggggaggccgcagcgctcgtacctatacatatgtacacgtgtgcacaccggtcctcgcgaggcggccccgcggggtcatagcgcggcagcgtaggccgcggggtaggggtccagctggggcttgcccatgcccggcagcaggatgtaggcgagcggcggctgcagcccggggctgggccacgcgctgcagttgcacgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagtaggggctgcccgcggcggcggcggcggcggcagcggcggcggcagcggccgactgcgggaagaagacgcgtgcggcggcagcggcggcggccgcggccgccttctcgggattggcgagcagcgactcaggcaccaggccgccgcccgcccccgcgtgcagcccggcgcccgccttgagcgcagggtgctcggcgtccgccacgccgcccaggccgtagggcaccgggaaggcgaacttgtccttcttgagcagcgtcttgggcttgcgccgcggccggtacttgtagtcggggtgctccttcatgtgcatggcgcgtagacgcttggcctcgtcgatgaacggccgcttctccgactctgtgagcagtttccactcggcgcccaagcgcttgctgatctccgagttgtgcatcttggggttctcctgggccatcttgcgccgctgagcccgcgaccacaccatgaaggcgttcatgggccgcttgacgtggtccaccggcttggacatgctctcgccctgccgcggctgcagcccgccgcctcccgggccctcgccctcggcccggaggaaatcaatgttggctgcccgcggagacccgctcggccggccggggctcgtcgcgccccggcgtcgctcccgccccggaggagggggctgggggaccagcccagggccacgccgcgccccgggccgccttagtgtctccggccgagcgctcgagcaggttgtctctgggacactctaacttctcggcggtgccccctccccgcggcggcagtttgccctttacgttctttgggtccttcgtctgcagtggcgtttgctggtgagctccccgcaggtagcggcggccgggcagagcgctcctcctcctcggtcgttctctcttaaatgcaaagcgtccccaaaagttgcgtcgcggagactcctcgaagttgagccgaggagcccgccgccgcgtgctgccaagtgccaaagggggctctcagcggctggagtgtttgggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgcaactaacttcgcccaagtttcctgcgccgcggcgcccctctcggcgcgctcctgggagcgtgcgcccgcgagtccgccgcgcccggggcccctctgtcctcgctgctgtggccagagccgagccggcgcaggggcggaggtgctgcaggagagttaaggaaaacgggccatcacctcagttcgcaggtccgcgctgtggcacctcccgctctccccactcccgcggcgcagggggccccttcccagcccaggccgccctctgcaccggctcaggtgagtgtggctacctgcatgtgtgcgcgcccggagccggcactgggtgtgcatgtccagccgcggctgtgtgtgtatatctgggggcctgcggaggaggtggagcccaggactcggggagggaggagg

SEQ ID NO: 109049 - DNA, 30 bp, Homo sapiens; identical to SEQ ID NO: 76199
  misc_feature 1..30: note = chr13:95451825-95451855
  misc_feature 1..30: note = Hypo
  source 1..30: mol_type = genomic DNA

SEQ ID NO: 109050 - DNA, 23 bp, Homo sapiens
  misc_feature 1..23: note = chr13:95476305-95476328
  misc_feature 1..23: note = Hypo
  source 1..23: mol_type = genomic DNA
ttaaaaattcttggccgggcacg

SEQ ID NO: 109051 - DNA, 1313 bp, Homo sapiens
  misc_feature 1..1313: note = chr13:95619761-95621074
  misc_feature 1..1313: note = Hyper
  source 1..1313: mol_type = genomic DNA
cttactgcagtgcagcgtttatgacacttgaaaacagattggagagtgggttttgctcgggcgacttgattgtctttcaagttggcgttaagagttttcaacaggtctccttccctgccagccgggaccccgggggtccctcggagcagggcgggtgggaccgctcggcctccttctctcgcccgcacgggcgccgccgcagacccggagcaggcacccggcggccgccgcgtgggctgcagcttagcctcctctgcgggcgcccggcagggctgcgcggccgagactcggggcgccggcgccggggcggccgggagctctgtcatttggcaactccctgcagactgatgacacggcgctttccatggtcgagccccacaaagtgtagggctgcggggcgcacctggctgggctcctaattacccggcctgggacgcacggggcagccgcggagggtggcgcctggggtcgggccggggtccccttcgccgcagtcccgcccacccgcagcctccgaggggtcccggccagggcgttctccacacgctcggctacctgcaggggttcgccactgcaagccgggccagtagaagtttgggggcgaaggcagagagcatttccttctcggcttttggcgcctccacgctgcacagaggcaggggcgactctgcaggccccgtttcccccatcctcccctccaccccagttccccgcaggacgtaggcgccgtccctagctcccccttctgtcctcgccctaacaccgcagggcctctcctggggatgtggggtcctgcgtgcttttgggggctacaaaaagtgggggccgtcgcagagcagagggaagctaggagcgggcaacgaattgaatcctggagacccgggaggagcgaggctgctgccgtccccggggaaagggcgacttcggcggggataccccgtgccaggccctgcaactcccgggccctcgggaatgggatgggggaggcgcggggtgcgcgcagctcccggtgatgttaaggcgtccgatggagacttgggttatttgcttcgcgtatcctcccctgttcctctgcaccgagctcctggctgccgctgcggccgctgtgtgcccgaggggcggctctgtaacccggctccaggcatttcttaggtttcccatccccgccctccaagctcccgggagcgcctgctccgctgcccgcagacaggcgtcgttcaaacctcagctctgctcggtctgcattcatggaccccagatcttcaccctaggatttccatctcagcatttcacgttcccggggaaaaagggag

SEQ ID NO: 109052 - DNA, 355 bp, Homo sapiens; identical to SEQ ID NO: 76204
  misc_feature 1..355: note = chr13:95655055-95655410
  misc_feature 1..355: note = Hyper
  source 1..355: mol_type = genomic DNA

SEQ ID NO: 109053 - DNA, 135 bp, Homo sapiens; identical to SEQ ID NO: 76205
  misc_feature 1..135: note = chr13:95711256-95711391
  misc_feature 1..135: note = Hypo
  source 1..135: mol_type = genomic DNA

SEQ ID NO: 109054 - DNA, 70 bp, Homo sapiens; identical to SEQ ID NO: 76206
  misc_feature 1..70: note = chr13:95718405-95718475
  misc_feature 1..70: note = Hypo
  source 1..70: mol_type = genomic DNA

SEQ ID NO: 109055 - DNA, 30 bp, Homo sapiens; identical to SEQ ID NO: 76207
  misc_feature 1..30: note = chr13:95725531-95725561
  misc_feature 1..30: note = Hypo
  source 1..30: mol_type = genomic DNA

SEQ ID NO: 109056 - DNA, 85 bp, Homo sapiens; identical to SEQ ID NO: 76208
  misc_feature 1..85: note = chr13:95775589-95775674
  misc_feature 1..85: note = Hypo
  source 1..85: mol_type = genomic DNA

SEQ ID NO: 109057 - DNA, 30 bp, Homo sapiens; identical to SEQ ID NO: 76209
  misc_feature 1..30: note = chr13:95780731-95780761
  misc_feature 1..30: note = Hypo
  source 1..30: mol_type = genomic DNA

SEQ ID NO: 109058 - DNA, 50 bp, Homo sapiens; identical to SEQ ID NO: 76210
  misc_feature 1..50: note = chr13:95843472-95843522
  misc_feature 1..50: note = Hypo
  source 1..50: mol_type = genomic DNA

SEQ ID NO: 109059 - DNA, 73 bp, Homo sapiens; identical to SEQ ID NO: 76211
  misc_feature 1..73: note = chr13:95858839-95858912
  misc_feature 1..73: note = Hypo
  source 1..73: mol_type = genomic DNA

SEQ ID NO: 109060 - DNA, 30 bp, Homo sapiens; identical to SEQ ID NO: 76212
  misc_feature 1..30: note = chr13:95870024-95870054
  misc_feature 1..30: note = Hypo
  source 1..30: mol_type = genomic DNA

SEQ ID NO: 109061 - DNA, 105 bp, Homo sapiens; identical to SEQ ID NO: 76213
  misc_feature 1..105: note = chr13:95888741-95888846
  misc_feature 1..105: note = Hypo
  source 1..105: mol_type = genomic DNA

SEQ ID NO: 109062 - DNA, 91 bp, Homo sapiens; identical to SEQ ID NO: 76214
  misc_feature 1..91: note = chr13:96031634-96031725
  misc_feature 1..91: note = Hypo
  source 1..91: mol_type = genomic DNA

SEQ ID NO: 109063 - DNA, 30 bp, Homo sapiens; identical to SEQ ID NO: 35019
  misc_feature 1..30: note = chr13:96056313-96056343
  misc_feature 1..30: note = Hyper
  source 1..30: mol_type = genomic DNA

SEQ ID NO: 109064 - DNA, 30 bp, Homo sapiens; identical to SEQ ID NO: 76216
  misc_feature 1..30: note = chr13:96135326-96135356
  misc_feature 1..30: note = Hypo
  source 1..30: mol_type = genomic DNA

SEQ ID NO: 109065 - DNA, 525 bp, Homo sapiens
  misc_feature 1..525: note = chr13:96204838-96205363
  misc_feature 1..525: note = Hyper
  source 1..525: mol_type = genomic DNA
atgggtgtgaggggtcgcgtgcgccccctggcgccgggtccgctgggcggggtggtgggcggggacggtgggcggaggcggaggcgggaggcggagccccggggttgggagtgcgggggtcgcggcgcagagtgggagccggagagcgagcgcggctgcagccggcggcatggctagcacggcttcggagatcatcgccttcatggtctccatctcaggctgggtactggtgtcctccacgctgcccaccgactactggaaggtgtctaccatcgacggcacggtcatcacaaccgccacctattgggccaacctgtggaaggcgtgcgttaccgactccacgggcgtctccaactgcaaggacttcccctccatgctggcgctggacggtctgcatccccgcggcccccgccctcagccctccttccttgatggccagcccgctaggcgccctctcgcccccaatacccccagcgggacccctagactggactcctctgaggcccgacccgtctctcccaacag

SEQ ID NO: 109066 - DNA, 865 bp, Homo sapiens
  misc_feature 1..865: note = chr13:96296373-96297238
  misc_feature 1..865: note = Hyper
  source 1..865: mol_type = genomic DNA
gcctcaagtcccaggcgcatggcaccgccgggcagccgaaccagcagacaaaagccgagagacgcgggttccaggggaacctcggcgcccttccttggaaggcaaacaggcagtgggggcagcggcggctactccagctggatctgcagaggctcggctcgcagcctggagaggcaggagggccggcttcgcgggtatcgggatgccccgtcagccacctcctgtgggcgcctggcgcatccccggtctcggctcaccccagctgcgcgctcctgggcgggtgccgggcgctgcaggcgggcgggggcgacacaggggacccagaccccagggtcgctgctgacgcgggccgggcccgcggaggccgaggagcagcaaagcggagagaggcaggccggctccttcttgcagggcgcaggatgaaacgtgtctggtctgggcaagttgtggcgaggcgggtcgactggcgccgctctagggccttccagactccggaccacggacgactcaggataccccacccccctcccgccccctcccctccgcgatctccctccggcctcttccctcggtgtcccggctcctctggcaactgggcgggaccgcgagcgtctagaccgcagcgctaaaatgcgctcagccaatccggcagctggcgcagacacgtggttcgggggcgcgctccgttgctggccctggatgctaaccctaggaaggcttttcaaagagaaaccagattcgctcctacccggttgttggtctggccctcagcaagctaatttcccagaggagcttcaggtgaattatcttccaaaaagagatgcgttttaatcgcagaagtctgcagatgcgaaggaccttgaaa

SEQ ID NO: 109067 - DNA, 66 bp, Homo sapiens; identical to SEQ ID NO: 43823
  misc_feature 1..66: note = chr13:96409578-96409644
  misc_feature 1..66: note = Hypo
  source 1..66: mol_type = genomic DNA

SEQ ID NO: 109068 - DNA, 919 bp, Homo sapiens; identical to SEQ ID NO: 76222
  misc_feature 1..919: note = chr13:96742194-96743113
  misc_feature 1..919: note = Hyper
  source 1..919: mol_type = genomic DNA

SEQ ID NO: 109069 - DNA, 769 bp, Homo sapiens
  misc_feature 1..769: note = chr13:96743347-96744116
  misc_feature 1..769: note = Hyper
  source 1..769: mol_type = genomic DNA
ccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggtactgtcgcccgctgggtctctgttcttcccccccaccccccatccctcttcctcagtcctgacccagagcgaccccgcgctccctgcccctgccgatggtttcctggcgtcttcagcggttggcgccgtggctttggggagggatgagaaacctccggatagtgcctaggtcctgaactcgttcttcccccagcccccaccgcttcccgccacccctctgccttcaccctctaagatgtgcggagccaccgtgtggatcctgcctgttgcctagcacggcctggcctccct

SEQ ID NO: 109070 - DNA, 30 bp, Homo sapiens; identical to SEQ ID NO: 76225
  misc_feature 1..30: note = chr13:96958800-96958830
  misc_feature 1..30: note = Hypo
  source 1..30: mol_type = genomic DNA

SEQ ID NO: 109071 - DNA, 18 bp, Homo sapiens
  misc_feature 1..18: note = chr13:97599727-97599745
  misc_feature 1..18: note = Hypo
  source 1..18: mol_type = genomic DNA
tctcgcctcactgcaacc

SEQ ID NO: 109072 - DNA, 16 bp, Homo sapiens
  misc_feature 1..16: note = chr13:98426774-98426790
  misc_feature 1..16: note = Hypo
  source 1..16: mol_type = genomic DNA
tgcctgatctcagctc

SEQ ID NO: 109073 - DNA, 30 bp, Homo sapiens; identical to SEQ ID NO: 76228
  misc_feature 1..30: note = chr13:98702848-98702878
  misc_feature 1..30: note = Hypo
  source 1..30: mol_type = genomic DNA

SEQ ID NO: 109074 - DNA, 30 bp, Homo sapiens; identical to SEQ ID NO: 76229
  misc_feature 1..30: note = chr13:98795810-98795840
  misc_feature 1..30: note = Hyper
  source 1..30: mol_type = genomic DNA

SEQ ID NO: 109075 - DNA, 39 bp, Homo sapiens; identical to SEQ ID NO: 76230
  misc_feature 1..39: note = chr13:98866341-98866380
  misc_feature 1..39: note = Hypo
  source 1..39: mol_type = genomic DNA

SEQ ID NO: 109076 - DNA, 48 bp, Homo sapiens; identical to SEQ ID NO: 76231
  misc_feature 1..48: note = chr13:98870050-98870098
  misc_feature 1..48: note = Hypo
  source 1..48: mol_type = genomic DNA

SEQ ID NO: 109077 - DNA, 325 bp, Homo sapiens; identical to SEQ ID NO: 76232
  misc_feature 1..325: note = chr13:99083172-99083497
  misc_feature 1..325: note = Hypo
  source 1..325: mol_type = genomic DNA

SEQ ID NO: 109078 - DNA, 30 bp, Homo sapiens; identical to SEQ ID NO: 76233
  misc_feature 1..30: note = chr13:99136257-99136287
  misc_feature 1..30: note = Hypo
  source 1..30: mol_type = genomic DNA

SEQ ID NO: 109079 - DNA, 30 bp, Homo sapiens; identical to SEQ ID NO: 76234
  misc_feature 1..30: note = chr13:99176587-99176617
  misc_feature 1..30: note = Hypo
  source 1..30: mol_type = genomic DNA

SEQ ID NO: 109080 - DNA, 187 bp, Homo sapiens; identical to SEQ ID NO: 76235
  misc_feature 1..187: note = chr13:99189615-99189802
  misc_feature 1..187: note = Hypo
  source 1..187: mol_type = genomic DNA

SEQ ID NO: 109081 - DNA, 46 bp, Homo sapiens; identical to SEQ ID NO: 76236
  misc_feature 1..46: note = chr13:99328589-99328635
  misc_feature 1..46: note = Hypo
  source 1..46: mol_type = genomic DNA

SEQ ID NO: 109082 - DNA, 407 bp, Homo sapiens
  misc_feature 1..407: note = chr13:99404616-99405023
  misc_feature 1..407: note = Hyper
  source 1..407: mol_type = genomic DNA
cctcggcggagtcggcgcctctgggcacctctggcttccgcgccccggccgcacggtgaccacccgggaggggatcccgggcgccccgcaacctcccggcccccgtgggccttcgggtcgccccgcttcccgccgccgcgtacccttcgcgcctcccggccctcggtgccggcccccgccccgcgtagctccgagtctttagcccggccggccccccacccgccgagcgtacccatggcggcggctcccagggctcctgcgacctgccggcgggacgtgctcctggcaggtgctactcctccgacctgacgtccaggcccggccccgttgccccaggtacagccccagctctgcgaggcggggccgccggctccacccggggggcggtgctgcggggagcagaggtc

SEQ ID NO: 109083 - DNA, 213 bp, Homo sapiens; identical to SEQ ID NO: 76238
  misc_feature 1..213: note = chr13:99428504-99428717
  misc_feature 1..213: note = Hypo
  source 1..213: mol_type = genomic DNA

SEQ ID NO: 109084 - DNA, 24 bp, Homo sapiens
  misc_feature 1..24: note = chr13:99851628-99851652
  misc_feature 1..24: note = Hypo
  source 1..24: mol_type = genomic DNA
tggggagagcgagactccgtctca

SEQ ID NO: 109085 - DNA, 30 bp, Homo sapiens; identical to SEQ ID NO: 43831
  misc_feature 1..30: note = chr13:100095884-100095914
  misc_feature 1..30: note = Hypo
  source 1..30: mol_type = genomic DNA

SEQ ID NO: 109086 - DNA, 37 bp, Homo sapiens; identical to SEQ ID NO: 43832
  misc_feature 1..37: note = chr13:100146505-100146542
  misc_feature 1..37: note = Hypo
  source 1..37: mol_type = genomic DNA

SEQ ID NO: 109087 - DNA, 81 bp, Homo sapiens; identical to SEQ ID NO: 15770
  misc_feature 1..81: note = chr13:100356871-100356952
  misc_feature 1..81: note = Hypo
  source 1..81: mol_type = genomic DNA

SEQ ID NO: 109088 - DNA, 30 bp, Homo sapiens; identical to SEQ ID NO: 75350
  misc_feature 1..30: note = chr13:100452188-100452218
  misc_feature 1..30: note = Hypo
  source 1..30: mol_type = genomic DNA

SEQ ID NO: 109089 - DNA, 30 bp, Homo sapiens; identical to SEQ ID NO: 75351
  misc_feature 1..30: note = chr13:100523137-100523167
  misc_feature 1..30: note = Hypo
  source 1..30: mol_type = genomic DNA

SEQ ID NO: 109090 - DNA, 41 bp, Homo sapiens
  misc_feature 1..41: note = chr13:100547868-100547909
  misc_feature 1..41: note = Hyper
  source 1..41: mol_type = genomic DNA
cccgcgcttgggacccggcagctctgcgcgggctggttttg

SEQ ID NO: 109091 - DNA, 276 bp, Homo sapiens; identical to SEQ ID NO: 43834
  misc_feature 1..276: note = chr13:100575337-100575613
  misc_feature 1..276: note = Hypo
  source 1..276: mol_type = genomic DNA

SEQ ID NO: 109092 - DNA, 30 bp, Homo sapiens; identical to SEQ ID NO: 43835
  misc_feature 1..30: note = chr13:100583792-100583822
  misc_feature 1..30: note = Hypo
  source 1..30: mol_type = genomic DNA

SEQ ID NO: 109093 - DNA, 1162 bp, Homo sapiens
  misc_feature 1..1162: note = chr13:100608107-100609269
  misc_feature 1..1162: note = Hyper
  source 1..1162: mol_type = genomic DNA
acttccagcttggagcggaaatcggggccggggcaaggacgcaggggcgtgtcgcccacgtttctggcccggctagccgcaactccttggatgtaaacgagatttggccggcgctgcggcgtgtggggaaagatgattacactcgaaaggaatcacgactccttgcggagccattactcgtgccgctccgcacgcgcaggttctggcccggctttcagcaactccccgctcctcgctaaccactcgctcgtaatttgtgggccgcagtggagctgcgcccggggctgcagccccccaattaaagcacttttgcagctcggacacccagagagctgcctccgcgcacgccaggccggcacctcctgctcccactcccctctccgcccagccgtgggcagctgaaatggatgtgatttcacgcacttcctgcgcgcgcacacacacatgcacacatggacatacacttgcacacacgcacaacgcgcattccccctccaatgccgcccgcacacgtgcgcgagcctggacgttccccttttgtgctcgttttgcaggcccagagctcctgctgctggttttctcctttctctccttcatcgcctcttccttcgccactttccttctggaccctccgggctggctcctgcccctctgccccggtggcgctctcgcctattcctcccgggaggagccggggccgcagaggtgcgccctgcacgcccagcgagggccgagttctgggacggctgggaccaaagggctggcctccggcctgcgccctgtttgttttcctttcgccccctgaatactagattgagacgtaaagattacccgggccgaataatgccgggagtcaacactcgagcaaacaaaagtgcttgcacaactagtcaaccccgctgggacccgggccgcgggctgggggagagaacgcgctcctcgctgctaattacaaataaatgatgatgtgctcactaagtaattgatttaatgaagttcctatgaaactattaaacccgggtggaggtcaggctggaggcgccccagagcgcccattgtgggctgtttaactccaccaggctcctcggaaagacatcggggctaataggtgaagtcacagctgctcgcgctgacttctcggagcgcccggctggccgcgggc

SEQ ID NO: 109094 - DNA, 109 bp, Homo sapiens; identical to SEQ ID NO: 75357
  misc_feature 1..109: note = chr13:100609476-100609585
  misc_feature 1..109: note = Hyper
  source 1..109: mol_type = genomic DNA

SEQ ID NO: 109095 - DNA, 350 bp, Homo sapiens; identical to SEQ ID NO: 75358
  misc_feature 1..350: note = chr13:100611882-100612232
  misc_feature 1..350: note = Hyper
  source 1..350: mol_type = genomic DNA

SEQ ID NO: 109096 - DNA, 30 bp, Homo sapiens; identical to SEQ ID NO: 75359
  misc_feature 1..30: note = chr13:100620344-100620374
  misc_feature 1..30: note = Hyper
  source 1..30: mol_type = genomic DNA

SEQ ID NO: 109097 - DNA, 276 bp, Homo sapiens; identical to SEQ ID NO: 75360
  misc_feature 1..276: note = chr13:100620640-100620916
  misc_feature 1..276: note = Hyper
  source 1..276: mol_type = genomic DNA

SEQ ID NO: 109098 - DNA, 231 bp, Homo sapiens; identical to SEQ ID NO: 75361
  misc_feature 1..231: note = chr13:100621135-100621366
  misc_feature 1..231: note = Hyper
  source 1..231: mol_type = genomic DNA

SEQ ID NO: 109099 - DNA, 299 bp, Homo sapiens; identical to SEQ ID NO: 75362
  misc_feature 1..299: note = chr13:100621716-100622015
  misc_feature 1..299: note = Hyper
  source 1..299: mol_type = genomic DNA

SEQ ID NO: 109100 - DNA, 959 bp, Homo sapiens; identical to SEQ ID NO: 75363
  misc_feature 1..959: note = chr13:100622222-100623181
  misc_feature 1..959: note = Hyper
  source 1..959: mol_type = genomic DNA

SEQ ID NO: 109101 - DNA, 773 bp, Homo sapiens
  misc_feature 1..773: note = chr13:100623899-100624672
  misc_feature 1..773: note = Hyper
  source 1..773: mol_type = genomic DNA
tttattccctctgcccgccttcaaaaacatgtatgtattgggcgctctttaacttcttttgtcctggcctcttaactctgcttattcctgttcccactctatcctccagcgattggcagagtgaacaccacatttgagctgcacagtgggaccgagattttggaaatggcacgggtgggattggagggagccgcgtgattggcagtagcctcggctgctcgattggctcccgttcaggccctcgacccagcggggattcgcccccgtgcttgcggccgcctgcgctttcgcttcgcgccccctcctccgctggagccacacgtccccgcctccccggggatgcccaagttgcacttgcagaaagtttgagcctggcctgcgcgcgcagcgccccgctcttccttgacgcacctcgcggagcgcgcgccggcacgcgggcagagggcgcggggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctagggcgcatagacagtagacggagtgaagaagataaagtctattggttgcaagacaacttgagtgatttggctccgcgaaacaccaggt

SEQ ID NO: 109102 - DNA, 66 bp, Homo sapiens
  misc_feature 1..66: note = chr13:100624887-100624953
  misc_feature 1..66: note = Hyper
  source 1..66: mol_type = genomic DNA
gcggggcaggccaaacggcatctctgcagagagaagccgctaaataagcaccgtcctttaagtaga

SEQ ID NO: 109103 - DNA, 154 bp, Homo sapiens; identical to SEQ ID NO: 75367
  misc_feature 1..154: note = chr13:100626366-100626520
  misc_feature 1..154: note = Hyper
  source 1..154: mol_type = genomic DNA

SEQ ID NO: 109104 - DNA, 30 bp, Homo sapiens
  misc_feature 1..30: note = chr13:100626979-100627009
  misc_feature 1..30: note = Hyper
  source 1..30: mol_type = genomic DNA
gggggctgtggaaggcgttatgccaattct

SEQ ID NO: 109105 - DNA, 106 bp, Homo sapiens
  misc_feature 1..106: note = chr13:100627295-100627401
  misc_feature 1..106: note = Hyper
  source 1..106: mol_type = genomic DNA
gttggctgagttaaccgcgctcagctgcctggaggccacgggacccgatctctggggatgctcgagctggcgcttgcggcttcccgctgcgcgtagtgggggactg

SEQ ID NO: 109106 - DNA, 511 bp, Homo sapiens; identical to SEQ ID NO: 75368
  misc_feature 1..511: note = chr13:100630630-100631141
  misc_feature 1..511: note = Hyper
  source 1..511: mol_type = genomic DNA

SEQ ID NO: 109107 - DNA, 32 bp, Homo sapiens; identical to SEQ ID NO: 75369
  misc_feature 1..32: note = chr13:100631610-100631642
  misc_feature 1..32: note = Hyper
  source 1..32: mol_type = genomic DNA

SEQ ID NO: 109108 - DNA, 54 bp, Homo sapiens; identical to SEQ ID NO: 35044
  misc_feature 1..54: note = chr13:100631883-100631937
  misc_feature 1..54: note = Hyper
  source 1..54: mol_type = genomic DNA

SEQ ID NO: 109109 - DNA, 85 bp, Homo sapiens; identical to SEQ ID NO: 75371
  misc_feature 1..85: note = chr13:100632429-100632514
  misc_feature 1..85: note = Hyper
  source 1..85: mol_type = genomic DNA

SEQ ID NO: 109110 - DNA, 42 bp, Homo sapiens; identical to SEQ ID NO: 75372
  misc_feature 1..42: note = chr13:100633842-100633884
  misc_feature 1..42: note = Hyper
  source 1..42: mol_type = genomic DNA

SEQ ID NO: 109111 - DNA, 30 bp, Homo sapiens; identical to SEQ ID NO: 75373
  misc_feature 1..30: note = chr13:100634277-100634307
  misc_feature 1..30: note = Hyper
  source 1..30: mol_type = genomic DNA

SEQ ID NO: 109112 - DNA, 595 bp, Homo sapiens
  misc_feature 1..595: note = chr13:100634944-100635539
  misc_feature 1..595: note = Hyper
  source 1..595: mol_type = genomic DNA
actccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggtaaccgcgggctgggacagggaccaggcgcggaggggagacacgcacaggctgagactcaggctgtgggtgccgacgctgggcgcagaccgccagccggggacctgggatgggaggtgtttttgcgtgtacgaaagagccagcag

SEQ ID NO: 109113 - DNA, 506 bp, Homo sapiens
  misc_feature 1..506: note = chr13:100635935-100636441
  misc_feature 1..506: note = Hyper
  source 1..506: mol_type = genomic DNA
cgtctcggggtgggtcgcgggggctttactgtggtttcgcagcagtttgtgaaattctctaatgggcaccacagagtttgcgattcccaacttggacccaggtcagctagagccccaggtcagctagagccccaggcagcgcggccccgcggggggatcgcgtgagaagagagagccgcaaaagaacgcgcctcccgcctcatagattattcatctatgaccaggtctcagccaaaatcgtgccagacgatttcctaaaagaaagccaaatgttttagcaacttcccccgtcaatatttactccgaagtggggatgcgccagcggcctattgttctcttccgggaagggagggagccgaggtgcgagacaagcttttaacaaggtttaaaatttgagaaatttatttgcatgaaatgctcgctttcgagtcctgtgtctgagcggatgtctttaagaaacaatttaggtgctaatggaatttaacgttaaacggtcccctttccaa

SEQ ID NO: 109114 - DNA, 1159 bp, Homo sapiens; identical to SEQ ID NO: 75378
  misc_feature 1..1159: note = chr13:100636859-100638018
  misc_feature 1..1159: note = Hyper
  source 1..1159: mol_type = genomic DNA

SEQ ID NO: 109115 - DNA, 194 bp, Homo sapiens; identical to SEQ ID NO: 75379
  misc_feature 1..194: note = chr13:100640276-100640470
  misc_feature 1..194: note = Hyper
  source 1..194: mol_type = genomic DNA

SEQ ID NO: 109116 - DNA, 1296 bp, Homo sapiens
  misc_feature 1..1296: note = chr13:100640905-100642201
  misc_feature 1..1296: note = Hyper
  source 1..1296: mol_type = genomic DNA
ggagcgggcgggagccgcttttcctcgaaagggctcccagtccctggtccctcgcttcccaaggctttgtccaaacaagtcacggacccgacaaggtggtccattctctctctttggcctttcttttctgcccttcgaatccgaaggactggatggaggggaggggatatggcaatagtgtagaagtgtcaagatgtgaaaattgctcaactgagaacgcacgcgggggctcgcggcccaacagcctgcaccacactcaggagcctgggcctgggcctgggggtggggtgggggggacaggcgtcccccccaccccaaccccacccctatccctgcccggctgtctaaacggacctaaatgctaacctgctgttgccttgactccagagacacgaaactgaagctagccctcgcccctctctgggatcccgcgctgcgctgcgggtagctgcccgcagggaggcccaacctgccgcggctggagcacggtttctgctagccgccgccgtcaacttgaacttcagtgagcctaggccggcttccttcgcgctcacctccatccaccacctaagaagtcccctcagcgcgagcgtcgctttatccggaggcagctggagccccctcgggaggcccgtcattattattattaattatcgtgatccttactgcattattaatgcccaggatgataaccggcatcggtatcagctttccctggttcagtgatatcccacgaagttcggggcggggaggaagtcactccaggatcagaggccgcgtcggttctgcttggggcatgggcagagggaggctgctggggccaagccccggctggacgcgagggaagaaactcgtcccaggacccgcacgcccatacctggctgtcccagagctcttccctaggccggcaccttcgctcttcctcttccccaccccctagcccttttgtctctttttcagacggatgttttcagtctcaagtggttttattttccgcacaaaaccctgagatcaagggcagatcacagactgtaccggaggctcgggtttccctggactctgtgctgttctgcgtcccagggttggctaggaaggaaggcctgggccggcgaggtgacgggtctcccgcccaggtcggcaggacggggggaggtgtgtcccggtaggtccctggtgagctcacccgtggcatcggggacccgcgggaacccaccgggcgcccactagagactcgggtcctaccctcccccacactactccaccgaaatgatcggaagggcgcgctaggcctgcttc

SEQ ID NO: 109117 - DNA, 204 bp, Homo sapiens
  misc_feature 1..204: note = chr13:100642886-100643090
  misc_feature 1..204: note = Hyper
  source 1..204: mol_type = genomic DNA
gtgctggggccacctcgtcgccctcccacgtttctcttttgttcccaggagccgacgagcttttgaagaggtgacacctcgcttcgccttctcctgctctaggccctgccctcgtccagcatccctcctgccccacgaagcgagaggatgctcagcgcagctgccaggcagagagtgtgtggggaggtcccttgcctttgcgcg

SEQ ID NO: 109118 - DNA, 383 bp, Homo sapiens
  misc_feature 1..383: note = chr13:100643150-100643533
  misc_feature 1..383: note = Hyper
  source 1..383: mol_type = genomic DNA
tatgctcacacaccctcacctccttcagcttccgcacctcccagccacaggctcgcgtgagtgggaaggacctgaggccgcagaaatgtgggttagcgtgggcagcaggagatgctccccgcacccctcctcccattcctacctcccccagccctttctagcgcctcttggaggggaccgggcctgccctgcgctctcaacctaattcggcctcggagggtcctcccccacccagggcggcactccccaggccggcactcgcgccactggcgtgggactaaggctccctgcagttgggtctcccaagcccacttccaggggctgagagaggccaggctgccttgcctgcccgcgcgccctccagccctcgggtgtagggaggg

SEQ ID NO: 109119 - DNA, 516 bp, Homo sapiens
  misc_feature 1..516: note = chr13:100643736-100644252
  misc_feature 1..516: note = Hyper
  source 1..516: mol_type = genomic DNA
gtcagagataatcatcgcagttaacgctcagcgactgggctgctccgcggaggccggcggaggcctacagaggctcctgactggcagaactggaggtgtgggtgtggttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttcccgaaactctttggagtcgcctgggtctgcgtgcccctggccccgtcctcacccccgggctcgtcccccagcctccgccggcccgcctgtgaatggtggatttaatgagcgtttgtgtggcgttggccggcggttctgaagatgcgctgacctggagggagggcgcgaaaggtcaggcgcatgccgggcccaacttggg

SEQ ID NO: 109120 - DNA, 405 bp, Homo sapiens; identical to SEQ ID NO: 75384
  misc_feature 1..405: note = chr13:100647898-100648303
  misc_feature 1..405: note = Hyper
  source 1..405: mol_type = genomic DNA

SEQ ID NO: 109121 - DNA, 686 bp, Homo sapiens
  misc_feature 1..686: note = chr13:100649333-100650019
  misc_feature 1..686: note = Hyper
  source 1..686: mol_type = genomic DNA
ccctgggcgcagggctgtgtgtgcgaggacaattattttcatcagctgcttgctagcccgcgcccgactgctcctctttgcagaaccgacgggctttcaactctggaagtgaagcaggacgaattcctccatggagactccctccttgggaacgtcgaactctctctgccttggggagtggggctcgataaagggtacctaggtcgcaccctggcaggggagcactagagggccgcgaggtcccgggtttcgccatcctgagacccccgcgcggatggcccaggaggggcgcggcggccctgagtcaaggtgggcgggggcaggtgcttccctccaccgcgttgtcctatgccggcgcggtccccaccgcccgacctagcccggcgccggccgagcacggcggccgcgcttcgcactccttcctcccaccgggtccgcaggcccggcttcacgattcccgggccctcgggcatgtgagggacttgagtgaatgcagctccctcaactcactcccgcaaaaccacagccaagagggccttaagtcagagaacccggcctaggagcctcccctagagcctcggcgcgggccccttccccttccccacatcggtcggccgagggagcctagagccggtgggagacgggcagcggcctctcctgatcctttcctgcggtcatacaagttc

SEQ ID NO: 109122 - DNA, 30 bp, Homo sapiens; identical to SEQ ID NO: 75388
  misc_feature 1..30: note = chr13:101298018-101298048
  misc_feature 1..30: note = Hypo
  source 1..30: mol_type = genomic DNA

SEQ ID NO: 109123 - DNA, 31 bp, Homo sapiens; identical to SEQ ID NO: 75389
  misc_feature 1..31: note = chr13:101532259-101532290
  misc_feature 1..31: note = Hypo
  source 1..31: mol_type = genomic DNA

SEQ ID NO: 109124 - DNA, 30 bp, Homo sapiens; identical to SEQ ID NO: 75390
  misc_feature 1..30: note = chr13:101714425-101714455
  misc_feature 1..30: note = Hypo
  source 1..30: mol_type = genomic DNA

SEQ ID NO: 109125 - DNA, 30 bp, Homo sapiens; identical to SEQ ID NO: 75391
  misc_feature 1..30: note = chr13:101787561-101787591
  misc_feature 1..30: note = Hypo
  source 1..30: mol_type = genomic DNA

SEQ ID NO: 109126 - DNA, 1017 bp, Homo sapiens
  misc_feature 1..1017: note = chr13:102068158-102069175
  misc_feature 1..1017: note = Hyper
  source 1..1017: mol_type = genomic DNA
ccccacctccccacccgcgcgttggcccagaggtttacccaggcagcggccctggtgccgagggggcaggtgcagcgctgtagtgatgcccagtggcctcgtcctcagccacctgccccccaacacctgctagatgcccaggcggggcaggcccgaggtgtcgccggccctgggcttcccaagccagcccaggggcatcccgcggcaggcgcccccgacacccacgcgcaggaatagggagggcgcatcgcggctcccgcgccccggccaggccggcaaggaccccaccgccccgctctcgggtggaggcgcccctccccacccctcccccgcgcggggcccccgcccgcagcccctctagcagcccctctcgcagccccagcgcccctgagccgtcctggcccggaccggccaaggaactaacgagcgcgcatcgcgggcctcgggcgcagggcacggagccggccgcgccgcagcctcccgggcaccggcggcggtgaccaacctgtaaccccagcgctcagagctgtcatggtgcccgcgggcggcggcggcggcgacagtgggcgaccggcaggatcagtgccaggcgcggcgcccagggcgggcggggacgcgggcccctcacctacggcggctcagctcaggcagcgcgctcggcccggctggggccgcggctcacgctcgccgtgtcactcactgagcgccgccgccgccgggcaggctgggggaggggtgggagccggagttttcgggcctttaaaaaattattattttatttaaatttttaaagttagctttgctacagggactgcagtgatgccgaagggcgggcaccgcagaggaggctgcgccgcagttggtggggagcgccagggtcggtactggcagttccttcttgccggctgccacccgcagtcagtctcacagcaacagctaggctctcatctgcgagctcctctcgggggtctttcgtactcaacagcacggcggcggtgtgcacgggagtccgccggg

SEQ ID NO: 109127 - DNA, 30 bp, Homo sapiens; identical to SEQ ID NO: 43836
  misc_feature 1..30: note = chr13:102206088-102206118
  misc_feature 1..30: note = Hypo
  source 1..30: mol_type = genomic DNA

SEQ ID NO: 109128 - DNA, 30 bp, Homo sapiens; identical to SEQ ID NO: 43837
  misc_feature 1..30: note = chr13:102385630-102385660
  misc_feature 1..30: note = Hypo
  source 1..30: mol_type = genomic DNA

SEQ ID NO: 109129 - DNA, 1585 bp, Homo sapiens
  misc_feature 1..1585: note = chr13:102568410-102569995
  misc_feature 1..1585: note = Hyper
  source 1..1585: mol_type = genomic DNA
gctcagatcagactgcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaatccctccagcaccaacgcccccccgtcgccacccccaaccc

SEQ ID NO: 109130 - DNA, 46 bp, Homo sapiens; identical to SEQ ID NO: 75401
  misc_feature 1..46: note = chr13:102571921-102571967
  misc_feature 1..46: note = Hyper
  source 1..46: mol_type = genomic DNA

SEQ ID NO: 109131 - DNA, 46 bp, Homo sapiens; identical to SEQ ID NO: 75402
  misc_feature 1..46: note = chr13:102572229-102572275
  misc_feature 1..46: note = Hyper
  source 1..46: mol_type = genomic DNA

SEQ ID NO: 109132 - DNA, 663 bp, Homo sapiens
  misc_feature 1..663: note = chr13:103046665-103047328
  misc_feature 1..663: note = Hyper
  source 1..663: mol_type = genomic DNA
cacatggggtgcccccgcgtcaacgccggaggagtgaccttgcaaacccgcgccccgcgggcggcagagccggccgctcactgcccggtccccggccaccacggaagagcgaagatctctgccagggcaggagccctagccccgacccgcgccccaagtctctcccgcgcggcggcttccggccgccatggtttccatagcaacaacagcacaagctgccgggtcccagagacgccctagggtcagaggtcatctccgtggcaacggaaacttcccgcgctacggcggctccaacgggccgcttccgccgcattgcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccc

SEQ ID NO: 109133 - DNA, 1329 bp, Homo sapiens
  misc_feature 1..1329: note = chr13:103052094-103053423
  misc_feature 1..1329: note = Hyper
  source 1..1329: mol_type = genomic DNA
aggagggtaaaaggacggaggaggaggaaacagatggggtgaatagaaacggtgtaagaactagaacacagggaggaggactcagggcagagcccagagcccactgcagcaccgagtccacggagcagccagaggctactaccagagcctcaattgccaccccaaagtaccagctgggggcaatcttctccgccccagcataggagcctctgcccttttagactgtctaacaactcgcagtttctcctttgctgcaggaatggtggccgcaaacggtctcagcctccgcacccaccgcctccgtccccgcccacccgcacctcctcctcctctgcctcgcgctgcacccgcaggcggcagacccctcggagcgcgccaccccagctacgttgcattggcaaggttcggaggctggagggcagcagccacttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgccgccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtgtcagaggcagacagggggaatgagttaatgctcgggcacccggagctggacgggggagggacgcgggggctgacggaggagcggggccgcgagggagggggcctcttttactttggtaaaggtgatcgtggtggcgaatattgtgcaagctaatcagaaagtctagagcaggttctcggaacccagctacg

SEQ ID NO: 109134 - DNA, 189 bp, Homo sapiens; identical to SEQ ID NO: 75408
  misc_feature 1..189: note = chr13:103054542-103054731
  misc_feature 1..189: note = Hyper
  source 1..189: mol_type = genomic DNA

SEQ ID NO: 109135 - DNA, 133 bp, Homo sapiens; identical to SEQ ID NO: 75409
  misc_feature 1..133: note = chr13:103157771-103157904
  misc_feature 1..133: note = Hypo
  source 1..133: mol_type = genomic DNA

SEQ ID NO: 109136 - DNA, 30 bp, Homo sapiens; identical to SEQ ID NO: 75410
  misc_feature 1..30: note = chr13:103451013-103451043
  misc_feature 1..30: note = Hyper
  source 1..30: mol_type = genomic DNA

SEQ ID NO: 109137 - DNA, 27 bp, Homo sapiens
  misc_feature 1..27: note = chr13:103569166-103569193
  misc_feature 1..27: note = Hypo
  source 1..27: mol_type = genomic DNA
ccggccgtcccccgttaatcttactcc

SEQ ID NO: 109138 - DNA, 30 bp, Homo sapiens; identical to SEQ ID NO: 75412
  misc_feature 1..30: note = chr13:103598335-103598365
  misc_feature 1..30: note = Hypo
  source 1..30: mol_type = genomic DNA

SEQ ID NO: 109139 - DNA, 163 bp, Homo sapiens; identical to SEQ ID NO: 75413
  misc_feature 1..163: note = chr13:103724063-103724226
  misc_feature 1..163: note = Hypo
  source 1..163: mol_type = genomic DNA

SEQ ID NO: 109140 - DNA, 23 bp, Homo sapiens
  misc_feature 1..23: note = chr13:103931640-103931663
  misc_feature 1..23: note = Hypo
  source 1..23: mol_type = genomic DNA
tatagaaaacctggccgggcgcg

SEQ ID NO: 109141 - DNA, 21 bp, Homo sapiens
  misc_feature 1..21: note = chr13:104514710-104514731
  misc_feature 1..21: note = Hypo
  source 1..21: mol_type = genomic DNA
cccggccgagaattttatgta

SEQ ID NO: 109142 - DNA, 30 bp, Homo sapiens; identical to SEQ ID NO: 75416
  misc_feature 1..30: note = chr13:104659524-104659554
  misc_feature 1..30: note = Hypo
  source 1..30: mol_type = genomic DNA

SEQ ID NO: 109143 - DNA, 19 bp, Homo sapiens
  misc_feature 1..19: note = chr13:105886013-105886032
  misc_feature 1..19: note = Hypo
  source 1..19: mol_type = genomic DNA
ttttttcttttgagacgga

SEQ ID NO: 109144 - DNA, 18 bp, Homo sapiens
  misc_feature 1..18: note = chr13:106549803-106549821
  misc_feature 1..18: note = Hypo
  source 1..18: mol_type = genomic DNA
actcggcccattatcaat

SEQ ID NO: 109145 - DNA, 39 bp, Homo sapiens; identical to SEQ ID NO: 75419
  misc_feature 1..39: note = chr13:107001648-107001687
  misc_feature 1..39: note = Hyper
  source 1..39: mol_type = genomic DNA

SEQ ID NO: 109146 - DNA, 496 bp, Homo sapiens; identical to SEQ ID NO: 75420
  misc_feature 1..496: note = chr13:107186664-107187160
  misc_feature 1..496: note = Hyper
  source 1..496: mol_type = genomic DNA

SEQ ID NO: 109147 - DNA, 70 bp, Homo sapiens; identical to SEQ ID NO: 75421
  misc_feature 1..70: note = chr13:107188738-107188808
  misc_feature 1..70: note = Hyper
  source 1..70: mol_type = genomic DNA

SEQ ID NO: 109148 - DNA, 30 bp, Homo sapiens; identical to SEQ ID NO: 75422
  misc_feature 1..30: note = chr13:107189087-107189117
  misc_feature 1..30: note = Hyper
  source 1..30: mol_type = genomic DNA

SEQ ID NO: 109149 - DNA, 30 bp, Homo sapiens; identical to SEQ ID NO: 75423
  misc_feature 1..30: note = chr13:107323934-107323964
  misc_feature 1..30: note = Hypo
  source 1..30: mol_type = genomic DNA

SEQ ID NO: 109150 - DNA, 37 bp, Homo sapiens; identical to SEQ ID NO: 75424
  misc_feature 1..37: note = chr13:107552994-107553031
  misc_feature 1..37: note = Hypo
  source 1..37: mol_type = genomic DNA

SEQ ID NO: 109151 - DNA, 245 bp, Homo sapiens; identical to SEQ ID NO: 75425
  misc_feature 1..245: note = chr13:107570101-107570346
  misc_feature 1..245: note = Hyper
  source 1..245: mol_type = genomic DNA

SEQ ID NO: 109152 - DNA, 22 bp, Homo sapiens
  misc_feature 1..22: note = chr13:108122378-108122400
  misc_feature 1..22: note = Hypo
  source 1..22: mol_type = genomic DNA
ccacgcccgaccaactatgtat

SEQ ID NO: 109153 - DNA, 143 bp, Homo sapiens; identical to SEQ ID NO: 43839
  misc_feature 1..143: note = chr13:108218849-108218992
  misc_feature 1..143: note = Hypo
  source 1..143: mol_type = genomic DNA

SEQ ID NO: 109154 - DNA, 30 bp, Homo sapiens; identical to SEQ ID NO: 75428
  misc_feature 1..30: note = chr13:108518091-108518121
  misc_feature 1..30: note = Hyper
  source 1..30: mol_type = genomic DNA

SEQ ID NO: 109155 - DNA, 277 bp, Homo sapiens
  misc_feature 1..277: note = chr13:108518380-108518657
  misc_feature 1..277: note = Hyper
  source 1..277: mol_type = genomic DNA
gtccgcattctccaccgtgaagcactggcccgaggacgcgccctgggggtaacaagtctccaggcgccacacgggcttggcagagtttcctagaaaaagagccttgccccggtcgtctttgcctcggttgcccttgccgccgccgccgccgccgtctcccggggaggggggcagggtgggggacgaggaggcggagaggagtctgtgtgcctgggcggcgggcgaggactcccccatgctcgccaggagcgcgggccaggagggctcctgctgccgc

SEQ ID NO: 109156 - DNA, 216 bp, Homo sapiens; identical to SEQ ID NO: 75430
  misc_feature 1..216: note = chr13:108518717-108518933
  misc_feature 1..216: note = Hyper
  source 1..216: mol_type = genomic DNA

SEQ ID NO: 109157 - DNA, 156 bp, Homo sapiens; identical to SEQ ID NO: 35076
  misc_feature 1..156: note = chr13:108519254-108519410
  misc_feature 1..156: note = Hyper
  source 1..156: mol_type = genomic DNA

SEQ ID NO: 109158 - DNA, 310 bp, Homo sapiens
  misc_feature 1..310: note = chr13:108519622-108519932
  misc_feature 1..310: note = Hyper
  source 1..310: mol_type = genomic DNA
ccccaccccccaccccgcgctctaagtgctgccgccgccgccgccgccgccgccgctgccgcagggccgcccgcgggcgccgccgccggggctccgactgctgacgccgcctcccgcggagctccgggccgaatcgcctgggctgggcctcccgagagccacagtcatcttcagtccgcgggctaagttgccgccatcttcgtcctggagaaacacttttttggggggagcgctggcttttgcgtcatctcctcccgcgccgagctcgctccatcctggcgcagtggcgccggctcggcccgggaggagg

SEQ ID NO: 109159 - DNA, 408 bp, Homo sapiens
  misc_feature 1..408: note = chr13:108520465-108520873
  misc_feature 1..408: note = Hyper
  source 1..408: mol_type = genomic DNA
ctattctaaagtaaacgattagaagtggcctcatagagtcttaggaagaaacagtaagccctgtgccacccggggtcactgcctagccctgccctccgcgcgcaccgtccgcgtctccgagggctcctcctcggacctggaccctctggagcggcttcgaccctccctctgcccccgctgcctgcgtccagaccccctcccgggtgggctcctccgaggacctccgcagccgcgggcgagctgggtgcctgcgagtcgccgccgcagtctgagcctctggtgccccttagcgttggctctcggagttctgagaagggaaaggagacagacactctgggaaaatctggggtcacctcgattccggctcctacgctggatgccgtgggcaagcatcggtctcctttgatc

SEQ ID NO: 109160 - DNA, 1455 bp, Homo sapiens
  misc_feature 1..1455: note = chr13:109147577-109149032
  misc_feature 1..1455: note = Hyper
  source 1..1455: mol_type = genomic DNA
cactgccacagtccccgcgatggcctttgttctgttaggactccccagggggacctcggctccaggtcacagctctgggcactcccttctcctcctgctcccaggatcttgctaaagtggagacggaaggaaaagtttcaggagtgagctgcgttcttagaattgtagcagagagagaggagggagagagcagaggatcggagggcaggagtggagagaggcgcggtctcctggaacgcgcgggggaacgtggaaaggagggcgcgggagacccggagggctgccccggcggggattagaagcgaggcgggttcagcgtcctgggcgccgcaggaaagtgacccgcagagcgaggcgcggcgccccgggagctggagctcagccccacgacccgcgctgcggcgggcaccacgcggggggcgcgcggggaggggagaggcggggccggcggggactgtgtcgccgccgacgccgcggctgcgggtcgcagaggcgggcagagagagccgccgccgagcgggtggcggagcagtccccagcctccagccggcctggctgcgcgcaaccgcgccggccccgggcacaggggcaactgccgacccctctcacccgccgcgcggggctggtttccgagccgagtcccggccatcgccgcgtcgcctggcgcccggctccggcggacccttctccggcaggtaggggcgtcggcggggcgctgcgcgcggtccaagcgcggggaacgcggcggggcagcctctccgagtctggaggtacgcggggcgcagaggctgttctgcaccgccgggctggggacgccgggagggtgccccgggtcggacttgcggcgctgggtccccacccagagttcccgcacggtgagggttggacgcgtctggggggcgtggagaggaggcttgtcggtcccttcctgggaaaggaatcgcggggacttcccaaccgctaggacgcgtaagccgaggctgggagtagaagccttctgaactctggacctaccccagaaggagggggcgaaactggccatttcgagggacgcggaagccccgttgctaggggagatgggggaagcggcgtggtcacctacacaaccgctcccaggcgcgatgggggctctgcttcctcctcctctgtttctttggggatggaaaagagagcagaacaaagatgtagagtgaaggagggctccccagctgttgcctcttgcgcggattctgctgacccctctgcgcgaccccagctgggcagtgtcagctccattgtctcagaggccggcggccaagtgagggaccagtctcacccggggggcgtcgagcctcagcgcatcgccccgtcttccctggctgcagaaaaccactaggccggtggaagtgctccgtttaattggtccctagtacgcccccgaaaggaaatggagacgatttccgtcaagttctctta

SEQ ID NO: 109161 - DNA, 30 bp, Homo sapiens; identical to SEQ ID NO: 75439
  misc_feature 1..30: note = chr13:109149238-109149268
  misc_feature 1..30: note = Hyper
  source 1..30: mol_type = genomic DNA

SEQ ID NO: 109162 - DNA, 30 bp, Homo sapiens; identical to SEQ ID NO: 75440
  misc_feature 1..30: note = chr13:109779816-109779846
  misc_feature 1..30: note = Hypo
  source 1..30: mol_type = genomic DNA

SEQ ID NO: 109163 - DNA, 200 bp, Homo sapiens
  misc_feature 1..200: note = chr13:109793278-109793478
  misc_feature 1..200: note = Hyper
  source 1..200: mol_type = genomic DNA
caggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggttcacc

SEQ ID NO: 109164 - DNA, 30 bp, Homo sapiens; identical to SEQ ID NO: 75441
  misc_feature 1..30: note = chr13:109917328-109917358
  misc_feature 1..30: note = Hypo
  source 1..30: mol_type = genomic DNA

SEQ ID NO: 109165 - DNA, 30 bp, Homo sapiens; identical to SEQ ID NO: 75442
  misc_feature 1..30: note = chr13:109944512-109944542
  misc_feature 1..30: note = Hypo
  source 1..30: mol_type = genomic DNA

SEQ ID NO: 109166 - DNA, 23 bp, Homo sapiens
  misc_feature 1..23: note = chr13:110053866-110053889
  misc_feature 1..23: note = Hypo
  source 1..23: mol_type = genomic DNA
tacctgagattcaatcgctgagg

SEQ ID NO: 109167 - DNA, 23 bp, Homo sapiens
  misc_feature 1..23: note = chr13:110053949-110053972
  misc_feature 1..23: note = Hypo
  source 1..23: mol_type = genomic DNA
ttttggcccgataaattccattt

SEQ ID NO: 109168 - DNA, 30 bp, Homo sapiens; identical to SEQ ID NO: 75445
  misc_feature 1..30: note = chr13:110174352-110174382
  misc_feature 1..30: note = Hypo
  source 1..30: mol_type = genomic DNA

SEQ ID NO: 109169 - DNA, 30 bp, Homo sapiens; identical to SEQ ID NO: 75446
  misc_feature 1..30: note = chr13:110344624-110344654
  misc_feature 1..30: note = Hypo
  source 1..30: mol_type = genomic DNA

SEQ ID NO: 109170 - DNA, 160 bp, Homo sapiens; identical to SEQ ID NO: 75447
  misc_feature 1..160: note = chr13:110424427-110424587
  misc_feature 1..160: note = Hypo
  source 1..160: mol_type = genomic DNA

SEQ ID NO: 109171 - DNA, 2130 bp, Homo sapiens; identical to SEQ ID NO: 75448
  misc_feature 1..2130: note = chr13:110434379-110436509
  misc_feature 1..2130: note = Hypo
  source 1..2130: mol_type = genomic DNA

SEQ ID NO: 109172 - DNA, 35 bp, Homo sapiens; identical to SEQ ID NO: 75449
  misc_feature 1..35: note = chr13:110438921-110438956
  misc_feature 1..35: note = Hyper
  source 1..35: mol_type = genomic DNA

SEQ ID NO: 109173 - DNA, 45 bp, Homo sapiens; identical to SEQ ID NO: 75450
  misc_feature 1..45: note = chr13:110439819-110439864
  misc_feature 1..45: note = Hyper
  source 1..45: mol_type = genomic DNA

SEQ ID NO: 109174 - DNA, 30 bp, Homo sapiens; identical to SEQ ID NO: 75451
  misc_feature 1..30: note = chr13:110525952-110525982
  misc_feature 1..30: note = Hypo
  source 1..30: mol_type = genomic DNA

SEQ ID NO: 109175 - DNA, 30 bp, Homo sapiens; identical to SEQ ID NO: 43842
  misc_feature 1..30: note = chr13:110659714-110659744
  misc_feature 1..30: note = Hypo
  source 1..30: mol_type = genomic DNA

SEQ ID NO: 109176 - DNA, 30 bp, Homo sapiens; identical to SEQ ID NO: 75453
  misc_feature 1..30: note = chr13:110767621-110767651
  misc_feature 1..30: note = Hypo
  source 1..30: mol_type = genomic DNA

SEQ ID NO: 109177 - DNA, 30 bp, Homo sapiens; identical to SEQ ID NO: 75454
  misc_feature 1..30: note = chr13:110958402-110958432
  misc_feature 1..30: note = Hyper
  source 1..30: mol_type = genomic DNA

SEQ ID NO: 109178 - DNA, 1894 bp, Homo sapiens
  misc_feature 1..1894: note = chr13:110958709-110960603
  misc_feature 1..1894: note = Hyper
  source 1..1894: mol_type = genomic DNA
acttctgccttggagcgcgccttaggcagcagtcgtgggaaagctcagatacagctgtttccaggcaaagggcccagagcttttcagcctcagccaccagggtctccagacaaggagaaatacgcccaaagctgctcccaggggctaggagctcggagctcccagtgtgggtctctgagcagcgcggggtgggcgctcccggccctccagcccccaactccctcgcgcacccgggacgggtgaaggcgcccagctgccgagcatacccgcgacgcgggttcaaatcccgccggctcccaggcaccctcaccccgccacagcgcgggctgtttctcctcccttccccggaggaattccttaactctccagtacccataccataacaaaggaggctcggtccaccaatgcgcgatcgtagcctacagggacccccaacgaaccccggcccagagaatgcacctggccgtgccacgcgcgacccccgaggggcaggcggacgggtccaggcgcggacaaaggggcctctcggggcgcccaagctcggggcgggacgccgggagcggagctggccgggaactcaccttcgcagcggcccggctgtgctcctcgtggagcagaagggcggcgggcagcagcagcagccagacgctgagccggggccccatggtggcgcgcccgaggcggcgagggacggctgcccggcgtgcgggggccgcggcggacagctagctctcggaaggccggacttccagcgctacgcaccgtcccgggtgcggcggctccaagcggagacctgagcgcggcgggccgagctccccaatttgttggcgctgccccctcccccccggcggtgcgcgggcggcgcctcaaaggggaggaccctgcggcgcgggtaagaggcggcgggagcgcgcggcccgggagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccac

SEQ ID NO: 109179 - DNA, 221 bp, Homo sapiens; identical to SEQ ID NO: 35090
  misc_feature 1..221: note = chr13:110960909-110961130
  misc_feature 1..221: note = Hyper
  source 1..221: mol_type = genomic DNA

SEQ ID NO: 109180 - DNA, 97 bp, Homo sapiens; identical to SEQ ID NO: 75461
  misc_feature 1..97: note = chr13:110998830-110998927
  misc_feature 1..97: note = Hypo
  source 1..97: mol_type = genomic DNA

SEQ ID NO: 109181 - DNA, 126 bp, Homo sapiens; identical to SEQ ID NO: 75462
  misc_feature 1..126: note = chr13:110999273-110999399
  misc_feature 1..126: note = Hypo
  source 1..126: mol_type = genomic DNA

SEQ ID NO: 109182 - DNA, 149 bp, Homo sapiens; identical to SEQ ID NO: 43844
  misc_feature 1..149: note = chr13:111144888-111145037
  misc_feature 1..149: note = Hypo
  source 1..149: mol_type = genomic DNA

SEQ ID NO: 109183 - DNA, 30 bp, Homo sapiens; identical to SEQ ID NO: 75464
  misc_feature 1..30: note = chr13:111207973-111208003
  misc_feature 1..30: note = Hypo
  source 1..30: mol_type = genomic DNA

SEQ ID NO: 109184 - DNA, 66 bp, Homo sapiens; identical to SEQ ID NO: 75465
  misc_feature 1..66: note = chr13:111267526-111267592
  misc_feature 1..66: note = Hypo
  source 1..66: mol_type = genomic DNA

SEQ ID NO: 109185 - DNA, 580 bp, Homo sapiens; identical to SEQ ID NO: 75466
  misc_feature 1..580: note = chr13:111277084-111277664
  misc_feature 1..580: note = Hypo
  source 1..580: mol_type = genomic DNA

SEQ ID NO: 109186 - DNA, 105 bp, Homo sapiens; identical to SEQ ID NO: 75467
  misc_feature 1..105: note = chr13:111278321-111278426
  misc_feature 1..105: note = Hypo
  source 1..105: mol_type = genomic DNA

SEQ ID NO: 109187 - DNA, 178 bp, Homo sapiens; identical to SEQ ID NO: 75468
  misc_feature 1..178: note = chr13:111289167-111289345
  misc_feature 1..178: note = Hypo
  source 1..178: mol_type = genomic DNA

SEQ ID NO: 109188 - DNA, 30 bp, Homo sapiens; identical to SEQ ID NO: 75469
  misc_feature 1..30: note = chr13:111337750-111337780
  misc_feature 1..30: note = Hypo
  source 1..30: mol_type = genomic DNA

SEQ ID NO: 109189 - DNA, 88 bp, Homo sapiens; identical to SEQ ID NO: 75470
  misc_feature 1..88: note = chr13:111363884-111363972
  misc_feature 1..88: note = Hypo
  source 1..88: mol_type = genomic DNA

SEQ ID NO: 109190 - DNA, 214 bp, Homo sapiens; identical to SEQ ID NO: 75471
  misc_feature 1..214: note = chr13:111477321-111477535
  misc_feature 1..214: note = Hypo
  source 1..214: mol_type = genomic DNA

SEQ ID NO: 109191 - DNA, 37 bp, Homo sapiens; identical to SEQ ID NO: 75472
  misc_feature 1..37: note = chr13:111682046-111682083
  misc_feature 1..37: note = Hypo
  source 1..37: mol_type = genomic DNA

SEQ ID NO: 109192 - DNA, 39 bp, Homo sapiens; identical to SEQ ID NO: 75473
  misc_feature 1..39: note = chr13:111704359-111704398
  misc_feature 1..39: note = Hypo
  source 1..39: mol_type = genomic DNA

SEQ ID NO: 109193 - DNA, 30 bp, Homo sapiens; identical to SEQ ID NO: 75474
  misc_feature 1..30: note = chr13:111745610-111745640
  misc_feature 1..30: note = Hypo
  source 1..30: mol_type = genomic DNA

SEQ ID NO: 109194 - DNA, 30 bp, Homo sapiens; identical to SEQ ID NO: 43850
  misc_feature 1..30: note = chr13:111764740-111764770
  misc_feature 1..30: note = Hypo
  source 1..30: mol_type = genomic DNA

SEQ ID NO: 109195 - DNA, 146 bp, Homo sapiens; identical to SEQ ID NO: 75476
  misc_feature 1..146: note = chr13:111766799-111766945
  misc_feature 1..146: note = Hyper
  source 1..146: mol_type = genomic DNA

SEQ ID NO: 109196 - DNA, 1295 bp, Homo sapiens
  misc_feature 1..1295: note = chr13:111767213-111768508
  misc_feature 1..1295: note = Hyper
  source 1..1295: mol_type = genomic DNA
tgcaaggtagcaaagcgaaacaaacgtctcgttttcagcctgtccccgccaccttgaaataaaaccggcaaaaataaaaagagcattctgggaagtacttcatcatttcaacgctcacgaattcaaaacataaacaaaggcttccgagtgccccggccaggggcgcggggcgcacggcgggcccggggcaggtaagcgcaggtgcgcgcccgcccccacccccggctccctccccatccgctccccgctccccttcccctttcccttccccgcccgctcccagccgccgccgccgccccgcgcacggcctggagcggaggctgcgcagggcgcggggcggcgcgggccgggcgcgggccgggcggacggccgcgtctttcttctcctggcggtgatgtcattgggcgacggcggccgaggccggggggcggcggcgggcgcccgcaggttcccgagccgctcctgagaaggcgcctgacagcgggccggggcgcacggagaagcgggccgggccggacctgctgggccgcgccgagccaatcgccggcgccggccgctcgatgggcgaggcggcggcggcggcggcgggggccgcgggccgggccgccgctccgaggtgaaggcgcgcgcccctccccgcctgcctcccgggccgcagcgatgaattccgccgagcaaaccgttacgtggctcatcactctgggggtgctggagtcgcccaaaaaaaccatctcggacccggagggctttctgcaggcgtcgctgaaggatggggtggtcctctgcaggctgctggagcgcctgctccccgggaccatcgagaaagtaagtcccggcccgcgcccccgcccgcgccccccggtccggcccgctgcggcccgggatgcgcgcggagcacctgaggccggccgcgctcgggaaacccgtgcgccctcctttgtgcgcggagcggcggcgcggccggcgccaggaccgtggcgggagctcggggggcgccattgtgtgcggggcagggggagggggccggggagcggggtcggggggaggggcggcgcgggcggcgggggtccccgggaaggagagtgcaccgcagcgaggagacggggcttctgcgccgcccgaacgctaagttgcccctccgcgtggggggccggccccgctccctggcagcagccgcatcggaaaccgcgttccgacgcggtgcggctcactccgctggctttgtgtggacagttcttgccggtggcgttgcgtgagtttcgcctcccaggttaattgaccggttgctctgtatt

SEQ ID NO: 109197 - DNA, 30 bp, Homo sapiens; identical to SEQ ID NO: 75479
  misc_feature 1..30: note = chr13:111768797-111768827
  misc_feature 1..30: note = Hyper
  source 1..30: mol_type = genomic DNA

SEQ ID NO: 109198 - DNA, 30 bp, Homo sapiens; identical to SEQ ID NO: 75480
  misc_feature 1..30: note = chr13:111773890-111773920
  misc_feature 1..30: note = Hypo
  source 1..30: mol_type = genomic DNA

SEQ ID NO: 109199 - DNA, 30 bp, Homo sapiens; identical to SEQ ID NO: 75481
  misc_feature 1..30: note = chr13:111797673-111797703
  misc_feature 1..30: note = Hypo
  source 1..30: mol_type = genomic DNA

SEQ ID NO: 109200 - DNA, 30 bp, Homo sapiens; identical to SEQ ID NO: 75482
  misc_feature 1..30: note = chr13:111932841-111932871
  misc_feature 1..30: note = Hypo
  source 1..30: mol_type = genomic DNA

SEQ ID NO: 109201 - DNA, 30 bp, Homo sapiens; identical to SEQ ID NO: 75483
  misc_feature 1..30: note = chr13:111972934-111972964
  misc_feature 1..30: note = Hypo
  source 1..30: mol_type = genomic DNA

SEQ ID NO: 109202 - DNA, 408 bp, Homo sapiens; identical to SEQ ID NO: 75484
  misc_feature 1..408: note = chr13:111978537-111978945
  misc_feature 1..408: note = Hypo
  source 1..408: mol_type = genomic DNA

SEQ ID NO: 109203 - DNA, 137 bp, Homo sapiens; identical to SEQ ID NO: 75485
  misc_feature 1..137: note = chr13:111997459-111997596
  misc_feature 1..137: note = Hypo
  source 1..137: mol_type = genomic DNA

SEQ ID NO: 109204 - DNA, 30 bp, Homo sapiens; identical to SEQ ID NO: 75486
  misc_feature 1..30: note = chr13:112052769-112052799
  misc_feature 1..30: note = Hypo
  source 1..30: mol_type = genomic DNA

SEQ ID NO: 109205 - DNA, 149 bp, Homo sapiens; identical to SEQ ID NO: 75487
  misc_feature 1..149: note = chr13:112060039-112060188
  misc_feature 1..149: note = Hypo
  source 1..149: mol_type = genomic DNA

SEQ ID NO: 109206 - DNA, 30 bp, Homo sapiens; identical to SEQ ID NO: 43852
  misc_feature 1..30: note = chr13:112062748-112062778
  misc_feature 1..30: note = Hypo
  source 1..30: mol_type = genomic DNA

SEQ ID NO: 109207 - DNA, 187 bp, Homo sapiens; identical to SEQ ID NO: 75489
  misc_feature 1..187: note = chr13:112078320-112078507
  misc_feature 1..187: note = Hypo
  source 1..187: mol_type = genomic DNA

SEQ ID NO: 109208 - DNA, 60 bp, Homo sapiens; identical to SEQ ID NO: 75490
  misc_feature 1..60: note = chr13:112090514-112090574
  misc_feature 1..60: note = Hypo
  source 1..60: mol_type = genomic DNA

SEQ ID NO: 109209 - DNA, 30 bp, Homo sapiens; identical to SEQ ID NO: 75491
  misc_feature 1..30: note = chr13:112165349-112165379
  misc_feature 1..30: note = Hypo
  source 1..30: mol_type = genomic DNA

SEQ ID NO: 109210 - DNA, 30 bp, Homo sapiens; identical to SEQ ID NO: 75492
  misc_feature 1..30: note = chr13:112172192-112172222
  misc_feature 1..30: note = Hypo
  source 1..30: mol_type = genomic DNA

SEQ ID NO: 109211 - DNA, 111 bp, Homo sapiens; identical to SEQ ID NO: 75493
  misc_feature 1..111: note = chr13:112192088-112192199
  misc_feature 1..111: note = Hypo
  source 1..111: mol_type = genomic DNA

SEQ ID NO: 109212 - DNA, 30 bp, Homo sapiens; identical to SEQ ID NO: 75494
  misc_feature 1..30: note = chr13:112196610-112196640
  misc_feature 1..30: note = Hypo
  source 1..30: mol_type = genomic DNA

SEQ ID NO: 109213 - DNA, 272 bp, Homo sapiens; identical to SEQ ID NO: 75495
  misc_feature 1..272: note = chr13:112200634-112200906
  misc_feature 1..272: note = Hypo
  source 1..272: mol_type = genomic DNA

SEQ ID NO: 109214 - DNA, 30 bp, Homo sapiens
  misc_feature 1..30: note = chr13:112225369-112225399
  misc_feature 1..30: note = Hypo
  source 1..30: mol_type = genomic DNA
cagtgccggcagaagcgcgttcggctccat

SEQ ID NO: 109215 - DNA, 66 bp, Homo sapiens; identical to SEQ ID NO: 75496
  misc_feature 1..66: note = chr13:112236766-112236832
  misc_feature 1..66: note = Hypo
  source 1..66: mol_type = genomic DNA

SEQ ID NO: 109216 - DNA, 30 bp, Homo sapiens; identical to SEQ ID NO: 43855
  misc_feature 1..30: note = chr13:112243149-112243179
  misc_feature 1..30: note = Hypo
  source 1..30: mol_type = genomic DNA

SEQ ID NO: 109217 - DNA, 79 bp, Homo sapiens; identical to SEQ ID NO: 75498
  misc_feature 1..79: note = chr13:112272942-112273021
  misc_feature 1..79: note = Hypo
  source 1..79: mol_type = genomic DNA

SEQ ID NO: 109218 - DNA, 30 bp, Homo sapiens; identical to SEQ ID NO: 75499
  misc_feature 1..30: note = chr13:112274381-112274411
  misc_feature 1..30: note = Hypo
  source 1..30: mol_type = genomic DNA

SEQ ID NO: 109219 - DNA, 68 bp, Homo sapiens; identical to SEQ ID NO: 43857
  misc_feature 1..68: note = chr13:112274715-112274783
  misc_feature 1..68: note = Hypo
  source 1..68: mol_type = genomic DNA

SEQ ID NO: 109220 - DNA, 36 bp, Homo sapiens; identical to SEQ ID NO: 75501
  misc_feature 1..36: note = chr13:112276380-112276416
  misc_feature 1..36: note = Hypo
  source 1..36: mol_type = genomic DNA

SEQ ID NO: 109221 - DNA, 30 bp, Homo sapiens; identical to SEQ ID NO: 75502
  misc_feature 1..30: note = chr13:112309025-112309055
  misc_feature 1..30: note = Hypo
  source 1..30: mol_type = genomic DNA

SEQ ID NO: 109222 - DNA, 179 bp, Homo sapiens; identical to SEQ ID NO: 75503
  misc_feature 1..179: note = chr13:112320583-112320762
  misc_feature 1..179: note = Hypo
  source 1..179: mol_type = genomic DNA

SEQ ID NO: 109223 - DNA, 32 bp, Homo sapiens; identical to SEQ ID NO: 75504
  misc_feature 1..32: note = chr13:112321043-112321075
  misc_feature 1..32: note = Hypo
  source 1..32: mol_type = genomic DNA

SEQ ID NO: 109224 - DNA, 30 bp, Homo sapiens; identical to SEQ ID NO: 75505
  misc_feature 1..30: note = chr13:112323073-112323103
  misc_feature 1..30: note = Hypo
  source 1..30: mol_type = genomic DNA

SEQ ID NO: 109225 - DNA, 167 bp, Homo sapiens; identical to SEQ ID NO: 75506
  misc_feature 1..167: note = chr13:112341901-112342068
  misc_feature 1..167: note = Hypo
  source 1..167: mol_type = genomic DNA

SEQ ID NO: 109226 - DNA, 30 bp, Homo sapiens; identical to SEQ ID NO: 75507
  misc_feature 1..30: note = chr13:112347214-112347244
  misc_feature 1..30: note = Hypo
  source 1..30: mol_type = genomic DNA

SEQ ID NO: 109227 - DNA, 36 bp, Homo sapiens; identical to SEQ ID NO: 75508
  misc_feature 1..36: note = chr13:112512707-112512743
  misc_feature 1..36: note = Hypo
  source 1..36: mol_type = genomic DNA

SEQ ID NO: 109228 - DNA, 116 bp, Homo sapiens; identical to SEQ ID NO: 75509
  misc_feature 1..116: note = chr13:112513008-112513124
  misc_feature 1..116: note = Hypo
  source 1..116: mol_type = genomic DNA

SEQ ID NO: 109229 - DNA, 325 bp, Homo sapiens; identical to SEQ ID NO: 75510
  misc_feature 1..325: note = chr13:112553503-112553828
  misc_feature 1..325: note = Hypo
  source 1..325: mol_type = genomic DNA

SEQ ID NO: 109230 - DNA, 64 bp, Homo sapiens; identical to SEQ ID NO: 75511
  misc_feature 1..64: note = chr13:112558994-112559058
  misc_feature 1..64: note = Hypo
  source 1..64: mol_type = genomic DNA

SEQ ID NO: 109231 - DNA, 62 bp, Homo sapiens; identical to SEQ ID NO: 75512
  misc_feature 1..62: note = chr13:112559680-112559742
  misc_feature 1..62: note = Hypo
  source 1..62: mol_type = genomic DNA

SEQ ID NO: 109232 - DNA, 60 bp, Homo sapiens; identical to SEQ ID NO: 75513
  misc_feature 1..60: note = chr13:112573418-112573478
  misc_feature 1..60: note = Hypo
  source 1..60: mol_type = genomic DNA

SEQ ID NO: 109233 - DNA, 35 bp, Homo sapiens; identical to SEQ ID NO: 43861
  misc_feature 1..35: note = chr13:112573696-112573731
  misc_feature 1..35: note = Hypo
  source 1..35: mol_type = genomic DNA

SEQ ID NO: 109234 - DNA, 81 bp, Homo sapiens; identical to SEQ ID NO: 75515
  misc_feature 1..81: note = chr13:112618899-112618980
  misc_feature 1..81: note = Hypo
  source 1..81: mol_type = genomic DNA

SEQ ID NO: 109235 - DNA, 30 bp, Homo sapiens; identical to SEQ ID NO: 75516
  misc_feature 1..30: note = chr13:112679985-112680015
  misc_feature 1..30: note = Hypo
  source 1..30: mol_type = genomic DNA

SEQ ID NO: 109236 - DNA, 58 bp, Homo sapiens; identical to SEQ ID NO: 75517
  misc_feature 1..58: note = chr13:112682842-112682900
  misc_feature 1..58: note = Hypo
  source 1..58: mol_type = genomic DNA

SEQ ID NO: 109237 - DNA, 270 bp, Homo sapiens; identical to SEQ ID NO: 75518
  misc_feature 1..270: note = chr13:112690736-112691006
  misc_feature 1..270: note = Hypo
  source 1..270: mol_type = genomic DNA

SEQ ID NO: 109238 - DNA, 1070 bp, Homo sapiens
  misc_feature 1..1070: note = chr13:112707631-112708701
  misc_feature 1..1070: note = Hyper
  source 1..1070: mol_type = genomic DNA
tcctgttcccatgtgcggttggtgtcggagttagacatcatcaagaggtgaaaatttgggaagacatttcaaggatgacggaagctctgagtgagtgaacagatattcttcgtgcagaataatcccccgtggcactggtttgccggcagagcagaatgtttgagacctcaccccgcagccacgcgcgggcgtaaatcgttctcagcacgagaaacacaaaggccgcaggatcccgcgagccgcagggggttggggtcatttttttgatgccgccgcccttaagagttccagtccttcaggcgaaaggggcagatcaggccttcggggaggacccttgcctgggagagggagggcagtgccccaggggccgcctccggtgcctaaacaaagaagacggtcttctgagcgtccgccctccccgcctcgccgcgcaaggaccccgcgctcctgggccacttcctcttgcaaaccacgaggaaaagccagtttccacccagacggccggctgtgggcaaagggaataaagcgccggtgccgccacgctctgcacttggctctgggcctggcgggggtctggcgcggccgcagacacctgggtgacctgggccgtggttgccggctctgctcggacagagagtctttttatttgtcgcctccgccttctcaccactgaggccgcaggacagcctcgctgcccggggccgagttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacacccccatgccctgcaaggctccttggccctgcttctcctctgtctcggcgggagaggagcagcctcggttttacagaatttcagggtcgcgtctccagcgccccgggcgaggccactacgtttaggagcgctcgccttcgctgcgctgtgtaccgtgtacacactggctccgtgcgcgagaccccgatgtg

SEQ ID NO: 109239 - DNA, 30 bp, Homo sapiens; identical to SEQ ID NO: 35097
  misc_feature 1..30: note = chr13:112709027-112709057
  misc_feature 1..30: note = Hyper
  source 1..30: mol_type = genomic DNA

SEQ ID NO: 109240 - DNA, 75 bp, Homo sapiens; identical to SEQ ID NO: 75522
  misc_feature 1..75: note = chr13:112709489-112709564
  misc_feature 1..75: note = Hyper
  source 1..75: mol_type = genomic DNA

SEQ ID NO: 109241 - DNA, 3214 bp, Homo sapiens
  misc_feature 1..3214: note = chr13:112709815-112713029
  misc_feature 1..3214: note = Hyper
  source 1..3214: mol_type = genomic DNA
cagagacccagaccccgagaaacaagtgtggctccagcccaggagcctcacagaacacatttcctcctccgccttcggctctgcgtgggctagccccgcgctagggagggcaggcaactaggtcctccgaggtgaggctggggctccgcctgcagagggagtgacagcgcgccgcgagggtccgcgacccaggcaggggtggccgcaccaccccggagcgccgcacagccccgcaggcctcccctcccgcagtgcgtgcctggaacgcggggccgcctggccgagggacgtttacctggagagctttgtgtccacaacactaatccttagacactgcttcgttcagcagctgccgtcagtcgtgagggcactagtgtggggatgggggcgaattcaggagcccgtcgcagagcaatatttaaaaaggggggggggagccggagctgctcccaggggaggcctcgcgcggcggcgcccacggccacggtgtccccgctgcgagccaacaaagctgaggcgctgtccgcgggaggagagagcccagcgcggggaccggcgcgggtgggagtgggggcgcggcgcggaaaaccccagggaaggaccgggtggacacgggacgggaggggggtgacatcctcccacccgggggttagaaaaggtccgggtggtagttccaggcgaaaataggcagccctctgtgatgacagaattgacaactattttttgggggggcgggggttggacttccgagtccctcgggacggaggcgcaggggagcaggaggggtgccccgtccctgcagttgcctcggcccgaatcccgcaggccaggccggaacgcgggggcgggggcgcgggagggggacccgcggcgggaggcgagagcgagcgaatggggagaggagcggggagcaggaggggacgcaggggagaggggactggggagcggcgagaggaggacgggagacgcggctccacctcccagctcaaaacggcgtcccagctgctcgcaaaccaactgctcgattctattcactgtcgagtaggaacaaaaaagtggctatttattagaatacttgtttggtattgttccgcgccacacaaaaggcgtttcattatgtggagggatctcctttttccagagagaaacaataacttgaaattgtctttaaagtcttttctatcaataataaatttcattttcttgtctctctcgcctgcagtgtgtgtgcgcgcgcgcgaggcgaggagagaggcgcgtgtgcgagtgagtgtgctagcgggggtgcgcgtgtgagtgtgcgcgtgtgtgtgcgtgcgcgtggcaccggcgcccgcggctacggggctggcgctgccggagccgggccggaccggggtccgagatctgcgtcgcgctgggcacgctggccacccggtccggaatgagtcggggctccgggaggtgcccgtgggcagagcgttaggggcgcggccgtgccggacccgccctggggacccgctggagctggaggaggaactaactgtaagtgtgtctcgaacttgcgcgggggcttcagcccgcccggggctgcggagctggccggtaaaggctctcgggagaggggcgcggtgtctccacggtgactttccgtgaaggaggatggggtgtctccgcagctttggggccccaggaaagaacaggtgggtagatgtggtggccacggctagcggactcgccgcggggcacatttgtcattttcttatctgtgcgttcactcctcccccatcctcggcttttgggattggccgccgcccaacggacccagactgtttctctctgggtcgccatttttggggaggggggagggaggtcgagtctgtggatttgggggagaggttcttgtccgccacagctccgcgccccctccccgcccctcgcggctcccccaccctcgcgttcggcagcgccaggctgcgctctccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccccaccagcgcggctcacgcctcagtctcgccgccccaaggtgggatccgacgcccaaaggagggcgccccaaggtgggatccgagcgggccgccctaggaggagtgaaccccgcccgggcgcacagctccgtgcgcctgtcctccctcctccagcgaaatcacacccgctttgcctcctcttgcagcaccgcgcgtgcctaggttctcggtctgcgcagctgggagtctcccccaccagcgccgcggagccgcccgcttccgctccctctttccgcgggtttgagcctcccgtggagaggaaaggtcacgaagtttcaaaggtgaaatggattttcggcggtggctggtgcgggagtcaatgggcagggcggggcaagcctggcagtcatcgacccgagcagggacccggctggccgcctccccttgcaggaaacaggtgtttgaacgcgatagcggccgccagtcaactaaggcattaaaagctcgctttataacatcgatttcctggagtgcggtggggcctgcgttctggaagctcgtttgtgaaaggcggggttgggggaattgccctgatggtaccccagttggcgcagaagatccccaaaagtccctgtcaccgcagcggcggacagcggggctgcccaggcggctgggagggcagcttttccctcccgctggggtggaaagaggagtcctgctccgttccccacccaggacaatggtcttgttaccccggcctcctcccctgcacctagggcctggcatgcagagagcgcccgcagcagagggggaagtctccaacaactggcaggtgtcccccgaggagctccgcttgatttggaagggtggttaaaccgggatccaggaggaaagcaattccgttgccacccacatcccctgggccctaccaggcttcttcccctgctagcacatctcccggatgcgacgcaggccaggtggcagggctgaagcaggcaggcacacaggagatggcatgcgtacctgtaaggat

SEQ ID NO: 109242 - DNA, 1190 bp, Homo sapiens
  misc_feature 1..1190: note = chr13:112715163-112716353
  misc_feature 1..1190: note = Hyper
  source 1..1190: mol_type = genomic DNA
aagacttagcttaggcgacttctctaaagaactcaaccaaatctgaaaggcacaggcattttctcctcaaaatccgaggctcgagaaccatctcctctggcagggtccagtctcagctccgcctcttgcctcctcacccacttgggcataacttttgcgggtcctagaaatctgggcagcagaagagggaggggaacgctcccagccggcagccgctctgggcgtgcacccgccacgcgaagccagaggttggacgacgcagccggccaggcgcggctcccgggggaccccgaaaccgcctgtggctcaggccctacttggcaagaagagactggggagtgagaggaggggtcactcttgctctctcgcacaatagacttcccgcaggcgagtgcgaacggccttttgcttcctccttcttttccaggacccttagcgacaggagaggaagagaagcggcccggcggtttaattgccaatttcctgatgcagccacagggcccagcagcggctcagcctaggccaccgggtccaggcctctaggcaataggcccggcgccccctccaagcaccgtttcccgccgaccccgcagtcatcactgtgagctcgagagtatgggcagcctgtggtgccctgaggcgccgggcgctcggcgcatccgccgtgcccacagcgctgaggaccaactagggctgccctcggccaggggcactgtgcccgtttgagtggcactcggacctggcgaggggtggaagcccaggtagagctcgcgtctttaagagccacccgacagaactgcgcgctacatctgcgccagctgggctgggtgggaacagcgcagaaatactcccgtgccggggcgtacagggcaggtaggcccagcagagagtcttctcggaaagtttcccacaaaagaagggccgggcaggccgagcggcaggaaaagccggtgctcagcggcgaggcccgagaggtctggcatccggcggcctcccagctttgctcgggtctcccgccgcctctctccagagccgcccgtagctccgtggggcggagggcgcaatgccccgctctggttccagcctttttcctccccttgtctcctctttcattcataaacctggtggctacagacgcagcttgaatattgacgtctctcccccaactgctctgccgttaacccaattac

SEQ ID NO: 109243 - DNA, 27 bp, Homo sapiens
  misc_feature 1..27: note = chr13:112716607-112716634
  misc_feature 1..27: note = Hyper
  source 1..27: mol_type = genomic DNA
ttcacccagagagctcggaggcacaca

SEQ ID NO: 109244 - DNA, 27 bp, Homo sapiens
  misc_feature 1..27: note = chr13:112716694-112716721
  misc_feature 1..27: note = Hyper
  source 1..27: mol_type = genomic DNA
attgtgaatgtgcggctctccacacga

SEQ ID NO: 109245 - DNA, 989 bp, Homo sapiens
  misc_feature 1..989: note = chr13:112717056-112718045
  misc_feature 1..989: note = Hyper
  source 1..989: mol_type = genomic DNA
atgatggactcagagcgcccagggaccctagagagaggagcactcctcaagagccccctggccatcacccgagcgccctggagcgccatcacccgaacgcgcgctccaggccctcgaacaaggcctctggctgccagagcgagtgaggggcgcagaggcggcagagagcggagagccccggtgtctccgcgagggcggcggcggccagcagacggcgatcgaggcgcgcgccacggcacggccagcgcagacacgccgcggggtctcgggccggagccgtgcagccgggcccgctgcctctttgcccctcatggctccgcgcgggaggaaaccgggccttctccgcccgccctcctctcgctgcggtgtccccagcacccccgccccgcccccgcgcggtccccaccgtcgcgctcccctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgggccagaaaatccacctctagatgcctcaaagctcgctttcatgctggggggcgggcgggagcggggaagggggaca

SEQ ID NO: 109246 - DNA, 2555 bp, Homo sapiens
  misc_feature 1..2555: note = chr13:112720033-112722588
  misc_feature 1..2555: note = Hyper
  source 1..2555: mol_type = genomic DNA
tgctacttgagactgcgtttgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcccgggcctcctcccccctccttcctgctttgctccccctccttcctcccctcctccccgctccgccgcccgcgcccagtgtatctactccctccccacgtcactcgccagcgcgccatgcaaatcaccgccgccgccggctcccattggccgcggcgcgctcatttaatggcagcccgggcccggcgtatggctgctgggccccgcgcgccgccggccccgcgtgcgcctccgctccgagcgcacggccccgggcaggcagcgggcagcccatcccgggctcggcggccccggctctccggccctctccgcgagcccgcgctcctcccgctgtccccgggcccctccctggctgcaccgtaatcgccccctgcaggcccccctgcgcctccccccccccgccactggcgcctggcttcccccgggcacctgggaccagcacatgcccagcgcacgcggcgcgccgccctgctagaagttgcagcctccgagttggaggccgctgaggaccgagcgcaggaggaaggagacagcgcgcagcggcggccggcgaggagacagcacaccccgggccgggcccagcgcaccgctcccggccccaaaagcggagctgcaacttggccacgactgcacctgtttgcaccgctccgccgagggcgcctgggctgcggtggcggcgaagacggcgaccccgaccgtcggcctctttggcaagtggtttgtgcatcaggagaaactttccacctgcgagccgaaccggcgccgagtgcgtgtgtttctgcctttttttgttgtcgttgcctccacccctccccattcttctctccgctaggacccccccgcccccgtctcactccgtctgaattcctctccgtctccctcccaccccggccgtctatgctccaggccctctcctcgcggtgccggtgaacccgccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatga

SEQ ID NO: 109247 - DNA, 880 bp, Homo sapiens
  misc_feature 1..880: note = chr13:112722844-112723724
  misc_feature 1..880: note = Hyper
  source 1..880: mol_type = genomic DNA
gcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctg

SEQ ID NO: 109248 - DNA, 423 bp, Homo sapiens; identical to SEQ ID NO: 75539
  misc_feature 1..423: note = chr13:112724172-112724595
  misc_feature 1..423: note = Hyper
  source 1..423: mol_type = genomic DNA

SEQ ID NO: 109249 - DNA, 190 bp, Homo sapiens; identical to SEQ ID NO: 75540
  misc_feature 1..190: note = chr13:112725278-112725468
  misc_feature 1..190: note = Hyper
  source 1..190: mol_type = genomic DNA

SEQ ID NO: 109250 - DNA, 45 bp, Homo sapiens; identical to SEQ ID NO: 35116
  misc_feature 1..45: note = chr13:112725825-112725870
  misc_feature 1..45: note = Hyper
  source 1..45: mol_type = genomic DNA

SEQ ID NO: 109251 - DNA, 2058 bp, Homo sapiens
  misc_feature 1..2058: note = chr13:112726292-112728350
  misc_feature 1..2058: note = Hyper
  source 1..2058: mol_type = genomic DNA
ccggagaaacccacccgtaacgtactagatggattagttttaaagaagactcgggcacagcgtgatctccagatgcgcgtcgggagcgtgactgataggtctattaaaatcacgcgtgtgggagaacggcactcatgctcccgcgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttggcgcggctctctttccagcgtgactatctggcgagactgaaaggccaggccagatggggaaaagtgagcggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcctcccgggcgcacccccctgcctgcgcctctccaagtcgccctttctccggctctgcccgcggctgagccccgcacaccgcgccgctgtccttggggtcccggcacacggcgttccctccccgcccccgccatccactcccaccgcctctccagtccctgtgccgtctccaccgccctctgactcccgcaccgagctgcgtctccgccgccggcctctctcagcgcggcccggcctcctctttgtctttgaagctcccccgccgaggcccgcgcgcggctcccctctccgtccctctccggcccttgggcgcccagtcggaggtcggggcgggatggggcacgagtctcggggcggcccgcgctccccctactagtcccctcattgcctcggccccgtccccgcagcctcggggcgggagggcgcaggggtccccgggcgccctgggagcccatctccctcaggtccgcgccggtgtcagccgccggcggggggcgggtggagattaagatgagtgctgcgagggacggggccgagggttttgtgtagaaggagagcaggattagtggagagaaagtgctgacccggggtcagccgcaagtcaaacccttttacactcagccggcggaacgagcacggctcgggccggacggcaacaagtgggcgcgaagggagggggaggggaggccgggtaccggccgggtccggcgtgagagaggggagggggaggggacgcggccacagcgccccagggcctcagcgtcatcggggacgggcgccgaggggagcgcgcaccagcgacccgggcgcggactggggcctgcagggcgtgactggctgccccccaggactccatctccttcataaacacctgccttttccattccccggggccgcttcggctgctcctctggagggaagactggggagaaggttgcctgcgctctctgccccagaggctctgttttagaaactgtttcttaatttccataagaaacaaaaaaatcacaggaaggcctggttcctctcccggacgactgcgtccccaggctctccaggaatcttcgccttatccgagcttcttcgcagccctggatctatttctggggggcgtgtgtgacgcagaatcggggtataaaatatcaatgctgtttgtcacgacaccgctttctccacccg

SEQ ID NO: 109252 - DNA, 2441 bp, Homo sapiens
  misc_feature 1..2441: note = chr13:112758003-112760444
  misc_feature 1..2441: note = Hyper
  source 1..2441: mol_type = genomic DNA
ctcagcacctgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagccggcccgttttcctcgagctttggaagtttcactcagccgtgcactcaatggcttcacaaagctgattacaagcttcagcgcattcctgaaggagccaaaagcgacgcaggtgcaaacgagccgagggagccccttatcccggtgacagaatgggacaagctgggaaaggcttagaccacacaagtccaaggctcaccaggccgcagaaagcctgccttgggaaccgggggtcattatccgccctattcagcggggcccggggaccctgggggccgagcgaggccagcccgggcgggagcaccgccgccagcgcgcgccggcgacaggggggaaccccgctgggcgctgcggccaggccggggctcagggcgctgggctgtgcgtttgcacaaatctgtgttccggcgggccggtgtcaaccctagtggggacacgggagaaagagcacgccagtaggccacgcggcgcgtgggcagtgcgcaacttctgtcggcgtccaggctgtacggccacgtttcagccggtgcccccaggccatggacacccagctccagggtcgctctgcgccctttctccccagcccacctttcccattggtcccctctcctgtccgagtggcagcgcggccccgcagggagcgaccccgggagggacagtgaccgcacgcgtggagtggggacggcggggcacaggacggtagtctaagagtgttcgcatggccgaggacgctttcgctgcgagtttggggtcgaggggcagttccctcccggagtcattaacttcgtctcctcgtgctcagggaccagcaacttggtgctgcgggcgccagaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggataattgtctattttctcgccaacagtctccatcacaatcacttatctggaaacctgcggttggattaatcgttatattcccgagatgagcgtcgctgcaatccgcagcgaacgcgggtagggacctggagacgcctcccgggcgctggcggggccggtgtgggccagctccgctaccgcctgagacgcggtgtgcccaggtgttggtgcccgcgggagagggctgtggggcgccttccccaggatttgcttgacttgcttttcgctcgagtgggtggtgcgcgggtgcgggaggcggagggaggaggaggggtgaggggaggagggcctgtggggctgcggacccggagcagcctgggtggagcgcggcctcgggaggccctgggtgcatcgcggcggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccgg

SEQ ID NO: 109253 - DNA, 527 bp, Homo sapiens; identical to SEQ ID NO: 75552
  misc_feature 1..527: note = chr13:112760850-112761377
  misc_feature 1..527: note = Hyper
  source 1..527: mol_type = genomic DNA

SEQ ID NO: 109254 - DNA, 30 bp, Homo sapiens; identical to SEQ ID NO: 43865
  misc_feature 1..30: note = chr13:112800543-112800573
  misc_feature 1..30: note = Hypo
  source 1..30: mol_type = genomic DNA

SEQ ID NO: 109255 - DNA, 30 bp, Homo sapiens; identical to SEQ ID NO: 75554
  misc_feature 1..30: note = chr13:112805073-112805103
  misc_feature 1..30: note = Hypo
  source 1..30: mol_type = genomic DNA

SEQ ID NO: 109256 - DNA, 41 bp, Homo sapiens; identical to SEQ ID NO: 43866
  misc_feature 1..41: note = chr13:112830483-112830524
  misc_feature 1..41: note = Hypo
  source 1..41: mol_type = genomic DNA

SEQ ID NO: 109257 - DNA, 30 bp, Homo sapiens; identical to SEQ ID NO: 75556
  misc_feature 1..30: note = chr13:112846818-112846848
  misc_feature 1..30: note = Hypo
  source 1..30: mol_type = genomic DNA

SEQ ID NO: 109258 - DNA, 212 bp, Homo sapiens; identical to SEQ ID NO: 75557
  misc_feature 1..212: note = chr13:112882188-112882400
  misc_feature 1..212: note = Hypo
  source 1..212: mol_type = genomic DNA

SEQ ID NO: 109259 - DNA, 20 bp, Homo sapiens
  misc_feature 1..20: note = chr13:112882956-112882976
  misc_feature 1..20: note = Hypo
  source 1..20: mol_type = genomic DNA
ttttttcttttgagacgcag

SEQ ID NO: 109260 - DNA, 222 bp, Homo sapiens; identical to SEQ ID NO: 75559
  misc_feature 1..222: note = chr13:112895421-112895643
  misc_feature 1..222: note = Hypo
  source 1..222: mol_type = genomic DNA

SEQ ID NO: 109261 - DNA, 36 bp, Homo sapiens; identical to SEQ ID NO: 75560
  misc_feature 1..36: note = chr13:112899548-112899584
  misc_feature 1..36: note = Hypo
  source 1..36: mol_type = genomic DNA

SEQ ID NO: 109262 - DNA, 34 bp, Homo sapiens; identical to SEQ ID NO: 75561
  misc_feature 1..34: note = chr13:112906409-112906443
  misc_feature 1..34: note = Hypo
  source 1..34: mol_type = genomic DNA

SEQ ID NO: 109263 - DNA, 30 bp, Homo sapiens; identical to SEQ ID NO: 75562
  misc_feature 1..30: note = chr13:112910078-112910108
  misc_feature 1..30: note = Hypo
  source 1..30: mol_type = genomic DNA

SEQ ID NO: 109264 - DNA, 77 bp, Homo sapiens; identical to SEQ ID NO: 75563
  misc_feature 1..77: note = chr13:112998058-112998135
  misc_feature 1..77: note = Hypo
  source 1..77: mol_type = genomic DNA

SEQ ID NO: 109265 - DNA, 30 bp, Homo sapiens; identical to SEQ ID NO: 75564
  misc_feature 1..30: note = chr13:113013574-113013604
  misc_feature 1..30: note = Hypo
  source 1..30: mol_type = genomic DNA

SEQ ID NO: 109266 - DNA, 30 bp, Homo sapiens; identical to SEQ ID NO: 75565
  misc_feature 1..30: note = chr13:113050319-113050349
  misc_feature 1..30: note = Hypo
  source 1..30: mol_type = genomic DNA

SEQ ID NO: 109267 - DNA, 42 bp, Homo sapiens; identical to SEQ ID NO: 43869
  misc_feature 1..42: note = chr13:113099281-113099323
  misc_feature 1..42: note = Hypo
  source 1..42: mol_type = genomic DNA

SEQ ID NO: 109268 - DNA, 95 bp, Homo sapiens; identical to SEQ ID NO: 75567
  misc_feature 1..95: note = chr13:113107030-113107125
  misc_feature 1..95: note = Hypo
  source 1..95: mol_type = genomic DNA

SEQ ID NO: 109269 - DNA, 294 bp, Homo sapiens; identical to SEQ ID NO: 75568
  misc_feature 1..294: note = chr13:113107711-113108005
  misc_feature 1..294: note = Hypo
  source 1..294: mol_type = genomic DNA

SEQ ID NO: 109270 - DNA, 30 bp, Homo sapiens; identical to SEQ ID NO: 75569
  misc_feature 1..30: note = chr13:113108949-113108979
  misc_feature 1..30: note = Hypo
  source 1..30: mol_type = genomic DNA

SEQ ID NO: 109271 - DNA, 34 bp, Homo sapiens; identical to SEQ ID NO: 75570
  misc_feature 1..34: note = chr13:113119848-113119882
  misc_feature 1..34: note = Hypo
  source 1..34: mol_type = genomic DNA

SEQ ID NO: 109272 - DNA, 30 bp, Homo sapiens; identical to SEQ ID NO: 75571
  misc_feature 1..30: note = chr13:113132528-113132558
  misc_feature 1..30: note = Hypo
  source 1..30: mol_type = genomic DNA

SEQ ID NO: 109273 - DNA, 59 bp, Homo sapiens; identical to SEQ ID NO: 75572
  misc_feature 1..59: note = chr13:113160568-113160627
  misc_feature 1..59: note = Hypo
  source 1..59: mol_type = genomic DNA

SEQ ID NO: 109274 - DNA, 218 bp, Homo sapiens; identical to SEQ ID NO: 75573
  misc_feature 1..218: note = chr13:113269889-113270107
  misc_feature 1..218: note = Hypo
  source 1..218: mol_type = genomic DNA

SEQ ID NO: 109275 - DNA, 49 bp, Homo sapiens; identical to SEQ ID NO: 75574
  misc_feature 1..49: note = chr13:113285488-113285537
  misc_feature 1..49: note = Hypo
  source 1..49: mol_type = genomic DNA

SEQ ID NO: 109276 - DNA, 30 bp, Homo sapiens; identical to SEQ ID NO: 43871
  misc_feature 1..30: note = chr13:113319347-113319377
  misc_feature 1..30: note = Hypo
  source 1..30: mol_type = genomic DNA

SEQ ID NO: 109277 - DNA, 245 bp, Homo sapiens; identical to SEQ ID NO: 75576
  misc_feature 1..245: note = chr13:113350398-113350643
  misc_feature 1..245: note = Hypo
  source 1..245: mol_type = genomic DNA

SEQ ID NO: 109278 - DNA, 36 bp, Homo sapiens; identical to SEQ ID NO: 75577
  misc_feature 1..36: note = chr13:113368582-113368618
  misc_feature 1..36: note = Hypo
  source 1..36: mol_type = genomic DNA

SEQ ID NO: 109279 - DNA, 30 bp, Homo sapiens; identical to SEQ ID NO: 75578
  misc_feature 1..30: note = chr13:113396823-113396853
  misc_feature 1..30: note = Hypo
  source 1..30: mol_type = genomic DNA

SEQ ID NO: 109280 - DNA, 333 bp, Homo sapiens; identical to SEQ ID NO: 75579
  misc_feature 1..333: note = chr13:113400400-113400733
  misc_feature 1..333: note = Hypo
  source 1..333: mol_type = genomic DNA

SEQ ID NO: 109281 - DNA, 39 bp, Homo sapiens; identical to SEQ ID NO: 43873
  misc_feature 1..39: note = chr13:113401430-113401469
  misc_feature 1..39: note = Hypo
  source 1..39: mol_type = genomic DNA

SEQ ID NO: 109282 - DNA, 30 bp, Homo sapiens; identical to SEQ ID NO: 75581
  misc_feature 1..30: note = chr13:113424191-113424221
  misc_feature 1..30: note = Hypo
  source 1..30: mol_type = genomic DNA

SEQ ID NO: 109283 - DNA, 52 bp, Homo sapiens; identical to SEQ ID NO: 75582
  misc_feature 1..52: note = chr13:113424883-113424935
  misc_feature 1..52: note = Hypo
  source 1..52: mol_type = genomic DNA

SEQ ID NO: 109284 - DNA, 30 bp, Homo sapiens; identical to SEQ ID NO: 75583
  misc_feature 1..30: note = chr13:113505580-113505610
  misc_feature 1..30: note = Hypo
  source 1..30: mol_type = genomic DNA

SEQ ID NO: 109285 - DNA, 30 bp, Homo sapiens; identical to SEQ ID NO: 75584
  misc_feature 1..30: note = chr13:113542925-113542955
  misc_feature 1..30: note = Hypo
  source 1..30: mol_type = genomic DNA

SEQ ID NO: 109286 - DNA, 30 bp, Homo sapiens; identical to SEQ ID NO: 75585
  misc_feature 1..30: note = chr13:113545760-113545790
  misc_feature 1..30: note = Hypo
  source 1..30: mol_type = genomic DNA

SEQ ID NO: 109287 - DNA, 156 bp, Homo sapiens; identical to SEQ ID NO: 75586
  misc_feature 1..156: note = chr13:113546374-113546530
  misc_feature 1..156: note = Hypo
  source 1..156: mol_type = genomic DNA

SEQ ID NO: 109288 - DNA, 167 bp, Homo sapiens; identical to SEQ ID NO: 75587
  misc_feature 1..167: note = chr13:113547082-113547249
  misc_feature 1..167: note = Hyper
  source 1..167: mol_type = genomic DNA

SEQ ID NO: 109289 - DNA, 30 bp, Homo sapiens; identical to SEQ ID NO: 75588
  misc_feature 1..30: note = chr13:113552672-113552702
  misc_feature 1..30: note = Hypo
  source 1..30: mol_type = genomic DNA

SEQ ID NO: 109290 - DNA, 30 bp, Homo sapiens; identical to SEQ ID NO: 75589
  misc_feature 1..30: note = chr13:113552957-113552987
  misc_feature 1..30: note = Hypo
  source 1..30: mol_type = genomic DNA

SEQ ID NO: 109291 - DNA, 190 bp, Homo sapiens; identical to SEQ ID NO: 75590
  misc_feature 1..190: note = chr13:113566241-113566431
  misc_feature 1..190: note = Hypo
  source 1..190: mol_type = genomic DNA

SEQ ID NO: 109292 - DNA, 30 bp, Homo sapiens; identical to SEQ ID NO: 75591
  misc_feature 1..30: note = chr13:113568768-113568798
  misc_feature 1..30: note = Hypo
  source 1..30: mol_type = genomic DNA

SEQ ID NO: 109293 - DNA, 309 bp, Homo sapiens; identical to SEQ ID NO: 75592
  misc_feature 1..309: note = chr13:113598542-113598851
  misc_feature 1..309: note = Hypo
  source 1..309: mol_type = genomic DNA

SEQ ID NO: 109294 - DNA, 51 bp, Homo sapiens; identical to SEQ ID NO: 75593
  misc_feature 1..51: note = chr13:113608271-113608322
  misc_feature 1..51: note = Hypo
  source 1..51: mol_type = genomic DNA

SEQ ID NO: 109295 - DNA, 64 bp, Homo sapiens; identical to SEQ ID NO: 75594
  misc_feature 1..64: note = chr13:113623284-113623348
  misc_feature 1..64: note = Hyper
  source 1..64: mol_type = genomic DNA

SEQ ID NO: 109296 - DNA, 700 bp, Homo sapiens
  misc_feature 1..700: note = chr13:113648342-113649042
  misc_feature 1..700: note = Hypo
  source 1..700: mol_type = genomic DNA
ccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgtcactgtctgtgccggtgtctcgggcgggggccagtgtggctgccaatggggcaaggtgcgtgggacgtcaagctgacgtcactgtctgtgccagtgtctcgggcaggggctggcagggctgcccaggaggctgtcggtggggcagttcctcatgaatctctgagctgagtttgtaaaagtgtgtgagagtggggaaaatatgggtgaaaatattttcagacatttggattcccctttggtgagctgtctcgtttcttcccgctggtcagggatgtggctgcttgaacagctgggcgcggtgaccaatgtgtggagagccgggaagcctgcggtgaggccgcgcgatgtccttcatcccgggcagtaaatccagccccgagggtggggcatcctcccgggcacaggctctc

SEQ ID NO: 109297 - DNA, 38 bp, Homo sapiens; identical to SEQ ID NO: 75596
  misc_feature 1..38: note = chr13:113678958-113678996
  misc_feature 1..38: note = Hypo
  source 1..38: mol_type = genomic DNA

SEQ ID NO: 109298 - DNA, 148 bp, Homo sapiens; identical to SEQ ID NO: 75597
  misc_feature 1..148: note = chr13:113718501-113718649
  misc_feature 1..148: note = Hypo
  source 1..148: mol_type = genomic DNA

SEQ ID NO: 109299 - DNA, 104 bp, Homo sapiens; identical to SEQ ID NO: 75598
  misc_feature 1..104: note = chr13:113719085-113719189
  misc_feature 1..104: note = Hypo
  source 1..104: mol_type = genomic DNA

SEQ ID NO: 109300 - DNA, 19 bp, Homo sapiens
  misc_feature 1..19: note = chr13:113763577-113763596
  misc_feature 1..19: note = Hypo
  source 1..19: mol_type = genomic DNA
ggagcgtgggtgtcgggga

SEQ ID NO: 109301 - DNA, 127 bp, Homo sapiens; identical to SEQ ID NO: 75600
  misc_feature 1..127: note = chr13:113775919-113776046
  misc_feature 1..127: note = Hypo
  source 1..127: mol_type = genomic DNA

SEQ ID NO: 109302 - DNA, 30 bp, Homo sapiens; identical to SEQ ID NO: 75601
  misc_feature 1..30: note = chr13:113797930-113797960
  misc_feature 1..30: note = Hypo
  source 1..30: mol_type = genomic DNA

SEQ ID NO: 109303 - DNA, 30 bp, Homo sapiens; identical to SEQ ID NO: 75602
  misc_feature 1..30: note = chr13:113825962-113825992
  misc_feature 1..30: note = Hypo
  source 1..30: mol_type = genomic DNA

SEQ ID NO: 109304 - DNA, 30 bp, Homo sapiens; identical to SEQ ID NO: 75603
  misc_feature 1..30: note = chr13:113848551-113848581
  misc_feature 1..30: note = Hypo
  source 1..30: mol_type = genomic DNA

SEQ ID NO: 109305 - DNA, 50 bp, Homo sapiens; identical to SEQ ID NO: 75604
  misc_feature 1..50: note = chr13:113984359-113984409
  misc_feature 1..50: note = Hypo
  source 1..50: mol_type = genomic DNA

SEQ ID NO: 109306 - DNA, 503 bp, Homo sapiens; identical to SEQ ID NO: 75605
  misc_feature 1..503: note = chr13:113985469-113985972
  misc_feature 1..503: note = Hypo
  source 1..503: mol_type = genomic DNA

SEQ ID NO: 109307 - DNA, 137 bp, Homo sapiens
  misc_feature 1..137: note = chr13:114017816-114017953
  misc_feature 1..137: note = Hyper
  source 1..137: mol_type = genomic DNA
gcatggatcgagttttgatccatcccgatatggctccctgctgggagggacgggtctccttcgcgtccgacccgccggcccatctcaaagcgggaaaaccggtccctgcggctgccctagctcggagcccgcagctt

SEQ ID NO: 109308 - DNA, 111 bp, Homo sapiens; identical to SEQ ID NO: 75607
  misc_feature 1..111: note = chr13:114018219-114018330
  misc_feature 1..111: note = Hyper
  source 1..111: mol_type = genomic DNA

SEQ ID NO: 109309 - DNA, 33 bp, Homo sapiens; identical to SEQ ID NO: 75608
  misc_feature 1..33: note = chr13:114019204-114019237
  misc_feature 1..33: note = Hypo
  source 1..33: mol_type = genomic DNA

SEQ ID NO: 109310 - DNA, 38 bp, Homo sapiens; identical to SEQ ID NO: 75609
  misc_feature 1..38: note = chr13:114028380-114028418
  misc_feature 1..38: note = Hypo
  source 1..38: mol_type = genomic DNA

SEQ ID NO: 109311 - DNA, 211 bp, Homo sapiens; identical to SEQ ID NO: 75610
  misc_feature 1..211: note = chr13:114055940-114056151
  misc_feature 1..211: note = Hypo
  source 1..211: mol_type = genomic DNA

SEQ ID NO: 109312 - DNA, 36 bp, Homo sapiens; identical to SEQ ID NO: 75611
  misc_feature 1..36: note = chr13:114056508-114056544
  misc_feature 1..36: note = Hypo
  source 1..36: mol_type = genomic DNA

SEQ ID NO: 109313 - DNA, 30 bp, Homo sapiens; identical to SEQ ID NO: 43882
  misc_feature 1..30: note = chr13:114059583-114059613
  misc_feature 1..30: note = Hypo
  source 1..30: mol_type = genomic DNA

SEQ ID NO: 109314 - DNA, 479 bp, Homo sapiens; identical to SEQ ID NO: 43883
  misc_feature 1..479: note = chr13:114059986-114060465
  misc_feature 1..479: note = Hypo
  source 1..479: mol_type = genomic DNA

SEQ ID NO: 109315 - DNA, 146 bp, Homo sapiens; identical to SEQ ID NO: 75614
  misc_feature 1..146: note = chr13:114060775-114060921
  misc_feature 1..146: note = Hypo
  source 1..146: mol_type = genomic DNA

SEQ ID NO: 109316 - DNA, 113 bp, Homo sapiens; identical to SEQ ID NO: 75615
  misc_feature 1..113: note = chr13:114064741-114064854
  misc_feature 1..113: note = Hypo
  source 1..113: mol_type = genomic DNA

SEQ ID NO: 109317 - DNA, 727 bp, Homo sapiens; identical to SEQ ID NO: 75616
  misc_feature 1..727: note = chr13:114074574-114075301
  misc_feature 1..727: note = Hypo
  source 1..727: mol_type = genomic DNA

SEQ ID NO: 109318 - DNA, 30 bp, Homo sapiens; identical to SEQ ID NO: 75617
  misc_feature 1..30: note = chr13:114080589-114080619
  misc_feature 1..30: note = Hypo
  source 1..30: mol_type = genomic DNA

SEQ ID NO: 109319 - DNA, 75 bp, Homo sapiens; identical to SEQ ID NO: 75618
  misc_feature 1..75: note = chr13:114103353-114103428
  misc_feature 1..75: note = Hypo
  source 1..75: mol_type = genomic DNA

SEQ ID NO: 109320 - DNA, 36 bp, Homo sapiens
  misc_feature 1..36: note = chr13:114107694-114107730
  misc_feature 1..36: note = Hypo
  source 1..36: mol_type = genomic DNA
tgtagccaagagcatcgccgacgctccccagcaaca

SEQ ID NO: 109321 - DNA, 59 bp, Homo sapiens; identical to SEQ ID NO: 75619
  misc_feature 1..59: note = chr13:114108109-114108168
  misc_feature 1..59: note = Hypo
  source 1..59: mol_type = genomic DNA

SEQ ID NO: 109322 - DNA, 30 bp, Homo sapiens; identical to SEQ ID NO: 75620
  misc_feature 1..30: note = chr13:114115112-114115142
  misc_feature 1..30: note = Hypo
  source 1..30: mol_type = genomic DNA

SEQ ID NO: 109323 - DNA, 374 bp, Homo sapiens; identical to SEQ ID NO: 75621
  misc_feature 1..374: note = chr13:114122901-114123275
  misc_feature 1..374: note = Hypo
  source 1..374: mol_type = genomic DNA

SEQ ID NO: 109324 - DNA, 22 bp, Homo sapiens
  misc_feature 1..22: note = chr13:114123716-114123738
  misc_feature 1..22: note = Hypo
  source 1..22: mol_type = genomic DNA
tgaaaccatggctcacgcctgt

SEQ ID NO: 109325 - DNA, 86 bp, Homo sapiens; identical to SEQ ID NO: 15788
  misc_feature 1..86: note = chr13:114188403-114188489
  misc_feature 1..86: note = Hypo
  source 1..86: mol_type = genomic DNA

SEQ ID NO: 109326 - DNA, 221 bp, Homo sapiens; identical to SEQ ID NO: 75624
  misc_feature 1..221: note = chr13:114189411-114189632
  misc_feature 1..221: note = Hypo
  source 1..221: mol_type = genomic DNA

SEQ ID NO: 109327 - DNA, 30 bp, Homo sapiens; identical to SEQ ID NO: 75625
  misc_feature 1..30: note = chr13:114190112-114190142
  misc_feature 1..30: note = Hypo
  source 1..30: mol_type = genomic DNA

SEQ ID NO: 109328 - DNA, 30 bp, Homo sapiens; identical to SEQ ID NO: 75626
  misc_feature 1..30: note = chr13:114191082-114191112
  misc_feature 1..30: note = Hypo
  source 1..30: mol_type = genomic DNA

SEQ ID NO: 109329 - DNA, 30 bp, Homo sapiens; identical to SEQ ID NO: 75627
  misc_feature 1..30: note = chr13:114202484-114202514
  misc_feature 1..30: note = Hypo
  source 1..30: mol_type = genomic DNA

SEQ ID NO: 109330 - DNA, 39 bp, Homo sapiens; identical to SEQ ID NO: 75628
  misc_feature 1..39: note = chr13:114202814-114202853
  misc_feature 1..39: note = Hypo
  source 1..39: mol_type = genomic DNA

SEQ ID NO: 109331 - DNA, 177 bp, Homo sapiens; identical to SEQ ID NO: 75629
  misc_feature 1..177: note = chr13:114203823-114204000
  misc_feature 1..177: note = Hypo
  source 1..177: mol_type = genomic DNA

SEQ ID NO: 109332 - DNA, 30 bp, Homo sapiens; identical to SEQ ID NO: 75630
  misc_feature 1..30: note = chr13:114212474-114212504
  misc_feature 1..30: note = Hypo
  source 1..30: mol_type = genomic DNA

SEQ ID NO: 109333 - DNA, 79 bp, Homo sapiens; identical to SEQ ID NO: 75631
  misc_feature 1..79: note = chr13:114220555-114220634
  misc_feature 1..79: note = Hypo
  source 1..79: mol_type = genomic DNA

SEQ ID NO: 109334 - DNA, 33 bp, Homo sapiens; identical to SEQ ID NO: 75632
  misc_feature 1..33: note = chr13:114221622-114221655
  misc_feature 1..33: note = Hypo
  source 1..33: mol_type = genomic DNA

SEQ ID NO: 109335 - DNA, 78 bp, Homo sapiens; identical to SEQ ID NO: 75633
  misc_feature 1..78: note = chr13:114271924-114272002
  misc_feature 1..78: note = Hypo
  source 1..78: mol_type = genomic DNA

SEQ ID NO: 109336 - DNA, 30 bp, Homo sapiens; identical to SEQ ID NO: 75634
  misc_feature 1..30: note = chr13:114283331-114283361
  misc_feature 1..30: note = Hypo
  source 1..30: mol_type = genomic DNA

SEQ ID NO: 109337 - DNA, 30 bp, Homo sapiens; identical to SEQ ID NO: 43894
  misc_feature 1..30: note = chr13:114285192-114285222
  misc_feature 1..30: note = Hypo
  source 1..30: mol_type = genomic DNA

SEQ ID NO: 109338 - DNA, 30 bp, Homo sapiens; identical to SEQ ID NO: 43895
  misc_feature 1..30: note = chr13:114285597-114285627
  misc_feature 1..30: note = Hypo
  source 1..30: mol_type = genomic DNA

SEQ ID NO: 109339 - DNA, 76 bp, Homo sapiens; identical to SEQ ID NO: 75637
  misc_feature 1..76: note = chr13:114302276-114302352
  misc_feature 1..76: note = Hypo
  source 1..76: mol_type = genomic DNA

SEQ ID NO: 109340 - DNA, 374 bp, Homo sapiens; identical to SEQ ID NO: 75638
  misc_feature 1..374: note = chr13:114304719-114305093
  misc_feature 1..374: note = Hypo
  source 1..374: mol_type = genomic DNA

SEQ ID NO: 109341 - DNA, 30 bp, Homo sapiens; identical to SEQ ID NO: 75639
  misc_feature 1..30: note = chr13:114305730-114305760
  misc_feature 1..30: note = Hypo
  source 1..30: mol_type = genomic DNA

SEQ ID NO: 109342 - DNA, 91 bp, Homo sapiens; identical to SEQ ID NO: 75640
  misc_feature 1..91: note = chr13:114312311-114312402
  misc_feature 1..91: note = Hypo
  source 1..91: mol_type = genomic DNA

SEQ ID NO: 109343 - DNA, 40 bp, Homo sapiens; identical to SEQ ID NO: 75641
  misc_feature 1..40: note = chr13:114318203-114318243
  misc_feature 1..40: note = Hypo
  source 1..40: mol_type = genomic DNA

SEQ ID NO: 109344 - DNA, 30 bp, Homo sapiens; identical to SEQ ID NO: 75642
  misc_feature 1..30: note = chr13:114323035-114323065
  misc_feature 1..30: note = Hypo
  source 1..30: mol_type = genomic DNA

SEQ ID NO: 109345 - DNA, 30 bp, Homo sapiens; identical to SEQ ID NO: 43899
  misc_feature 1..30: note = chr13:114426896-114426926
  misc_feature 1..30: note = Hypo
  source 1..30: mol_type = genomic DNA

SEQ ID NO: 109346 - DNA, 30 bp, Homo sapiens; identical to SEQ ID NO: 75644
  misc_feature 1..30: note = chr13:114438068-114438098
  misc_feature 1..30: note = Hypo
  source 1..30: mol_type = genomic DNA

SEQ ID NO: 109347 - DNA, 30 bp, Homo sapiens; identical to SEQ ID NO: 75645
  misc_feature 1..30: note = chr13:114438450-114438480
  misc_feature 1..30: note = Hypo
  source 1..30: mol_type = genomic DNA

SEQ ID NO: 109348 - DNA, 136 bp, Homo sapiens; identical to SEQ ID NO: 75646
  misc_feature 1..136: note = chr13:114450586-114450722
  misc_feature 1..136: note = Hypo
  source 1..136: mol_type = genomic DNA

SEQ ID NO: 109349 - DNA, 38 bp, Homo sapiens; identical to SEQ ID NO: 75647
  misc_feature 1..38: note = chr13:114454880-114454918
  misc_feature 1..38: note = Hypo
  source 1..38: mol_type = genomic DNA

SEQ ID NO: 109350 - DNA, 288 bp, Homo sapiens
  misc_feature 1..288: note = chr13:114462710-114462998
  misc_feature 1..288: note = Hyper
  source 1..288: mol_type = genomic DNA
cttcgtttggaagagcgaggtagccttttcctgtttgaacgtgcagaggcgctcacagaactggacagtgttgcttggtttcggctcgcccctctctcgtgtttctccccggtgtgttcacggaatctccaattcttccacttcccagaccaagcccgctgcagcctcggagccaggcaaaggctgggaaaacaggaaacctgttgcgtgttcaccagttcgcaagccgggctcgggggctctgccgggaagtggccaggactggaaggatgccgggtgtcttcctga

SEQ ID NO: 109351 - DNA, 153 bp, Homo sapiens; identical to SEQ ID NO: 75650
  misc_feature 1..153: note = chr13:114466991-114467144
  misc_feature 1..153: note = Hypo
  source 1..153: mol_type = genomic DNA

SEQ ID NO: 109352 - DNA, 70 bp, Homo sapiens; identical to SEQ ID NO: 75651
  misc_feature 1..70: note = chr13:114478858-114478928
  misc_feature 1..70: note = Hypo
  source 1..70: mol_type = genomic DNA

SEQ ID NO: 109353 - DNA, 68 bp, Homo sapiens; identical to SEQ ID NO: 75652
  misc_feature 1..68: note = chr13:114479383-114479451
  misc_feature 1..68: note = Hypo
  source 1..68: mol_type = genomic DNA

SEQ ID NO: 109354 - DNA, 132 bp, Homo sapiens; identical to SEQ ID NO: 75653
  misc_feature 1..132: note = chr13:114492908-114493040
  misc_feature 1..132: note = Hypo
  source 1..132: mol_type = genomic DNA

SEQ ID NO: 109355 - DNA, 30 bp, Homo sapiens; identical to SEQ ID NO: 75654
  misc_feature 1..30: note = chr13:114494463-114494493
  misc_feature 1..30: note = Hypo
  source 1..30: mol_type = genomic DNA

SEQ ID NO: 109356 - DNA, 30 bp, Homo sapiens; identical to SEQ ID NO: 75655
  misc_feature 1..30: note = chr13:114495640-114495670
  misc_feature 1..30: note = Hypo
  source 1..30: mol_type = genomic DNA

SEQ ID NO: 109357 - DNA, 30 bp, Homo sapiens; identical to SEQ ID NO: 43903
  misc_feature 1..30: note = chr13:114497409-114497439
  misc_feature 1..30: note = Hypo
  source 1..30: mol_type = genomic DNA

SEQ ID NO: 109358 - DNA, 516 bp, Homo sapiens; identical to SEQ ID NO: 75657
  misc_feature 1..516: note = chr13:114497813-114498329
  misc_feature 1..516: note = Hypo
  source 1..516: mol_type = genomic DNA

SEQ ID NO: 109359 - DNA, 38 bp, Homo sapiens; identical to SEQ ID NO: 75658
  misc_feature 1..38: note = chr13:114499931-114499969
  misc_feature 1..38: note = Hypo
  source 1..38: mol_type = genomic DNA

SEQ ID NO: 109360 - DNA, 30 bp, Homo sapiens; identical to SEQ ID NO: 75659
  misc_feature 1..30: note = chr13:114502300-114502330
  misc_feature 1..30: note = Hypo
  source 1..30: mol_type = genomic DNA

SEQ ID NO: 109361 - DNA, 175 bp, Homo sapiens; identical to SEQ ID NO: 43905
  misc_feature 1..175: note = chr13:114502787-114502962
  misc_feature 1..175: note = Hypo
  source 1..175: mol_type = genomic DNA

SEQ ID NO: 109362 - DNA, 185 bp, Homo sapiens; identical to SEQ ID NO: 75661
  misc_feature 1..185: note = chr13:114506372-114506557
  misc_feature 1..185: note = Hypo
  source 1..185: mol_type = genomic DNA

SEQ ID NO: 109363 - DNA, 30 bp, Homo sapiens; identical to SEQ ID NO: 75662
  misc_feature 1..30: note = chr13:114507314-114507344
  misc_feature 1..30: note = Hypo
  source 1..30: mol_type = genomic DNA

SEQ ID NO: 109364 - DNA, 30 bp, Homo sapiens; identical to SEQ ID NO: 75663
  misc_feature 1..30: note = chr13:114508713-114508743
  misc_feature 1..30: note = Hypo
  source 1..30: mol_type = genomic DNA

SEQ ID NO: 109365 - DNA, 48 bp, Homo sapiens; identical to SEQ ID NO: 75664
  misc_feature 1..48: note = chr13:114515287-114515335
  misc_feature 1..48: note = Hypo
  source 1..48: mol_type = genomic DNA

SEQ ID NO: 109366 - DNA, 252 bp, Homo sapiens; identical to SEQ ID NO: 75665
  misc_feature 1..252: note = chr13:114515648-114515900
  misc_feature 1..252: note = Hypo
  source 1..252: mol_type = genomic DNA

SEQ ID NO: 109367 - DNA, 30 bp, Homo sapiens; identical to SEQ ID NO: 75666
  misc_feature 1..30: note = chr13:114517682-114517712
  misc_feature 1..30: note = Hypo
  source 1..30: mol_type = genomic DNA

SEQ ID NO: 109368 - DNA, 30 bp, Homo sapiens; identical to SEQ ID NO: 75667
  misc_feature 1..30: note = chr13:114524666-114524696
  misc_feature 1..30: note = Hypo
  source 1..30: mol_type = genomic DNA

SEQ ID NO: 109369 - DNA, 142 bp, Homo sapiens; identical to SEQ ID NO: 75668
  misc_feature 1..142: note = chr13:114526487-114526629
  misc_feature 1..142: note = Hypo
  source 1..142: mol_type = genomic DNA

SEQ ID NO: 109370 - DNA, 36 bp, Homo sapiens; identical to SEQ ID NO: 75669
  misc_feature 1..36: note = chr13:114531771-114531807
  misc_feature 1..36: note = Hypo
  source 1..36: mol_type = genomic DNA

SEQ ID NO: 109371 - DNA, 30 bp, Homo sapiens; identical to SEQ ID NO: 75670
  misc_feature 1..30: note = chr13:114601611-114601641
  misc_feature 1..30: note = Hypo
  source 1..30: mol_type = genomic DNA

SEQ ID NO: 109372 - DNA, 154 bp, Homo sapiens; identical to SEQ ID NO: 43908
  misc_feature 1..154: note = chr13:114742788-114742942
  misc_feature 1..154: note = Hypo
  source 1..154: mol_type = genomic DNA

SEQ ID NO: 109373 - DNA, 69 bp, Homo sapiens; identical to SEQ ID NO: 75672
  misc_feature 1..69: note = chr13:114744097-114744166
  misc_feature 1..69: note = Hypo
  source 1..69: mol_type = genomic DNA

SEQ ID NO: 109374 - DNA, 50 bp, Homo sapiens; identical to SEQ ID NO: 75673
  misc_feature 1..50: note = chr13:114744515-114744565
  misc_feature 1..50: note = Hypo
  source 1..50: mol_type = genomic DNA

SEQ ID NO: 109375 - DNA, 77 bp, Homo sapiens; identical to SEQ ID NO: 43909
  misc_feature 1..77: note = chr13:114746775-114746852
  misc_feature 1..77: note = Hypo
  source 1..77: mol_type = genomic DNA

SEQ ID NO: 109376 - DNA, 812 bp, Homo sapiens; identical to SEQ ID NO: 75675
  misc_feature 1..812: note = chr13:114748324-114749136
  misc_feature 1..812: note = Hypo
  source 1..812: mol_type = genomic DNA

SEQ ID NO: 109377 - DNA, 32 bp, Homo sapiens; identical to SEQ ID NO: 43911
  misc_feature 1..32: note = chr13:114749950-114749982
  misc_feature 1..32: note = Hypo
  source 1..32: mol_type = genomic DNA

SEQ ID NO: 109378 - DNA, 30 bp, Homo sapiens; identical to SEQ ID NO: 75677
  misc_feature 1..30: note = chr13:114750396-114750426
  misc_feature 1..30: note = Hypo
  source 1..30: mol_type = genomic DNA

SEQ ID NO: 109379 - DNA, 78 bp, Homo sapiens; identical to SEQ ID NO: 75678
  misc_feature 1..78: note = chr13:114750975-114751053
  misc_feature 1..78: note = Hypo
  source 1..78: mol_type = genomic DNA

SEQ ID NO: 109380 - DNA, 30 bp, Homo sapiens; identical to SEQ ID NO: 43912
  misc_feature 1..30: note = chr13:114751360-114751390
  misc_feature 1..30: note = Hypo
  source 1..30: mol_type = genomic DNA

SEQ ID NO: 109381 - DNA, 39 bp, Homo sapiens; identical to SEQ ID NO: 75680
  misc_feature 1..39: note = chr13:114755827-114755866
  misc_feature 1..39: note = Hypo
  source 1..39: mol_type = genomic DNA

SEQ ID NO: 109382 - DNA, 30 bp, Homo sapiens; identical to SEQ ID NO: 75681
  misc_feature 1..30: note = chr13:114758007-114758037
  misc_feature 1..30: note = Hypo
  source 1..30: mol_type = genomic DNA

SEQ ID NO: 109383 - DNA, 111 bp, Homo sapiens; identical to SEQ ID NO: 75682
  misc_feature 1..111: note = chr13:114760934-114761045
  misc_feature 1..111: note = Hypo
  source 1..111: mol_type = genomic DNA

SEQ ID NO: 109384 - DNA, 197 bp, Homo sapiens; identical to SEQ ID NO: 75683
  misc_feature 1..197: note = chr13:114762623-114762820
  misc_feature 1..197: note = Hypo
  source 1..197: mol_type = genomic DNA

SEQ ID NO: 109385 - DNA, 193 bp, Homo sapiens; identical to SEQ ID NO: 75684
  misc_feature 1..193: note = chr13:114765044-114765237
  misc_feature 1..193: note = Hypo
  source 1..193: mol_type = genomic DNA

SEQ ID NO: 109386 - DNA, 754 bp, Homo sapiens; identical to SEQ ID NO: 75685
  misc_feature 1..754: note = chr13:114767261-114768015
  misc_feature 1..754: note = Hypo
  source 1..754: mol_type = genomic DNA

SEQ ID NO: 109387 - DNA, 206 bp, Homo sapiens; identical to SEQ ID NO: 43917
  misc_feature 1..206: note = chr13:114769986-114770192
  misc_feature 1..206: note = Hypo
  source 1..206: mol_type = genomic DNA

SEQ ID NO: 109388 - DNA, 143 bp, Homo sapiens; identical to SEQ ID NO: 75687
  misc_feature 1..143: note = chr13:114770922-114771065
  misc_feature 1..143: note = Hypo
  source 1..143: mol_type = genomic DNA

SEQ ID NO: 109389 - DNA, 200 bp, Homo sapiens; identical to SEQ ID NO: 75688
  misc_feature 1..200: note = chr13:114774947-114775147
  misc_feature 1..200: note = Hypo
  source 1..200: mol_type = genomic DNA

SEQ ID NO: 109390 - DNA, 146 bp, Homo sapiens; identical to SEQ ID NO: 75689
  misc_feature 1..146: note = chr13:114776302-114776448
  misc_feature 1..146: note = Hypo
  source 1..146: mol_type = genomic DNA

SEQ ID NO: 109391 - DNA, 40 bp, Homo sapiens; identical to SEQ ID NO: 43921
  misc_feature 1..40: note = chr13:114777010-114777050
  misc_feature 1..40: note = Hypo
  source 1..40: mol_type = genomic DNA

SEQ ID NO: 109392 - DNA, 30 bp, Homo sapiens; identical to SEQ ID NO: 75691
  misc_feature 1..30: note = chr13:114777780-114777810
  misc_feature 1..30: note = Hypo
  source 1..30: mol_type = genomic DNA

SEQ ID NO: 109393 - DNA, 34 bp, Homo sapiens; identical to SEQ ID NO: 43922
  misc_feature 1..34: note = chr13:114778697-114778731
  misc_feature 1..34: note = Hypo
  source 1..34: mol_type = genomic DNA

SEQ ID NO: 109394 - DNA, 113 bp, Homo sapiens; identical to SEQ ID NO: 75693
  misc_feature 1..113: note = chr13:114779925-114780038
  misc_feature 1..113: note = Hypo
  source 1..113: mol_type = genomic DNA

SEQ ID NO: 109395 - DNA, 543 bp, Homo sapiens; identical to SEQ ID NO: 75694
  misc_feature 1..543: note = chr13:114780540-114781083
  misc_feature 1..543: note = Hypo
  source 1..543: mol_type = genomic DNA

SEQ ID NO: 109396 - DNA, 35 bp, Homo sapiens; identical to SEQ ID NO: 75695
  misc_feature 1..35: note = chr13:114781299-114781334
  misc_feature 1..35: note = Hypo
  source 1..35: mol_type = genomic DNA

SEQ ID NO: 109397 - DNA, 93 bp, Homo sapiens; identical to SEQ ID NO: 75696
  misc_feature 1..93: note = chr13:114782866-114782959
  misc_feature 1..93: note = Hypo
  source 1..93: mol_type = genomic DNA

SEQ ID NO: 109398 - DNA, 56 bp, Homo sapiens; identical to SEQ ID NO: 75697
  misc_feature 1..56: note = chr13:114784530-114784586
  misc_feature 1..56: note = Hypo
  source 1..56: mol_type = genomic DNA

SEQ ID NO: 109399 - DNA, 66 bp, Homo sapiens; identical to SEQ ID NO: 43926
  misc_feature 1..66: note = chr13:114785766-114785832
  misc_feature 1..66: note = Hypo
  source 1..66: mol_type = genomic DNA

SEQ ID NO: 109400 - DNA, 165 bp, Homo sapiens; identical to SEQ ID NO: 75699
  misc_feature 1..165: note = chr13:114786866-114787031
  misc_feature 1..165: note = Hypo
  source 1..165: mol_type = genomic DNA

SEQ ID NO: 109401 - DNA, 116 bp, Homo sapiens; identical to SEQ ID NO: 75700
  misc_feature 1..116: note = chr13:114789389-114789505
  misc_feature 1..116: note = Hypo
  source 1..116: mol_type = genomic DNA

SEQ ID NO: 109402 - DNA, 20 bp, Homo sapiens
  misc_feature 1..20: note = chr13:114802298-114802318
  misc_feature 1..20: note = Hypo
  source 1..20: mol_type = genomic DNA
caccgcgcccagcctggagt

SEQ ID NO: 109403 - DNA, 115 bp, Homo sapiens; identical to SEQ ID NO: 75702
  misc_feature 1..115: note = chr13:114802580-114802695
  misc_feature 1..115: note = Hypo
  source 1..115: mol_type = genomic DNA

SEQ ID NO: 109404 - DNA, 42 bp, Homo sapiens; identical to SEQ ID NO: 75703
  misc_feature 1..42: note = chr13:114803361-114803403
  misc_feature 1..42: note = Hypo
  source 1..42: mol_type = genomic DNA

SEQ ID NO: 109405 - DNA, 30 bp, Homo sapiens; identical to SEQ ID NO: 75704
  misc_feature 1..30: note = chr13:114803808-114803838
  misc_feature 1..30: note = Hypo
  source 1..30: mol_type = genomic DNA

SEQ ID NO: 109406 - DNA, 346 bp, Homo sapiens; identical to SEQ ID NO: 75705
  misc_feature 1..346: note = chr13:114807501-114807847
  misc_feature 1..346: note = Hypo
  source 1..346: mol_type = genomic DNA

SEQ ID NO: 109407 - DNA, 46 bp, Homo sapiens; identical to SEQ ID NO: 75706
  misc_feature 1..46: note = chr13:114808091-114808137
  misc_feature 1..46: note = Hypo
  source 1..46: mol_type = genomic DNA

SEQ ID NO: 109408 - DNA, 18 bp, Homo sapiens
  misc_feature 1..18: note = chr13:114812180-114812198
  misc_feature 1..18: note = Hypo
  source 1..18: mol_type = genomic DNA
gtccgagccctgccttca

SEQ ID NO: 109409 - DNA, 30 bp, Homo sapiens; identical to SEQ ID NO: 75708
  misc_feature 1..30: note = chr13:114816511-114816541
  misc_feature 1..30: note = Hypo
  source 1..30: mol_type = genomic DNA

SEQ ID NO: 109410 - DNA, 72 bp, Homo sapiens; identical to SEQ ID NO: 75709
  misc_feature 1..72: note = chr13:114820299-114820371
  misc_feature 1..72: note = Hypo
  source 1..72: mol_type = genomic DNA

SEQ ID NO: 109411 - DNA, 30 bp, Homo sapiens; identical to SEQ ID NO: 75710
  misc_feature 1..30: note = chr13:114838479-114838509
  misc_feature 1..30: note = Hypo
  source 1..30: mol_type = genomic DNA

SEQ ID NO: 109412 - DNA, 30 bp, Homo sapiens; identical to SEQ ID NO: 75711
  misc_feature 1..30: note = chr13:114840646-114840676
  misc_feature 1..30: note = Hypo
  source 1..30: mol_type = genomic DNA

SEQ ID NO: 109413 - DNA, 316 bp, Homo sapiens; identical to SEQ ID NO: 75712
  misc_feature 1..316: note = chr13:114842818-114843134
  misc_feature 1..316: note = Hypo
  source 1..316: mol_type = genomic DNA

SEQ ID NO: 109414 - DNA, 30 bp, Homo sapiens; identical to SEQ ID NO: 75713
  misc_feature 1..30: note = chr13:114844847-114844877
  misc_feature 1..30: note = Hypo
  source 1..30: mol_type = genomic DNA

SEQ ID NO: 109415 - DNA, 37 bp, Homo sapiens; identical to SEQ ID NO: 75714
  misc_feature 1..37: note = chr13:114845313-114845350
  misc_feature 1..37: note = Hypo
  source 1..37: mol_type = genomic DNA

SEQ ID NO: 109416 - DNA, 460 bp, Homo sapiens; identical to SEQ ID NO: 75715
  misc_feature 1..460: note = chr13:114847212-114847672
  misc_feature 1..460: note = Hypo
  source 1..460: mol_type = genomic DNA

SEQ ID NO: 109417 - DNA, 227 bp, Homo sapiens; identical to SEQ ID NO: 75716
  misc_feature 1..227: note = chr13:114855474-114855701
  misc_feature 1..227: note = Hypo
  source 1..227: mol_type = genomic DNA

SEQ ID NO: 109418 - DNA, 30 bp, Homo sapiens; identical to SEQ ID NO: 75717
  misc_feature 1..30: note = chr13:114862455-114862485
  misc_feature 1..30: note = Hypo
  source 1..30: mol_type = genomic DNA

SEQ ID NO: 109419 - DNA, 37 bp, Homo sapiens; identical to SEQ ID NO: 75718
  misc_feature 1..37: note = chr13:114886881-114886918
  misc_feature 1..37: note = Hypo
  source 1..37: mol_type = genomic DNA

SEQ ID NO: 109420 - DNA, 53 bp, Homo sapiens; identical to SEQ ID NO: 75719
  misc_feature 1..53: note = chr13:114889099-114889152
  misc_feature 1..53: note = Hypo
  source 1..53: mol_type = genomic DNA

SEQ ID NO: 109421 - DNA, 30 bp, Homo sapiens; identical to SEQ ID NO: 75720
  misc_feature 1..30: note = chr13:114889446-114889476
  misc_feature 1..30: note = Hypo
  source 1..30: mol_type = genomic DNA

SEQ ID NO: 109422 - DNA, 38 bp, Homo sapiens; identical to SEQ ID NO: 75721
  misc_feature 1..38: note = chr13:114892617-114892655
  misc_feature 1..38: note = Hypo
  source 1..38: mol_type = genomic DNA

SEQ ID NO: 109423 - DNA, 30 bp, Homo sapiens; identical to SEQ ID NO: 75722
  misc_feature 1..30: note = chr13:114911257-114911287
  misc_feature 1..30: note = Hypo
  source 1..30: mol_type = genomic DNA

SEQ ID NO: 109424 - DNA, 69 bp, Homo sapiens; identical to SEQ ID NO: 75723
  misc_feature 1..69: note = chr13:114917035-114917104
  misc_feature 1..69: note = Hypo
  source 1..69: mol_type = genomic DNA

SEQ ID NO: 109425 - DNA, 30 bp, Homo sapiens; identical to SEQ ID NO: 75724
  misc_feature 1..30: note = chr13:114917570-114917600
  misc_feature 1..30: note = Hypo
  source 1..30: mol_type = genomic DNA

SEQ ID NO: 109426 - DNA, 37 bp, Homo sapiens; identical to SEQ ID NO: 75725
  misc_feature 1..37: note = chr13:114922755-114922792
  misc_feature 1..37: note = Hypo
  source 1..37: mol_type = genomic DNA

SEQ ID NO: 109427 - DNA, 351 bp, Homo sapiens; identical to SEQ ID NO: 75726
  misc_feature 1..351: note = chr13:114961720-114962071
  misc_feature 1..351: note = Hypo
  source 1..351: mol_type = genomic DNA

SEQ ID NO: 109428 - DNA, 107 bp, Homo sapiens; identical to SEQ ID NO: 75727
  misc_feature 1..107: note = chr13:114989891-114989998
  misc_feature 1..107: note = Hypo
  source 1..107: mol_type = genomic DNA

SEQ ID NO: 109429 - DNA, 207 bp, Homo sapiens; identical to SEQ ID NO: 75728
  misc_feature 1..207: note = chr13:115024113-115024320
  misc_feature 1..207: note = Hypo
  source 1..207: mol_type = genomic DNA

SEQ ID NO: 109430 - DNA, 38 bp, Homo sapiens; identical to SEQ ID NO: 76526
  misc_feature 1..38: note = chr14:20707559-20707597
  misc_feature 1..38: note = Hypo
  source 1..38: mol_type = genomic DNA

SEQ ID NO: 109431 - DNA, 125 bp, Homo sapiens; identical to SEQ ID NO: 76527
  misc_feature 1..125: note = chr14:20928177-20928302
  misc_feature 1..125: note = Hypo
  source 1..125: mol_type = genomic DNA

SEQ ID NO: 109432 - DNA, 30 bp, Homo sapiens; identical to SEQ ID NO: 76528
  misc_feature 1..30: note = chr14:20936882-20936912
  misc_feature 1..30: note = Hypo
  source 1..30: mol_type = genomic DNA

SEQ ID NO: 109433 - DNA, 77 bp, Homo sapiens; identical to SEQ ID NO: 76529
  misc_feature 1..77: note = chr14:21093454-21093531
  misc_feature 1..77: note = Hyper
  source 1..77: mol_type = genomic DNA

SEQ ID NO: 109434 - DNA, 196 bp, Homo sapiens; identical to SEQ ID NO: 76530
  misc_feature 1..196: note = chr14:21093591-21093787
  misc_feature 1..196: note = Hyper
  source 1..196: mol_type = genomic DNA

SEQ ID NO: 109435 - DNA, 283 bp, Homo sapiens; identical to SEQ ID NO: 76531
  misc_feature 1..283: note = chr14:21098864-21099147
  misc_feature 1..283: note = Hyper
  source 1..283: mol_type = genomic DNA

SEQ ID NO: 109436 - DNA, 430 bp, Homo sapiens
  misc_feature 1..430: note = chr14:21100626-21101056
  misc_feature 1..430: note = Hyper
  source 1..430: mol_type = genomic DNA
acagcaacttttccccgacggcacctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttcggaacgctgcgtctcggatccttctgaacccgcacgttgactttcctgg

SEQ ID NO: 109437 - DNA, 60 bp, Homo sapiens; identical to SEQ ID NO: 76535
  misc_feature 1..60: note = chr14:21121400-21121460
  misc_feature 1..60: note = Hyper
  source 1..60: mol_type = genomic DNA

SEQ ID NO: 109438 - DNA, 47 bp, Homo sapiens
  misc_feature 1..47: note = chr14:21121902-21121949
  misc_feature 1..47: note = Hyper
  source 1..47: mol_type = genomic DNA
ctcatcccccacccccgttcttcctcccgatgcgctttctgccttct

SEQ ID NO: 109439 - DNA, 17 bp, Homo sapiens
  misc_feature 1..17: note = chr14:21141354-21141371
  misc_feature 1..17: note = Hypo
  source 1..17: mol_type = genomic DNA
ggcgtgagccaccgcac

SEQ ID NO: 109440 - DNA, 68 bp, Homo sapiens; identical to SEQ ID NO: 76538
  misc_feature 1..68: note = chr14:21172544-21172612
  misc_feature 1..68: note = Hypo
  source 1..68: mol_type = genomic DNA

SEQ ID NO: 109441 - DNA, 117 bp, Homo sapiens; identical to SEQ ID NO: 76539
  misc_feature 1..117: note = chr14:21190395-21190512
  misc_feature 1..117: note = Hypo
  source 1..117: mol_type = genomic DNA

SEQ ID NO: 109442 - DNA, 24 bp, Homo sapiens
  misc_feature 1..24: note = chr14:21265229-21265253
  misc_feature 1..24: note = Hypo
  source 1..24: mol_type = genomic DNA
gcacctggccgtagcttctaattc

SEQ ID NO: 109443 - DNA, 23 bp, Homo sapiens
  misc_feature 1..23: note = chr14:21282035-21282058
  misc_feature 1..23: note = Hypo
  source 1..23: mol_type = genomic DNA
atgtttctggctgggcgcagtgg

SEQ ID NO: 109444 - DNA, 37 bp, Homo sapiens; identical to SEQ ID NO: 76542
  misc_feature 1..37: note = chr14:21287757-21287794
  misc_feature 1..37: note = Hypo
  source 1..37: mol_type = genomic DNA

SEQ ID NO: 109445 - DNA, 18 bp, Homo sapiens
  misc_feature 1..18: note = chr14:21289138-21289156
  misc_feature 1..18: note = Hypo
  source 1..18: mol_type = genomic DNA
agcactttgagaggccga

SEQ ID NO: 109446 - DNA, 20 bp, Homo sapiens
  misc_feature 1..20: note = chr14:21297174-21297194
  misc_feature 1..20: note = Hypo
  source 1..20: mol_type = genomic DNA
aagagcgagaaaaaaattaa

SEQ ID NO: 109447 - DNA, 209 bp, Homo sapiens; identical to SEQ ID NO: 76545
  misc_feature 1..209: note = chr14:21341988-21342197
  misc_feature 1..209: note = Hyper
  source 1..209: mol_type = genomic DNA

SEQ ID NO: 109448 - DNA, 132 bp, Homo sapiens; identical to SEQ ID NO: 76546
  misc_feature 1..132: note = chr14:21439185-21439317
  misc_feature 1..132: note = Hyper
  source 1..132: mol_type = genomic DNA

SEQ ID NO: 109449 - DNA, 130 bp, Homo sapiens; identical to SEQ ID NO: 76547
  misc_feature 1..130: note = chr14:21492900-21493030
  misc_feature 1..130: note = Hyper
  source 1..130: mol_type = genomic DNA

SEQ ID NO: 109450 - DNA, 251 bp, Homo sapiens; identical to SEQ ID NO: 76548
  misc_feature 1..251: note = chr14:21493570-21493821
  misc_feature 1..251: note = Hyper
  source 1..251: mol_type = genomic DNA

SEQ ID NO: 109451 - DNA, 28 bp, Homo sapiens
  misc_feature 1..28: note = chr14:21609905-21609933
  misc_feature 1..28: note = Hypo
  source 1..28: mol_type = genomic DNA
tggaaagctaacaaccgtcaggccggga

SEQ ID NO: 109452 - DNA, 32 bp, Homo sapiens; identical to SEQ ID NO: 43943
  misc_feature 1..32: note = chr14:21657875-21657907
  misc_feature 1..32: note = Hypo
  source 1..32: mol_type = genomic DNA

SEQ ID NO: 109453 - DNA, 30 bp, Homo sapiens; identical to SEQ ID NO: 43944
  misc_feature 1..30: note = chr14:21721854-21721884
  misc_feature 1..30: note = Hypo
  source 1..30: mol_type = genomic DNA

SEQ ID NO: 109454 - DNA, 30 bp, Homo sapiens; identical to SEQ ID NO: 76552
  misc_feature 1..30: note = chr14:21766806-21766836
  misc_feature 1..30: note = Hypo
  source 1..30: mol_type = genomic DNA

SEQ ID NO: 109455 - DNA, 349 bp, Homo sapiens; identical to SEQ ID NO: 76553
  misc_feature 1..349: note = chr14:21769030-21769379
  misc_feature 1..349: note = Hyper
  source 1..349: mol_type = genomic DNA

SEQ ID NO: 109456 - DNA, 30 bp, Homo sapiens; identical to SEQ ID NO: 76554
  misc_feature 1..30: note = chr14:21943010-21943040
  misc_feature 1..30: note = Hypo
  source 1..30: mol_type = genomic DNA

SEQ ID NO: 109457 - DNA, 174 bp, Homo sapiens; identical to SEQ ID NO: 76555
  misc_feature 1..174: note = chr14:21980230-21980404
  misc_feature 1..174: note = Hypo
  source 1..174: mol_type = genomic DNA

SEQ ID NO: 109458 - DNA, 248 bp, Homo sapiens
  misc_feature 1..248: note = chr14:21994140-21994388
  misc_feature 1..248: note = Hyper
  source 1..248: mol_type = genomic DNA
ctgcgcatccccctccgcccccacccctgcccagcccgaccgaccctaccgcacctccgagctctgccggctccccgcagggcaccccgagacgagagctcctctcggattcgtgcgccatggttgtgggggaagtggagggccaggtggggtgggagacaatggatattgggattgagggaggcgatggccgctgggtctgcggcagcctctgcacccagcggcccagactgcggagatggagatcg

SEQ ID NO: 109459 - DNA, 30 bp, Homo sapiens; identical to SEQ ID NO: 76557
  misc_feature 1..30: note = chr14:21994769-21994799
  misc_feature 1..30: note = Hyper
  source 1..30: mol_type = genomic DNA

SEQ ID NO: 109460 - DNA, 183 bp, Homo sapiens; identical to SEQ ID NO: 76558
  misc_feature 1..183: note = chr14:22004998-22005181
  misc_feature 1..183: note = Hyper
  source 1..183: mol_type = genomic DNA

SEQ ID NO: 109461 - DNA, 38 bp, Homo sapiens; identical to SEQ ID NO: 43946
  misc_feature 1..38: note = chr14:22551269-22551307
  misc_feature 1..38: note = Hypo
  source 1..38: mol_type = genomic DNA

SEQ ID NO: 109462 - DNA, 95 bp, Homo sapiens; identical to SEQ ID NO: 76560
  misc_feature 1..95: note = chr14:22763687-22763782
  misc_feature 1..95: note = Hypo
  source 1..95: mol_type = genomic DNA

SEQ ID NO: 109463 - DNA, 32 bp, Homo sapiens; identical to SEQ ID NO: 76561
  misc_feature 1..32: note = chr14:22812323-22812355
  misc_feature 1..32: note = Hypo
  source 1..32: mol_type = genomic DNA

SEQ ID NO: 109464 - DNA, 31 bp, Homo sapiens; identical to SEQ ID NO: 76562
  misc_feature 1..31: note = chr14:23028684-23028715
  misc_feature 1..31: note = Hypo
  source 1..31: mol_type = genomic DNA

SEQ ID NO: 109465 - DNA, 176 bp, Homo sapiens; identical to SEQ ID NO: 76563
  misc_feature 1..176: note = chr14:23183874-23184050
  misc_feature 1..176: note = Hypo
  source 1..176: mol_type = genomic DNA

SEQ ID NO: 109466 - DNA, 30 bp, Homo sapiens
  misc_feature 1..30: note = chr14:23290879-23290909
  misc_feature 1..30: note = Hypo
  source 1..30: mol_type = genomic DNA
tttttgacagtaatgcgttaaaggcaaaga

SEQ ID NO: 109467 - DNA, 232 bp, Homo sapiens; identical to SEQ ID NO: 76564
  misc_feature 1..232: note = chr14:23291733-23291965
  misc_feature 1..232: note = Hyper
  source 1..232: mol_type = genomic DNA

SEQ ID NO: 109468 - DNA, 23 bp, Homo sapiens
  misc_feature 1..23: note = chr14:23293758-23293781
  misc_feature 1..23: note = Hypo
  source 1..23: mol_type = genomic DNA
actgcgcccggtttttgttgttg

SEQ ID NO: 109469 - DNA, 120 bp, Homo sapiens; identical to SEQ ID NO: 76566
  misc_feature 1..120: note = chr14:23339352-23339472
  misc_feature 1..120: note = Hypo
  source 1..120: mol_type = genomic DNA

SEQ ID NO: 109470 - DNA, 94 bp, Homo sapiens; identical to SEQ ID NO: 76567
  misc_feature 1..94: note = chr14:23355390-23355484
  misc_feature 1..94: note = Hypo
  source 1..94: mol_type = genomic DNA

SEQ ID NO: 109471 - DNA, 43 bp, Homo sapiens; identical to SEQ ID NO: 76568
  misc_feature 1..43: note = chr14:23355778-23355821
  misc_feature 1..43: note = Hyper
  source 1..43: mol_type = genomic DNA

SEQ ID NO: 109472 - DNA, 29 bp, Homo sapiens
  misc_feature 1..29: note = chr14:23356236-23356265
  misc_feature 1..29: note = Hyper
  source 1..29: mol_type = genomic DNA
ctcccaggatgccccggtgtgaccgccgg

SEQ ID NO: 109473 - DNA, 56 bp, Homo sapiens; identical to SEQ ID NO: 76569
  misc_feature 1..56: note = chr14:23399557-23399613
  misc_feature 1..56: note = Hyper
  source 1..56: mol_type = genomic DNA

SEQ ID NO: 109474 - DNA, 206 bp, Homo sapiens; identical to SEQ ID NO: 76570
  misc_feature 1..206: note = chr14:23426887-23427093
  misc_feature 1..206: note = Hypo
  source 1..206: mol_type = genomic DNA

SEQ ID NO: 109475 - DNA, 318 bp, Homo sapiens; identical to SEQ ID NO: 76571
  misc_feature 1..318: note = chr14:23450428-23450746
  misc_feature 1..318: note = Hyper
  source 1..318: mol_type = genomic DNA

SEQ ID NO: 109476 - DNA, 30 bp, Homo sapiens; identical to SEQ ID NO: 76572
  misc_feature 1..30: note = chr14:23537948-23537978
  misc_feature 1..30: note = Hypo
  source 1..30: mol_type = genomic DNA

SEQ ID NO: 109477 - DNA, 30 bp, Homo sapiens; identical to SEQ ID NO: 76573
  misc_feature 1..30: note = chr14:23545233-23545263
  misc_feature 1..30: note = Hypo
  source 1..30: mol_type = genomic DNA

SEQ ID NO: 109478 - DNA, 34 bp, Homo sapiens; identical to SEQ ID NO: 76574
  misc_feature 1..34: note = chr14:23577687-23577721
  misc_feature 1..34: note = Hypo
  source 1..34: mol_type = genomic DNA

SEQ ID NO: 109479 - DNA, 188 bp, Homo sapiens; identical to SEQ ID NO: 76575
  misc_feature 1..188: note = chr14:23652713-23652901
  misc_feature 1..188: note = Hyper
  source 1..188: mol_type = genomic DNA

SEQ ID NO: 109480 - DNA, 100 bp, Homo sapiens; identical to SEQ ID NO: 76576
  misc_feature 1..100: note = chr14:23706665-23706765
  misc_feature 1..100: note = Hypo
  source 1..100: mol_type = genomic DNA

SEQ ID NO: 109481 - DNA, 156 bp, Homo sapiens; identical to SEQ ID NO: 76577
  misc_feature 1..156: note = chr14:23707497-23707653
  misc_feature 1..156: note = Hypo
  source 1..156: mol_type = genomic DNA

SEQ ID NO: 109482 - DNA, 285 bp, Homo sapiens; identical to SEQ ID NO: 43952
  misc_feature 1..285: note = chr14:23776954-23777239
  misc_feature 1..285: note = Hypo
  source 1..285: mol_type = genomic DNA

SEQ ID NO: 109483 - DNA, 809 bp, Homo sapiens
  misc_feature 1..809: note = chr14:23821384-23822193
  misc_feature 1..809: note = Hyper
  source 1..809: mol_type = genomic DNA
cagcgggggcgccagcgtgaagatggggtccgaggccatgcccagagccacgaagagcaccggcaggcagcagaggccgagctgcagctgctggccgccgcccagcgcccccacctgggcgagcagcgcctcaaagctgagggggcctgggggcacggccagcgacaggctgctgcccagtccgtcgccgcccgcgtctccctccccctcccgctcgcgctcccgctcaccctgcagctgctccgtgggcaccgcatctccgagggtcccgacctgctgttggggggcagggggtggcaggagaagggtgaagcggaggaaaccgcagagcaagggcagggggcaggtgggagggagggctaggaaggcagtcaggggcgagggatgcgcaggaggaaaatgccagacgctccgcgggggcgggggtgctgggagaggatggcgtcgccacctggggctcgggcacttactccgttggaggtgggggtgatctctacagtgttgtcgattttgccgccgcccccgccattgggctcgggggtcccggtggccacccggggagccagcttgccgaccgcaggggccctgccggcccgcgccgaaaggatgcgctgtcctctggctcagttgcgcgccggctgcccggacacagacagctcgaagagatcccgctctgcagctctgcagccgcgggcgcctccttggtctctgcgatctctgcgctgctttcccctccccttcctctagactctcctccccttcccacgtcagcagaaccttcggtccagactcttcgtcagagagaggaa

SEQ ID NO: 109484 - DNA, 965 bp, Homo sapiens
  misc_feature 1..965: note = chr14:23834172-23835137
  misc_feature 1..965: note = Hyper
  source 1..965: mol_type = genomic DNA
gtggaggtctctccccggcagcctccactccctggtggactcaccgacgtggcaatggccatggctttggcctcccgcgcagcctgcctcaggccaggctcggttttgctgacttcagcggtggctgccccgcaccatggtccgcggcctctagcccccagctgtggcgcctgagtcgtggcctccgccaaggttggaggaggagaaagaaaacccacaaaacttcccaaatgagaggcaggctagccaggcaggaggaggagcggggcgggccggggcgtcgctgcgggacggcatccaagggcgcgcgctgcgtgctgtccccgcggcctcccgggcgccaccggctcggccaggccccgggagctgcccgccctaggccgcgggggcgccccgggctcgcaggatccgaaaattcccttcccgggccggggcgggtgagcaggcgggcgctgggctgcgctcgacgcctctccaggccgctcaggagagcctcgagggctgggagaagccgccggggcggttgggctggacgagcgagtttaggggccaaccgtctccacccgccggccgcgctgcagagcggtgctcccagggctggggtctgcggcgaccccgctgggaggaagggagagcgagaactgagacgcttgccccaagttgcctggagccaaaggcccccgagagcgtggccgtggggctgggtcgctggagtggccgcttcggcccagacactcgcacccccggcggtgcggcggttttcacgcgcgcactcactcagcgcgcccgggggtctgaggtcgccgctacggcgcctcgccccgggcagcagcaaccagcacgcaggcacccctggaacaggcgggactgccttcccgacgcgcggcctgcgcccaggcggcggaggggcccagcccccttccagtcctcggctccagggcgcagggccacgagctcccgctccc

SEQ ID NO: 109485 - DNA, 94 bp, Homo sapiens; identical to SEQ ID NO: 43953
  misc_feature 1..94: note = chr14:23884288-23884382
  misc_feature 1..94: note = Hypo
  source 1..94: mol_type = genomic DNA

SEQ ID NO: 109486 - DNA, 49 bp, Homo sapiens; identical to SEQ ID NO: 76582
  misc_feature 1..49: note = chr14:23939668-23939717
  misc_feature 1..49: note = Hypo
  source 1..49: mol_type = genomic DNA

SEQ ID NO: 109487 - DNA, 115 bp, Homo sapiens
  misc_feature 1..115: note = chr14:23982352-23982467
  misc_feature 1..115: note = Hypo
  source 1..115: mol_type = genomic DNA
gcttggcactgatctcggggagagagagggagggaggctgggcaaagagcatctgttccctccattctcccagctccatcggctgccaacctagggccatcgtctgcctccatca

SEQ ID NO: 109488 - DNA, 93 bp, Homo sapiens; identical to SEQ ID NO: 43954
  misc_feature 1..93: note = chr14:24021398-24021491
  misc_feature 1..93: note = Hypo
  source 1..93: mol_type = genomic DNA

SEQ ID NO: 109489 - DNA, 277 bp, Homo sapiens
  misc_feature 1..277: note = chr14:24045413-24045690
  misc_feature 1..277: note = Hyper
  source 1..277: mol_type = genomic DNA
gctttcgggacgacgcgccgtcggcgtccccgggcccggccagcacgaagccgccccgggagcccgaggcggggctgcctccctcgtcgcccggcaagggcaggggcgggggtggcgtcggggggtcgctgtggccggaatccagggaggtgcggcggggcgagcgcagcagcgccgcctgatggtagggcacactctggcgtaccccgtagccgtggcgcttcccggcctgccactggccctggtaggtgcctgcgggcggcggaggggtgggaga

SEQ ID NO: 109490 - DNA, 30 bp, Homo sapiens; identical to SEQ ID NO: 76585
  misc_feature 1..30: note = chr14:24608282-24608312
  misc_feature 1..30: note = Hypo
  source 1..30: mol_type = genomic DNA

SEQ ID NO: 109491 - DNA, 91 bp, Homo sapiens; identical to SEQ ID NO: 76586
  misc_feature 1..91: note = chr14:24682617-24682708
  misc_feature 1..91: note = Hyper
  source 1..91: mol_type = genomic DNA

SEQ ID NO: 109492 - DNA, 1031 bp, Homo sapiens
  misc_feature 1..1031: note = chr14:24803463-24804494
  misc_feature 1..1031: note = Hyper
  source 1..1031: mol_type = genomic DNA
aagtctgtcagaacccggacagaaacgagaagcatccaggactcagctttctccctgagcagacccagaagggtagagtgacttgcccagggtcactgcagttcctagccaggctcaatggtcctttctttctctgctcccagcaacgaaaacacatcgaaaagaagaccccacaaaccccaaccccgaaaatgctccccaggtagagaccctcccgcagcagaggctcggctcaccctgccgctggcccaggccactgcgagcagcgccgcgagcgcacagagcacgatccccagcagcagcagcagcagcgggtactgctggctcaggctgtagtaggtctcgtagaagaggtcttcgctggggggcggccgggggctgaagaggcgggccatgatctccccagccccgagccccggggctggctagggccgggcgccgggttacctccttcggcccggcgggccccacctgagcttttctcacccgctcaaagccgctaccaccccgcgcccccaacctcgtggcaatcccgtctcctttttcaggccctccctgcggcctcccagcccgctcccagctggcgatgaggggatccctcagtcctttcctcctcctccctcaaacccggattgtagaggtgccctagaaaagcctcatcgccaggagggcaggatttggggttggtgcgagggagccccgggttcccctgatccccgaactcactgcccgcggcgctggcgcagcggagtgggctaggtccggggagggagccggggacctgatggcggagtcacgctcgccgctgcgctctggctcagagtcccgggcgacaggcgcttccctcccggcgccgcggccccctcccacttccccgacgggacagcccggccccttcctgtgccaaagccggactcccctggtctcctcccgcacttggttttgtctctcctaacaccatcgcctccccgcttcagccccttcagggaagggcaatgtggaccctgggagagatgcgaaggggtgggctg

SEQ ID NO: 109493 - DNA, 152 bp, Homo sapiens; identical to SEQ ID NO: 76590
  misc_feature 1..152: note = chr14:24808711-24808863
  misc_feature 1..152: note = Hyper
  source 1..152: mol_type = genomic DNA

SEQ ID NO: 109494 - DNA, 80 bp, Homo sapiens; identical to SEQ ID NO: 76591
  misc_feature 1..80: note = chr14:24837744-24837824
  misc_feature 1..80: note = Hyper
  source 1..80: mol_type = genomic DNA

SEQ ID NO: 109495 - DNA, 30 bp, Homo sapiens; identical to SEQ ID NO: 76592
  misc_feature 1..30: note = chr14:24860993-24861023
  misc_feature 1..30: note = Hypo
  source 1..30: mol_type = genomic DNA

SEQ ID NO: 109496 - DNA, 153 bp, Homo sapiens; identical to SEQ ID NO: 15809
  misc_feature 1..153: note = chr14:24862082-24862235
  misc_feature 1..153: note = Hypo
  source 1..153: mol_type = genomic DNA

SEQ ID NO: 109497 - DNA, 45 bp, Homo sapiens; identical to SEQ ID NO: 76594
  misc_feature 1..45: note = chr14:24868518-24868563
  misc_feature 1..45: note = Hyper
  source 1..45: mol_type = genomic DNA

SEQ ID NO: 109498 - DNA, 66 bp, Homo sapiens; identical to SEQ ID NO: 76595
  misc_feature 1..66: note = chr14:24901940-24902006
  misc_feature 1..66: note = Hypo
  source 1..66: mol_type = genomic DNA

SEQ ID NO: 109499 - DNA, 30 bp, Homo sapiens; identical to SEQ ID NO: 76596
  misc_feature 1..30: note = chr14:25156087-25156117
  misc_feature 1..30: note = Hypo
  source 1..30: mol_type = genomic DNA

SEQ ID NO: 109500 - DNA, 250 bp, Homo sapiens; identical to SEQ ID NO: 76597
  misc_feature 1..250: note = chr14:25518419-25518669
  misc_feature 1..250: note = Hyper
  source 1..250: mol_type = genomic DNA

SEQ ID NO: 109501 - DNA, 634 bp, Homo sapiens; identical to SEQ ID NO: 76598
  misc_feature 1..634: note = chr14:25518982-25519616
  misc_feature 1..634: note = Hyper
  source 1..634: mol_type = genomic DNA

SEQ ID NO: 109502 - DNA, 309 bp, Homo sapiens; identical to SEQ ID NO: 76599
  misc_feature 1..309: note = chr14:26674308-26674617
  misc_feature 1..309: note = Hyper
  source 1..309: mol_type = genomic DNA

SEQ ID NO: 109503 - DNA, 30 bp, Homo sapiens; identical to SEQ ID NO: 76600
  misc_feature 1..30: note = chr14:26960497-26960527
  misc_feature 1..30: note = Hypo
  source 1..30: mol_type = genomic DNA

SEQ ID NO: 109504 - DNA, 124 bp, Homo sapiens; identical to SEQ ID NO: 76601
  misc_feature 1..124: note = chr14:27066218-27066342
  misc_feature 1..124: note = Hyper
  source 1..124: mol_type = genomic DNA

SEQ ID NO: 109505 - DNA, 85 bp, Homo sapiens; identical to SEQ ID NO: 76602
  misc_feature 1..85: note = chr14:27066596-27066681
  misc_feature 1..85: note = Hyper
  source 1..85: mol_type = genomic DNA

SEQ ID NO: 109506 - DNA, 239 bp, Homo sapiens
  misc_feature 1..239: note = chr14:27067097-27067336
  misc_feature 1..239: note = Hyper
  source 1..239: mol_type = genomic DNA
gaaggaggtggatgccgagagaggagcgagcggcagaggagggcaggagccgggaaggagcgcggcggtccccgcgccgcgctagcgttgcgctcgctcccgctgctggtgctgccgccgccgccgctgccggagcggttctgccgttgcctgggctgctcggcgctgctgctgctgccgcccggtctcgctcattatttctcccgcttgttggggggggctggcggggagggaggggg

SEQ ID NO: 109507 - DNA, 95 bp, Homo sapiens; identical to SEQ ID NO: 76604
  misc_feature 1..95: note = chr14:27067604-27067699
  misc_feature 1..95: note = Hyper
  source 1..95: mol_type = genomic DNA

SEQ ID NO: 109508 - DNA, 205 bp, Homo sapiens; identical to SEQ ID NO: 76605
  misc_feature 1..205: note = chr14:27068077-27068282
  misc_feature 1..205: note = Hyper
  source 1..205: mol_type = genomic DNA

SEQ ID NO: 109509 - DNA, 96 bp, Homo sapiens; identical to SEQ ID NO: 76606
  misc_feature 1..96: note = chr14:29224711-29224807
  misc_feature 1..96: note = Hyper
  source 1..96: mol_type = genomic DNA

SEQ ID NO: 109510 - DNA, 237 bp, Homo sapiens; identical to SEQ ID NO: 35156
  misc_feature 1..237: note = chr14:29225531-29225768
  misc_feature 1..237: note = Hyper
  source 1..237: mol_type = genomic DNA

SEQ ID NO: 109511 - DNA, 534 bp, Homo sapiens; identical to SEQ ID NO: 76608
  misc_feature 1..534: note = chr14:29226033-29226567
  misc_feature 1..534: note = Hyper
  source 1..534: mol_type = genomic DNA

SEQ ID NO: 109512 - DNA, 2202 bp, Homo sapiens
  misc_feature 1..2202: note = chr14:29227651-29229853
  misc_feature 1..2202: note = Hyper
  source 1..2202: mol_type = genomic DNA
cagcaagcagacagacgatatgatatgatcttaagggaccatctccaaaactgaaggagcagagaatgtgtaattcttttcccagtaaatccttccagttcctaggacaagactcaaacgtcccgctaggagctgcagctgcgaggtggagccaaaggctctgacaagtggcttgtgtatgacccaatatttatcaataacaacaacaaaatcaagtgaaaccaaggctgcggattttgaaatgcttctgcagccctggcgtggatatgcacgtgagcgaagtaaaagtcgctggagatgagttggctccacttgtccgccctggggagcaatcctggggcaaaatccagtgctaattgatcccaaccagccacattatcagctgtaaatgttcaaggggacaaagaatgagcattgtgtactaaagatactccaagcattttttcaagtaaatagggacgtgtaatcagtagcgtgtgtatgcatataaataggaaaagagaattatttttaattaattaggaaaataatgtttcatgtgtaattccagaattctctagcgtctcccactgtccgactgttttgtgattgggacttcctctaggaaaacctgcgggccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattcatagttcataggctccggagccaaacttgccgacccagcttttttctcgaacattactttctctcctacgtgccttaggacaaacccagaaggaagacactaaaattgccgaacaagaatctaggattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaactgttttctatatccccgcgtttaccgtggcagatgacctcttagcccaaaattgatttggtgtgtatccggtcttatgtgccaaaaaaagagatacctaggctgaaaaggcaactttaaggggggacatctagagagatgacgcctagaatcaaggcctctggctcgattgcgttcggcaagcgtctgcaacaaaggagcgtcgggcaagctcgcgggtatgcgcagggagcagcggcgcgcagacctgggagccccagctccgcgaagctcctcgaagggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggcttgcttaccccactcatgaagttttctctcctctcattccttcagacctttagtgggtgcaagcatttcctataagatacttattaatctcatatacggaccttgaactgttcaatgttttccgtgtacatttaaat

SEQ ID NO: 109513 - DNA, 378 bp, Homo sapiens
  misc_feature 1..378: note = chr14:29230851-29231229
  misc_feature 1..378: note = Hyper
  source 1..378: mol_type = genomic DNA
ttttgctgaagatcacgggacttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacatttccactctcatagacgaggctctcccatagatttttttactcgaggttctcaagcaaaattgccggtgccacaatgttatgatggaaggatgctgaaatgacaggcctagtagacgcttgtcttaatcatcggcttcttaatttagttttagtgctg

SEQ ID NO: 109514 - DNA, 437 bp, Homo sapiens; identical to SEQ ID NO: 76612
  misc_feature 1..437: note = chr14:29231289-29231726
  misc_feature 1..437: note = Hyper
  source 1..437: mol_type = genomic DNA

SEQ ID NO: 109515 - DNA, 1639 bp, Homo sapiens
  misc_feature 1..1639: note = chr14:29234555-29236194
  misc_feature 1..1639: note = Hyper
  source 1..1639: mol_type = genomic DNA
tccttttaaagcccccgattcgcaatttccccattcacttcaacctccaaccgaaccttcccagttccaaagcccaagaagctgggactgtgagatccacgttcccaaggctccccggtgctttccagcagcactcagggttggcaagagctggcttcagtatactgttatttcaggaatgaggcccgcacaaaataaaagcatttgagaaacggaaaggaaaaaaaaggagtgaaaataggaaggcttaaaaaaaaaaccggaaagaaatagacgcccacccttattttccctccaatgtcaacaagcaaaacgaaaatatttccagggtgatcgctcgcagctacccgcttccaattcggattagaagctgaggctggagcggcgaggagaaaacgacatcgagtcaccccgcgcgtgagcgacgctctggagcaggagagaaggaaaaggaagagacacacgtatatagcatgtgttacctgatttatttcgagattgtttggtactgttttctctctgggcacctctcatttcggaaggccatcagaggcgcccactactgagcggccccggccgccgcagcagcacccggagccccagtcccggtttccccgcggtgccggagcccggagctcgccgccgcccaggcctcaggaatcgagtaagtaacccctgtttggccccgcgctcctctgcccacttcctcctcctcatctcatcgctcccaaagctctcccacaccctcctcccccgaagtaaaggacacccccgcacacacgccagcggtgggccttatctccccccttatccaaagctgcgctagactattacctacaaagggcacaattttcctgctggctcagaaatgccagacactggcctgcaaggccgactcggaaaagtagtgcctcgcctctacctcctccatttcctgccctctcgcatcctctccctgcactcccactcttcccactaccaccaccacccccgctttcaaaaataaaattggatacaaactttaatcactaaggacaaatattgacgcttaaacgaaaatgacccagtacaatgaggaggaagccggaaatgtgagctattggccctaggaggggaatttcggtggagcggagccggcggggtggagggggtggcgggggcgcagggaagggctgcggcaccgcgtgctcccgccggcgtatccctacgcggctccgcgcggcctcggggtccgaggcccgcggagagggggaggcgagcgcccgagggggcggcagccggcgggcggggcgggggtgggtgggcccggcccctccgattggtcgacggcgagagagacgctcccgcacgccgccagctctgattggcccagcggtaggaaaggttaaaccaaaaatttttttacagccctagtgtgcgcctgtagctcggaaaattaattgtggctatagccgcctcgatcgctgtctccccagcctcgccgcggccgctccgggacgcgcccgcccgccgcccggctctccccccctttgggctgctgctgctgctgctgtgactgctgctgcgagaggaggaggaggaggaggaagcagcgggggggggagcggggggtggggggggagaccaagaagtacagttg

SEQ ID NO: 109516 - DNA, 360 bp, Homo sapiens
  misc_feature 1..360: note = chr14:29236254-29236614
  misc_feature 1..360: note = Hyper
  source 1..360: mol_type = genomic DNA
cttttcctttttttttttttttctaattcctgaggggtggttgctgcttttgctacatgacttgccagcgcccgagcctgcggtccaactgcgctgctgccggagcgctcagtgccgccgctgccgcccgcgccccccgcgccccgttcggcacccaccggtcgccgccgcccgccgcgccgctgtcccgctcccgcgccgccgccgccgtttccccccgacgactgggtgatgctggacatgggagataggaaagaggtgaaaatgatccccaagtcctcgttcagcatcaacagcctggtgcccgaggcggtccagaacgacaaccaccacgcgagccacggccaccacaacagccac

SEQ ID NO: 109517 - DNA, 1219 bp, Homo sapiens
  misc_feature 1..1219: note = chr14:29236674-29237893
  misc_feature 1..1219: note = Hyper
  source 1..1219: mol_type = genomic DNA
caaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggacgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacaagtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccgcgtcctcctccacgtcgccgcaggccccctcgaccctgccctgtgagtctttaagaccctctttgccaagttttacgacgggactgtctgggg

SEQ ID NO: 109518 - DNA, 102 bp, Homo sapiens; identical to SEQ ID NO: 76623
  misc_feature 1..102: note = chr14:29242506-29242608
  misc_feature 1..102: note = Hyper
  source 1..102: mol_type = genomic DNA

SEQ ID NO: 109519 - DNA, 114 bp, Homo sapiens; identical to SEQ ID NO: 76624
  misc_feature 1..114: note = chr14:29243157-29243271
  misc_feature 1..114: note = Hyper
  source 1..114: mol_type = genomic DNA

SEQ ID NO: 109520 - DNA, 779 bp, Homo sapiens
  misc_feature 1..779: note = chr14:29243513-29244292
  misc_feature 1..779: note = Hyper
  source 1..779: mol_type = genomic DNA
ttaattagcttttcccggcgcctcagggactccggggtgaagatggagaggtggcataatggcgggacttgaagtcgttgtggcagggacctggcagcgttgttttctcgggttttgaaccggtgtggagaagtaacttcagctgctgagttggggccgccctggctgcgcggtggcggaggaggagaggagaagcgctctcgggacattgcggcggcgatccccgcagagggtgaagccgggcgctgcgcagggagcagcaacatgagggcgctcttgcccaggacaagcagagctgtacgtttgggtagctcatattggctgatgccaagaaaagtgacttcagaaccttggctggcgcgcttccctaccttttccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcagagtaccccgcgagtgcggagattttcaggctgtaatcttcagtctgggaaaggcgatgggaaggaagg

SEQ ID NO: 109521 - DNA, 645 bp, Homo sapiens; identical to SEQ ID NO: 76627
  misc_feature 1..645: note = chr14:29247097-29247742
  misc_feature 1..645: note = Hyper
  source 1..645: mol_type = genomic DNA

SEQ ID NO: 109522 - DNA, 1046 bp, Homo sapiens
  misc_feature 1..1046: note = chr14:29254087-29255133
  misc_feature 1..1046: note = Hyper
  source 1..1046: mol_type = genomic DNA
agtggctcatatggtcgttctgtgttttgtagaatacgtaggggactcctgaaatgtgtgggatgtaggtaggggcgggagcgactctgtggggagagaagggagaaaaagattgagagaaggaaagagaagtgtatttgcaaggcaggctgacaatttctcaattaatttggggcagagacagaaagactccgagtttctagcttcttttctatacctcagataaaaaactgaagacagccttattctaacaactcaatttaaaaagagcccccctgcgtacgtccccgcacccctttcgccccagcggccgctcacaaagcgccacccgcgcctcgggcgcccgcagaagccggagccagttctcagccctgatcgccgccagccgcccaggcttcggggaaggagggaggggagaataatgcgcccctctttcaataaacgccactgccaaccactccaacagacacactttcggtcccccgccagagctccggtgcccccgagtgaccgctttctgcgatcgcgtccgccgggaccccgtccctctttccccttcagtcttcagggagggggaggcgctccgcattagcggggcagttcagcaaccccgaccccacccgcgtggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttt

SEQ ID NO: 109523 - DNA, 30 bp, Homo sapiens; identical to SEQ ID NO: 76630
  misc_feature 1..30: note = chr14:30066780-30066810
  misc_feature 1..30: note = Hypo
  source 1..30: mol_type = genomic DNA

SEQ ID NO: 109524 - DNA, 23 bp, Homo sapiens
  misc_feature 1..23: note = chr14:30126794-30126817
  misc_feature 1..23: note = Hypo
  source 1..23: mol_type = genomic DNA
gggcgcagtggctcacggctgta

SEQ ID NO: 109525 - DNA, 30 bp, Homo sapiens; identical to SEQ ID NO: 35181
  misc_feature 1..30: note = chr14:30396081-30396111
  misc_feature 1..30: note = Hyper
  source 1..30: mol_type = genomic DNA

SEQ ID NO: 109526 - DNA, 128 bp, Homo sapiens; identical to SEQ ID NO: 76633
  misc_feature 1..128: note = chr14:30396380-30396508
  misc_feature 1..128: note = Hyper
  source 1..128: mol_type = genomic DNA

SEQ ID NO: 109527 - DNA, 478 bp, Homo sapiens; identical to SEQ ID NO: 76634
  misc_feature 1..478: note = chr14:30396920-30397398
  misc_feature 1..478: note = Hyper
  source 1..478: mol_type = genomic DNA

SEQ ID NO: 109528 - DNA, 57 bp, Homo sapiens; identical to SEQ ID NO: 76635
  misc_feature 1..57: note = chr14:30739946-30740003
  misc_feature 1..57: note = Hyper
  source 1..57: mol_type = genomic DNA

SEQ ID NO: 109529 - DNA, 142 bp, Homo sapiens; identical to SEQ ID NO: 76636
  misc_feature 1..142: note = chr14:31027434-31027576
  misc_feature 1..142: note = Hypo
  source 1..142: mol_type = genomic DNA

SEQ ID NO: 109530 - DNA, 34 bp, Homo sapiens; identical to SEQ ID NO: 76637
  misc_feature 1..34: note = chr14:31309552-31309586
  misc_feature 1..34: note = Hypo
  source 1..34: mol_type = genomic DNA

SEQ ID NO: 109531 - DNA, 1298 bp, Homo sapiens; identical to SEQ ID NO: 76638
  misc_feature 1..1298: note = chr14:31343340-31344638
  misc_feature 1..1298: note = Hyper
  source 1..1298: mol_type = genomic DNA

SEQ ID NO: 109532 - DNA, 157 bp, Homo sapiens; identical to SEQ ID NO: 76639
  misc_feature 1..157: note = chr14:31534496-31534653
  misc_feature 1..157: note = Hypo
  source 1..157: mol_type = genomic DNA

SEQ ID NO: 109533 - DNA, 40 bp, Homo sapiens; identical to SEQ ID NO: 76640
  misc_feature 1..40: note = chr14:31713750-31713790
  misc_feature 1..40: note = Hypo
  source 1..40: mol_type = genomic DNA

SEQ ID NO: 109534 - DNA, 100 bp, Homo sapiens; identical to SEQ ID NO: 43959
  misc_feature 1..100: note = chr14:31925624-31925724
  misc_feature 1..100: note = Hypo
  source 1..100: mol_type = genomic DNA

SEQ ID NO: 109535 - DNA, 172 bp, Homo sapiens; identical to SEQ ID NO: 76642
  misc_feature 1..172: note = chr14:32597712-32597884
  misc_feature 1..172: note = Hypo
  source 1..172: mol_type = genomic DNA

SEQ ID NO: 109536 - DNA, 82 bp, Homo sapiens; identical to SEQ ID NO: 76643
  misc_feature 1..82: note = chr14:32671453-32671535
  misc_feature 1..82: note = Hyper
  source 1..82: mol_type = genomic DNA

SEQ ID NO: 109537 - DNA, 16 bp, Homo sapiens
  misc_feature 1..16: note = chr14:33163277-33163293
  misc_feature 1..16: note = Hypo
  source 1..16: mol_type = genomic DNA
gtccatggggccaggc

SEQ ID NO: 109538 - DNA, 936 bp, Homo sapiens
  misc_feature 1..936: note = chr14:33401981-33402917
  misc_feature 1..936: note = Hyper
  source 1..936: mol_type = genomic DNA
cacagatgctcattacgattctttttacgtgcaacacgtgggggacgaagcagtttcatatctcctggtattatctgccgtccaaagcattttctttgaaaggaaaatggaaacgcagctgcgccgtgggcccggccagcgagagctggggctccctccctctgtttcccagcggctgccgggtgcaggaggcgcctccggaaactgacttgggttaggggagttcagaggttgccccagcaggcgcgggacgccgccagggcgaaggctcgtctttgtgcgggttggctgtttcccgagagccatcagggtgggaggggacgcccgggtctgcggcaagggcaggcgtctggcccctacaccgtgtgcggggacgctaggctgggcggcctgtgtcactcttggccttggcaacttctggccaatccgccctgcccctctgggtcccggcgggccggctgcgccctaggctcaaagggttaagcaggtgcctctccgggcgaggcgctattggccgagggctggggcggcgcggccgcggtcaccacgcttcgccgatcccaacttgggttcctgcggaaggcaaggcggccactcgtcccctggctgcggctgcggggcccaggccttggcgcgcagggagtgggaaggagaaaaggacgagaaggggcaagcaccagccgcaccagcaaagggggcgagggtggcgcgcgcaagatgaggggagctgaagccctgcatcccgaaggaggctgcgcccaccgcccgcaactccactccaggctcgccagccggaagaaagaggaggaagtgggacaacgggggtcctgggcaggggtaggggaaacgatcaactcccactgcccccacccactagtcgagttggaatgcaagtcgtcacttaaaaaggctcacccaaaccgcaggcatacctcc

SEQ ID NO: 109539 - DNA, 1208 bp, Homo sapiens; identical to SEQ ID NO: 76648
  misc_feature 1..1208: note = chr14:33403210-33404418
  misc_feature 1..1208: note = Hyper
  source 1..1208: mol_type = genomic DNA

SEQ ID NO: 109540 - DNA, 88 bp, Homo sapiens; identical to SEQ ID NO: 76649
  misc_feature 1..88: note = chr14:33407604-33407692
  misc_feature 1..88: note = Hyper
  source 1..88: mol_type = genomic DNA

SEQ ID NO: 109541 - DNA, 27 bp, Homo sapiens
  misc_feature 1..27: note = chr14:33407752-33407779
  misc_feature 1..27: note = Hyper
  source 1..27: mol_type = genomic DNA
cgtacgagagagcgctctggagcaaag

SEQ ID NO: 109542 - DNA, 98 bp, Homo sapiens; identical to SEQ ID NO: 76651
  misc_feature 1..98: note = chr14:33408303-33408401
  misc_feature 1..98: note = Hyper
  source 1..98: mol_type = genomic DNA

SEQ ID NO: 109543 - DNA, 204 bp, Homo sapiens; identical to SEQ ID NO: 76652
  misc_feature 1..204: note = chr14:33408623-33408827
  misc_feature 1..204: note = Hyper
  source 1..204: mol_type = genomic DNA

SEQ ID NO: 109544 - DNA, 84 bp, Homo sapiens; identical to SEQ ID NO: 76653
  misc_feature 1..84: note = chr14:33408887-33408971
  misc_feature 1..84: note = Hyper
  source 1..84: mol_type = genomic DNA

SEQ ID NO: 109545 - DNA, 30 bp, Homo sapiens; identical to SEQ ID NO: 76654
  misc_feature 1..30: note = chr14:33801361-33801391
  misc_feature 1..30: note = Hypo
  source 1..30: mol_type = genomic DNA

SEQ ID NO: 109546 - DNA, 20 bp, Homo sapiens
  misc_feature 1..20: note = chr14:34408709-34408729
  misc_feature 1..20: note = Hypo
  source 1..20: mol_type = genomic DNA
ccggccgaaacaatcttaaa

SEQ ID NO: 109547 - DNA, 242 bp, Homo sapiens
  misc_feature 1..242: note = chr14:34419561-34419803
  misc_feature 1..242: note = Hyper
  source 1..242: mol_type = genomic DNA
ccgcgggagcagctgcggcagggcgccgagcgcgtcctaccttagacctctccttgacgtagtatttgcccagccggctcccgcagtagaggaccagcctgtcgatgagggacaggaggaagctgatggcctcgcagccctcctcgttgcccccgatccacgtgatctggtcgccccgcaggtgtcgcttggagacgccggcgcgcggccccgccagctggccgtcccgcagggccccggtg

SEQ ID NO: 109548 - DNA, 367 bp, Homo sapiens; identical to SEQ ID NO: 76657
  misc_feature 1..367: note = chr14:34420004-34420371
  misc_feature 1..367: note = Hyper
  source 1..367: mol_type = genomic DNA

SEQ ID NO: 109549 - DNA, 53 bp, Homo sapiens; identical to SEQ ID NO: 76658
  misc_feature 1..53: note = chr14:34499201-34499254
  misc_feature 1..53: note = Hypo
  source 1..53: mol_type = genomic DNA

SEQ ID NO: 109550 - DNA, 213 bp, Homo sapiens; identical to SEQ ID NO: 76659
  misc_feature 1..213: note = chr14:34529691-34529904
  misc_feature 1..213: note = Hyper
  source 1..213: mol_type = genomic DNA

SEQ ID NO: 109551 - DNA, 19 bp, Homo sapiens
  misc_feature 1..19: note = chr14:34554235-34554254
  misc_feature 1..19: note = Hypo
  source 1..19: mol_type = genomic DNA
gaactcagccaggtgcggt

SEQ ID NO: 109552 - DNA, 23 bp, Homo sapiens
  misc_feature 1..23: note = chr14:34920639-34920662
  misc_feature 1..23: note = Hypo
  source 1..23: mol_type = genomic DNA
caattctaggctgggcgcggtag

SEQ ID NO: 109553 - DNA, 16 bp, Homo sapiens
  misc_feature 1..16: note = chr14:34921211-34921227
  misc_feature 1..16: note = Hypo
  source 1..16: mol_type = genomic DNA
tagcgtggtggctcac

SEQ ID NO: 109554 - DNA, 80 bp, Homo sapiens; identical to SEQ ID NO: 76663
  misc_feature 1..80: note = chr14:35009476-35009556
  misc_feature 1..80: note = Hypo
  source 1..80: mol_type = genomic DNA

SEQ ID NO: 109555 - DNA, 180 bp, Homo sapiens; identical to SEQ ID NO: 76664
  misc_feature 1..180: note = chr14:35017114-35017294
  misc_feature 1..180: note = Hypo
  source 1..180: mol_type = genomic DNA

SEQ ID NO: 109556 - DNA, 461 bp, Homo sapiens; identical to SEQ ID NO: 76665
  misc_feature 1..461: note = chr14:35023150-35023611
  misc_feature 1..461: note = Hypo
  source 1..461: mol_type = genomic DNA

SEQ ID NO: 109557 - DNA, 92 bp, Homo sapiens; identical to SEQ ID NO: 76666
  misc_feature 1..92: note = chr14:35024362-35024454
  misc_feature 1..92: note = Hypo
  source 1..92: mol_type = genomic DNA

SEQ ID NO: 109558 - DNA, 30 bp, Homo sapiens; identical to SEQ ID NO: 76667
  misc_feature 1..30: note = chr14:35032127-35032157
  misc_feature 1..30: note = Hypo
  source 1..30: mol_type = genomic DNA

SEQ ID NO: 109559 - DNA, 43 bp, Homo sapiens; identical to SEQ ID NO: 76668
  misc_feature 1..43: note = chr14:35133216-35133259
  misc_feature 1..43: note = Hypo
  source 1..43: mol_type = genomic DNA

SEQ ID NO: 109560 - DNA, 35 bp, Homo sapiens; identical to SEQ ID NO: 76669
  misc_feature 1..35: note = chr14:35507693-35507728
  misc_feature 1..35: note = Hypo
  source 1..35: mol_type = genomic DNA

SEQ ID NO: 109561 - DNA, 30 bp, Homo sapiens; identical to SEQ ID NO: 76670
  misc_feature 1..30: note = chr14:35838869-35838899
  misc_feature 1..30: note = Hypo
  source 1..30: mol_type = genomic DNA

SEQ ID NO: 109562 - DNA, 107 bp, Homo sapiens; identical to SEQ ID NO: 76671
  misc_feature 1..107: note = chr14:35866805-35866912
  misc_feature 1..107: note = Hypo
  source 1..107: mol_type = genomic DNA

SEQ ID NO: 109563 - DNA, 404 bp, Homo sapiens; identical to SEQ ID NO: 76672
  misc_feature 1..404: note = chr14:36002600-36003004
  misc_feature 1..404: note = Hyper
  source 1..404: mol_type = genomic DNA

SEQ ID NO: 109564 - DNA, 1468 bp, Homo sapiens
  misc_feature 1..1468: note = chr14:36003546-36005014
  misc_feature 1..1468: note = Hyper
  source 1..1468: mol_type = genomic DNA
ggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacggactgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgg

SEQ ID NO: 109565 - DNA, 93 bp, Homo sapiens; identical to SEQ ID NO: 76677
  misc_feature 1..93: note = chr14:36458302-36458395
  misc_feature 1..93: note = Hypo
  source 1..93: mol_type = genomic DNA

SEQ ID NO: 109566 - DNA, 30 bp, Homo sapiens; identical to SEQ ID NO: 76678
  misc_feature 1..30: note = chr14:36790254-36790284
  misc_feature 1..30: note = Hypo
  source 1..30: mol_type = genomic DNA

SEQ ID NO: 109567 - DNA, 1160 bp, Homo sapiens
  misc_feature 1..1160: note = chr14:36972706-36973866
  misc_feature 1..1160: note = Hyper
  source 1..1160: mol_type = genomic DNA
ctgactttattcttacggaattaaacacaataatttttttaaaatatcttctttgaggcaagtgaccacgagagcacctgttatttaaaagtttattgggtagtttaaaaagcggtgtctccctcttcccccttcaaaaataaatggcattgaagtcctccgtttctcttgtttagatcctgcggttggctcgctcatgaatattaactgagaaaggtgaagcagtaatttagggaatcgaatcaaactcactaggagcaaagaagtggtcctgaatcaaaatggaataaacgataacccagagtcattgtcaagtctcccaaatgaagagatgttctgggtaaataaaagtgacaaagtcgtaccacataaacaaatgtagaagatagatgccccagatcaagaaatactactaaagtgacctgacttgacagtaattgcaggcagcttttgagaactgcatcggggttaaacggcagagatcctgacgacctgggcgaccgtccctgcgcagcccggcgggaggctgcgcccagaatcctgggctttgggcctctggggcccggcgaggagatgaagaagtcaagcctcgagctctccggaggttcgatggccgccgggccagtgcgggctcagaggaagaccctgcaaaaaagagcgctcgcccccacccctggagccgaccctgcgcagtagggccgcagccggtccccgcgggcagctcagcgggcgcgggcgggaggctcccggaacgcaggctgaggtcaggctgaccacgccgcctcctcagtcgccgtatcgcggggctggcggccagcgccttagaagagcctgctccgccgcaggaagaaagacgcccgacaggcgcccactgcccgaacccacgcgggggccagtcagccagcgggccgtgttgggaaagctccgcgcggcggcgggacataggatccccatcggggacctgggcgacggcctgagcttgggcgcccctccagctgggcgtcatctccacacagttcttcccttgcgccgcgaattcagcccctgtgaagacgctttgggcattggcgagcaacaggggaaaaaacgagtcacttaaatgggagaaggaaggggatggtcatgaggacttggaggaaaccacacggaaaagaaatcct

SEQ ID NO: 109568 - DNA, 1025 bp, Homo sapiens
  misc_feature 1..1025: note = chr14:36974507-36975532
  misc_feature 1..1025: note = Hyper
  source 1..1025: mol_type = genomic DNA
gagatgaaacaaattcgcccaaaagatagaaatctttgcctcggaaattatcggagaatattaacggagagggaggggagcgcgcgggtcgccgaggaaggacgcgggtacggccccttgctttggggtggcagagccgggctcaggagccagccaagctgacttcgcgaggtggcgcctgggcctttcgggggaaagccccgacggcggagccgcggctgggcggggactcaaatgctggcggcctctgggctggggccgagcagggggtgccgaccgcgggaagtctgggcggccgccctcccacccagacgagccgatgctgggccgcggtccctctcagctacctcgcttgcccgcctcggggcccctggagaggggtctgtgcctcccaggcagggaagcgtcttgatgtgcaccccggcgttcaccaaccaaataagggcctcgctcacacagtcgatgtcatgctgggtattaaaagggttgtgctgcagctaaaatatctcacagtgtgtgtgaacctcataaaagggaggacccggattccaagcccctcgaagtccccaagcagcctggagggtgggggactcccctctccttctctccacactgagcccccgggcaagcccaggcctcctcctgcgccggggtccccgggctccgaaactgcgagagccctgcggagcccggccagaggggcagagggtgggggctgggggcggggacctggggggtgcagcccagccagaacccgcggcctagcctgatcgcggggagccgggatccgccttccatcctgggaaacgactcgggttagggaagcgggatgggctccgctcggagttcccaggcagctggggcgccctccaagtgacgcctttgtccaggctgcgctcgcggagaataaagggggcgctgtccaacctcaggttcggggaaaaccaaggaaccaagggactctttttctaaaatgccctctccaaactacagggaggaggaatgggacacgtgtgcagaaaaag

SEQ ID NO: 109569 - DNA, 30 bp, Homo sapiens; identical to SEQ ID NO: 76685
  misc_feature 1..30: note = chr14:36976704-36976734
  misc_feature 1..30: note = Hyper
  source 1..30: mol_type = genomic DNA

SEQ ID NO: 109570 - DNA, 1345 bp, Homo sapiens
  misc_feature 1..1345: note = chr14:36977343-36978688
  misc_feature 1..1345: note = Hyper
  source 1..1345: mol_type = genomic DNA
caaagaaagattgtgcgttaagatcttttttaaaaatccctgcaagttagagtttgcatcatcgtcgtgacctagtgaactaatatttgtatattctgggatcgaaattccgaggaagtttctgctcttccgcacaccagacttgccggtgtggtctccaggaggggttgggggccgcgtcctcagggggcgcgcggccgaggctgttcccagcgcgggaacgggagggagaacctgggcaggggcggggcggggcggggcgcggggacctgggtacgcggagacgcggggcgggcgggggccgagagcgaggctgccggctgggtgttgggagagaggccgcgggtggacggggtaaggactgggactggggagactgagagctggggggtgcggggaggatgaggctgcggacaggaaacgaagggcctgggacagctgcttctcttggtcctagaaaccaaactttcgtagcgagagaccctaagacagctcgagatttcaagtgtccacacttctagtttagacatttggcaaccaattcggaacagccgggccgcgaggggcccccaggtctttggcggcgtcgttgggaggccgcggagttgtccctgggcttccctgaaggccccgcagactccccgccagtcccggccacacccagccagggctttgcagctccagcctgagaatgttagccccggcaaccccttctggcggttgttcctttaaaaaccaattcattttttccatcaagtcttctacccaatgggtagactcttcgttaaatgactgttaaccagtactgaggagaagcacaatcaacatagtttctctgtcacctttcttgccggttttttcctcccaaccatggagtctccattttctaagcaattaaattatatattcaacaggaacattccatttaaaatggttcgggacagaagactgatgcacaaggtctgaagctggaagaaaatatttagtgcttgcctacagattctgtcacccatcatctgctcggaatgcgctccgtatctttcagcgtgtccggctcttatgattgcaaatggccctgttttcaaatggaaataagacttgcaaactgattatgtgtattgaatcagaatcactcgctagatcctcttgtttaaaatgtattgaaaaaaggatgatgggtgcagacctctgtaaccagctctgtctcttctctgggaggtcgatctattttgcaactttttgccatttgagcgtgtttcagccagataattacgttgccattgtgttaccggcccaaagctcagacagggtacacacaccaccacccagccgtctcccaggccct

SEQ ID NO: 109571 - DNA, 67 bp, Homo sapiens; identical to SEQ ID NO: 35211
  misc_feature 1..67: note = chr14:36979742-36979809
  misc_feature 1..67: note = Hyper
  source 1..67: mol_type = genomic DNA

SEQ ID NO: 109572 - DNA, 2774 bp, Homo sapiens
  misc_feature 1..2774: note = chr14:36981839-36984613
  misc_feature 1..2774: note = Hyper
  source 1..2774: mol_type = genomic DNA
gaacatggtgtccagcgtctcctaaccaggatctagccgagcagagaaaacattcagcctcctccctcccaatacccgtgtctgtcactttctttccattcaaaaagaaagtcctagttgaactaaacaagccagtaacccatgcctaagaatcatatcatctcagattctcatctcccaatgggctttctagttctccacaaataaaatcgtctactctgcttcctcgcgctaataattggggggtggggagcagggaagggagagcgatgtctggagacatatgatcagaattcaaggcagcttctcacaactctcttgtttatagaaaatgaatgtctgcctggcttgcttttagttcagaaaaggggtcagtctttatcagcacggttcacacagatcctggattttttttcccttatcttaaattgacccgcttttaagataaagacataatagagaaagcattgaccttacctggtccctaatgagttggaagtcagaaaacccggctctcatttcctcttatctggatcgcctgagaagagactcgcgctaccttttgtgcactcgcgcctcgagatagcccctcactgacgcctggacgcggtgagcgcgctgaaggctgtgcggcctctaaagtctcagaattcctccctgcggcctcaaaattggagagttggattccagaccaagacactgtcactagagctccctagccctggcccaggaagatttaaaatcccttaaaatcccttagacttgctcccgagcaagtctttccctatgaaaggccaaactctaagcttcgtgaagaagcctcctacaaggacactggtctggagcgcccgggcctccgcgtctccaggagtgcgcgcccagagcgtttctagcggagactgcccaggcctggctcggatttcagtcgcggggccccaggctacttcccaccgggccagcagcagggccgagccgctgccctgttggctgaggcattccctgcccccacccccctcctggccttgaggaccgcagtgtgtacccttgttggtagcggcagcagcccgggatccctgtctcccctgctcagagcatctctgtctcgctcttctccccgcttctgagcttggcccagtccctgaccccctcgctagctgagagagctgctttccttcctctcctgcccacagctcccagttcccaggctggggccagggtggggagcagctttgggatgctaaacatcaaaaaagcccagcctggggtttcagggcccgaagccactagagcggctctccaaggctctcgagaaagtcctagtgtttacatggcgaagtgggggtggggagaggaggaaggggggtgcagtgtgcaaaatctcccccactcctctcagccgttggggcctagggatgggtagggtactttggcggaggcaaagcttcgcggtgatctcggggtgaaccgtacttgctcccaaacctcggaagcttccaagcacctcagcgccaggggcatcctcagaatgctgatttctccgagaggggaggccagaaattgggcacgagttgatgcaggagattcccagaaaggaggactgtcggctttccagaagccgacggtgctgtaggggcggagggtgtccccaggttgcggaaccctcttgcactgctcccagcgcgcacctatttccctaatgaaacgcttcagattgcgttctaggtctcttcccgcagctgcgacaattcccccagccgggagcgggagcggatggagccagcgtaattgatggcaagaaagaggctgaggtcctgtttgtctcggtccgcaaacccgattgagttcacctttccccgggacaagtaaacagacttcaaactatgccgactgtagacggcgaggagaagaatgtatttgatggaaactccatccaatgcaaagatgataaggccgagggtgccacagcctactaaaattgtgactcccaaaggcttcctcccagctagaatggggtgcggggcagccgccagaaccacagccgggcaccgccagccaggtccccgcccgggcttgggctaggctggggcaggttaagcgaagctccaattccgtgggatccggacctagagccaaacagcagctgcagtatccatgtcccctgcccggccggcctgagctgggtgccttagccacctacactcccggtcccggaaccacagctgaccattccaacgcaagtggtcaaatttgtttgttttccaaaacgtgagacctgttaaaatctcccttccccgccttccaacaagcactctcactagacccaaccatcctcttgggaatcttcgagtccctctggctgttggaaactgtgtctcagcagtgaggcccaggtttctgagggagaaagcccggcctagcccacagtcttaaggcaccacgccagaggaggctccaggaagttaacaaagaggactgctgggcccggagcgaggactccggccagtctgctttcctcacaagctcttggtgggggagcgggagagagggattgggaagagatgcagacgaataacgaaatgagagaggggaagagaggaagaaaaagaaagttgaaaacctgggcgagaagtgagtacatgccaaataagaatcaattgcccataatccaatacttccaggcctagaggaaagtgctgggaggggcgtctgcccgcagctggctcagctgcctttcgaccggagatttggcaagggtgacccggaagggctacagc

SEQ ID NO: 109573 - DNA, 98 bp, Homo sapiens; identical to SEQ ID NO: 76693
  misc_feature 1..98: note = chr14:36985841-36985939
  misc_feature 1..98: note = Hyper
  source 1..98: mol_type = genomic DNA

SEQ ID NO: 109574 - DNA, 2013 bp, Homo sapiens
  misc_feature 1..2013: note = chr14:36986140-36988153
  misc_feature 1..2013: note = Hyper
  source 1..2013: mol_type = genomic DNA
tgtgccccgccctagcgtggaaaacccatttgaatcaccaaaaaaagacaccccaaagctgttttatgcccttctctgcttaaagattccttgagattggatgcgcttggttgtttttcattttctttttttaaaaaaaaaaacccacaaattttagggggggaaaaaaagaaagacgtccagcagtttggcctttgtggtttttttgttccttggtctaaacgcggccaggttgttaagaaaagtcgaagcgcgtggagcagcggtggatggtggtctgtgtggcgggcaggagggaagcggtgaggcagagcgctgggctagggccggcccggcgtcctctcaccaggtccgaccgtatagcaaggtggagcaggacatggtgccgtagtccgagcccgaggagttcaggtgggacaggctggatacctggccctgcagcgccgcggggctggcggcgtggtgcgccaggtccggagactggcctgcgctgcctggctggtggcccgggtgtgcgccaaggccggcgccaccgctgcccacggagatggccgctgccgccgcctgcgcggcctgcgcctggtgctgcgcctgctgctgcgcgtggccttgtaggctggcggcgcccggcgcgggggcacccgcctggcacggtttgccgtctttcaccaggaccggcaccgccacgcgtcgcggcgactgctgctgagcctgttgctgctgcgggcacccggtgcccccgccgcccccgccgccgccgctgtcctgctgcagttgctgctgcgccgccttgtccttggcctggcgcttcattttgtagcggtggttctggaaccagatcttgacctgcgtgggcgtcaggtggatcatgctggccaggtgctcgcgctccggcgccgacaggtacttctgttgcttgaagcgtcgctccagctcgtacacctgcgcctgcgagaagagcacccggcgcttcctgcgcggcgcgcttggcagcggggccatgttcttgctcacgtcccccagcgagcccaggccgcccatgccgctcatgttcatgccgctcgccgggcccatgaagcgggagactgtaagcgacaaacgcacagcgtcggccggggccaggccgagccaggccacccctgttttccgcgccattggcccgcccggcccgccccaaccgacggcgccctcctgacccaggcagcctagcgctggggcccaagaggcccatccgcggggaactgccagcgcctgccccaggccgtaccgtcgagggggctgtactggagcgctcacagccccaaccctggctgccctccctcagtctcagttccctctttcgaaccaaaagacgcagtgggggaaaggccgcttctgctcctttcgtgcccagcccgggtcagagcattaggattagctggccacaggcggcgaactgggctcaggccgggagctggggtcctacggtagaccccagtttggagaggttaggagagggggtgttgacttccaaaagctggagcccccagacgctttgcctcttggcttctctcctgtcaggccccagtgagggcacctgctcggacccttagagtcccctctggaactgcgagtcctcccacctgcccagactccgctggagagagggccgggccgggcgctcgagtgcctcccaacagggcagcctccctcctggcccggtctagcctctccgcgctctgctcgcccctgctccttgagctcggggtcgcttcccttggctccccgaggtcttctgcgccgagcagagctgccagtccaccgcgcctaggagacgccgagtacccgcatctgaccgcaggaccccagcgctaccaagtgcctgttcttggacccccagccgagcagggggaagcatccccagctcccgcacccaagtccctggcgccgctgccgggccgccctccctgatgcccagcgcgcagcctgccggcgccgcgccttctggacggctctcgccgcacctcctgagct

SEQ ID NO: 109575 - DNA, 93 bp, Homo sapiens; identical to SEQ ID NO: 76696
  misc_feature 1..93: note = chr14:36988551-36988644
  misc_feature 1..93: note = Hyper
  source 1..93: mol_type = genomic DNA

SEQ ID NO: 109576 - DNA, 2151 bp, Homo sapiens
  misc_feature 1..2151: note = chr14:36989186-36991337
  misc_feature 1..2151: note = Hyper
  source 1..2151: mol_type = genomic DNA
tcggtcggggttccccgggcacggacaggtctttaggaggagggggctgagggacagggtgggggtttcacctgagcctgccggggctgctcctccctcccgccgcggcctcccagccccgcgccttcccactgcctccggaccacatcgggcttcgctgcgctgagccccagtcgccaacaaatgagcgagcgagtctggggacgaaccctggggccgcactgttggtctacgtgtctgtcagtctgtctgcctctcttctgccgccgtcagagggacacctctgctccccgccccctttccccctaccggagagaatccgagcgggcggagggggcgctgagtaggggatcgactgcctcccggaggctgtcccggatccccgagccacaacccgcccccgcagctcaggggtttttcagtgggccacccccgctaacacgcctcccccaaggtcttccccccccccccccacccccggccgagcaaacacagcactggcccccagagctgggaggatgggaaggggtctcacgggagggtccgtcactgaagttgccccacctcgaacaaacctggtgtccctgaccctcgcccatctcccagacacgcggggatctggggctggagctgactttccgaggacatcacagccccagcacccgagcccagagccacgctgttttcccctctgatgcttcagggagcgcgcgagcagggagcggcgtgagtgcccgtctgtctgttgccgggcggaactgagcctgaaccccggcggctggagcgctggccaggagggggcgaatgccgaggtgcgggcagctcagcgggcgggaggctgggccgaggctcgcctccgcccgcagctcagccatgcaaaagtgctcttgcttcccgggaataaccaaatatctttgtttaaagtggtggcgtaaatggccagtcgctttgtggccacgctggatattagtagatgaggatcattctgcttcaattgggcgcctctcatccgacgagcaagaaactgcttaggaggaagagggtttcctgtctgcgcgttcccaggcttcaagtgtgggccccgcgccttgagggtccttgggcgcctggcgagggggagctgtgggctgcgctccccagcggaatcgggggtgtcccccgcgttgctccggccaggccggggcctgcagccgagtcgactaccgagtggagcactgaacggcgcggattttgagaccgactccggtttttgtccttggattttaaacgtttttatcattgtttttgttttgctttctccttagctgttttagtctcctctgcgcgccaggggctgggagggcggagcgctccccggccggccccggcaggtgcctccaagacacccgcgctggtcaaggagcttcttgaatttagtttttgttttcacattttctttcccctccttgtagagaaggagctcctgatcatgacgaacaggcagttttgagctacttaattcatccgggctccctttttttattaatagcaattacagtagagaaagttttatttatttttaaagatttcagccctctccttgaagagagctcttactccctcaatacaaagccaacttctataataacattcgcttttctcaccgcctaccttctttaccagggtaaagaaagctcaggacaccctccgccctcccacctgcgcccgcgtttttgtgcggtccccacggcagagctggggaggccaccctacgtttgcgcagggagacgcgctcgccgctggtgttgcgaaagaccagagcgaagcccggctccttgcccttccttcccaggggcttctctggggggcgctctcaggccccgacgaactgagcattgatcactgtggtggctaagcaaggaggggaggcgacgccgggcttaagcgaaccacagaggagaactggcaacgctgaatacagaccttgtctgcaggcgcgacctggccgggcctgagtcccgaatggggtctaattgcgaaggcggggtgggtttcccagtcacccagcttctttctctcactcgccattatttcatagttgtttgtaagtttaaggaacaccaagtgtagaatgttgtacatctcttccagtctcaacgccatttagaaatg

SEQ ID NO: 109577 - DNA, 922 bp, Homo sapiens
  misc_feature 1..922: note = chr14:36991579-36992501
  misc_feature 1..922: note = Hyper
  source 1..922: mol_type = genomic DNA
tcagcaggccacaggcgcacgtggctggcagctccccggcctccggctctgacagtccgggggcaaccaggcctgcagttctcgaggaaacccccagccccccacgtctcgttctggaccaggaaccccctccccaacaaccgcgcagcaagtggcgactctgggagctgaactggagtggagctcgaagtggctggggcgggcaaagactcccgcttcactctgggacacaactgggacggcgcttcaacctctgcctgcaggcgtgcttctcgcgcgcaccagcaagctctctatccacctcgcctgggcctttgcagcgccctgccgcccaggctccagcgcctctactaccctagccccttctcaacacgcggctctgccttcttccccagtaccactgcactgccgaaaataagcccggagactaacgcaccttgtagggaagagaaggacatctgtatctccaagcttatccaagcaaaggcctccagagtccctcccatggcccgaaacacctccctctgaccgaagagcgtcctttctttccgccgcctcctggactcatcctaaatagggcagacccgggctaaaccagtgatttttttttccatgaatacgaagaaccccgattgcactttgcgaagtctgcgcgtattcctttatcccgcaactagcttgctcccgggtggagtgggcacagtggggagcggtcagggcagggcagggcccaacgctggcccctcgcggagctttccctggcgcgacctcacacggtcgctgcctctattccgaccacgctctgcttcgctggctgcggctccgccaggaatccgagggggcgcaggcccaggctcggccctagatgcgcggaatcgccatcagcctttgcttacaccagcgtggccgcagggaaactcct

SEQ ID NO: 109578 - DNA, 37 bp, Homo sapiens; identical to SEQ ID NO: 76704
  misc_feature 1..37: note = chr14:36993177-36993214
  misc_feature 1..37: note = Hyper
  source 1..37: mol_type = genomic DNA

SEQ ID NO: 109579 - DNA, 1635 bp, Homo sapiens
  misc_feature 1..1635: note = chr14:36993438-36995073
  misc_feature 1..1635: note = Hyper
  source 1..1635: mol_type = genomic DNA
cccctcagttgctcccgcagtctcccacagctaggcacaggcttctaagccgggctgagctgggctcgcgagtgccatcgaggcaaccaggcgcagggagcggaaggcaggagtgtaactgggcgctggggggcgctgctccgcaaccccaagatccgaggaatgcctccgggggatgatttctctggaggggtctcgcagggccccctctgcgctgctttctcaggcaccagaaccgaaatcctcgggagggaccgcgggagcccggggcgtgcagacaggcggctttcacagacgcagcgggaggaaggatccctctactgctccctttcccgatttgaccgtctagggcctttgagaggactttccttttgggaaagcttttctcaattcgtggcctgtgggcaggctggggggtggggcgccaagtcatccgagcgcggcttctgcttctccctttccctcacaggcatgctctacggagggtatgggaggcgagggcgcgtctatgagggccagagtccgcgaagagagtccggcccttaggcctttggtgttgaagaatctgctcctctgtcgggtcaagccccactagaagttaacacctgtggtctccaaacttgcctattttcctgtcacgcagttcaagccaagattcaactcgtcttgaatttttgtatttagagcccctaccttctccaccgactccaggggcgccctctggcgggaaggggcctggggtaggagggaacctgagggagcgggttacaaagcagagaacagcgggagctcagcagctccctttgaattgcgaggaaaccaagacggagacgggaggtaggagcacgggcctgaagcggtcagccgaccctgtgaggcccgcgctgccgtgctacgccgcgaatccgccagacgcccccgtcggaaggggcagggacaccctcgggggcgctctagggttcgtgctgcgctaaggtaagtttcgcagctgctcctgataattaaaggacagattcccgaagcatccttgtggcggcgcggctgttttcgccccaggacctgtgcagcctcattcagctttaggtagtcgaaacctatagctctttctgccctctgttccccaacaaatctcagtcccaacagtgggagcccgtgggccttgggtgttcgagtttcccgcgggcttgccagcagcgctggggttccctcctccgctcctttcctcctctccaacctcccaccacagcccgtctcccccacatccccaacacttgtcccaggcagtttccggtggccgcagtatcgaccccaggccattggggtgggtgtgagggaagggtggagggggaatctccgaggcccaatgttttctgggacttgagggaggctgaattctccctcgctgcctaggacttggggtctgaaggttgcagaccgaggcgatccgcagcgccctcttccggcggccgtctggagaactgcagctttagagcggtctcggggaagctttgctactagtttccggctagggaaaactggtggtggtcggagactggtagtacatcatccacgcattcgctcattctaactgtccgcccgaccatacgtcaggctgtctatcggtccacccaaagc

SEQ ID NO: 109580 - DNA, 33 bp, Homo sapiens; identical to SEQ ID NO: 76708
  misc_feature 1..33: note = chr14:37050213-37050246
  misc_feature 1..33: note = Hyper
  source 1..33: mol_type = genomic DNA

SEQ ID NO: 109581 - DNA, 39 bp, Homo sapiens; identical to SEQ ID NO: 76709
  misc_feature 1..39: note = chr14:37050500-37050539
  misc_feature 1..39: note = Hyper
  source 1..39: mol_type = genomic DNA

SEQ ID NO: 109582 - DNA, 152 bp, Homo sapiens; identical to SEQ ID NO: 76710
  misc_feature 1..152: note = chr14:37051044-37051196
  misc_feature 1..152: note = Hyper
  source 1..152: mol_type = genomic DNA

SEQ ID NO: 109583 - DNA, 364 bp, Homo sapiens; identical to SEQ ID NO: 76711
  misc_feature 1..364: note = chr14:37051599-37051963
  misc_feature 1..364: note = Hyper
  source 1..364: mol_type = genomic DNA

SEQ ID NO: 109584 - DNA, 379 bp, Homo sapiens
  misc_feature 1..379: note = chr14:37116105-37116484
  misc_feature 1..379: note = Hyper
  source 1..379: mol_type = genomic DNA
ctggagacttggggacgtgaagggggggttctgtgatcccggaaaaaaagtaacttctcttggtaggtgatactaggcagttgcgtcccggggagtccccgcctttctgcgcttcccctgacgggggcacaggggccggcgtgcgtgtgtgggtacgtagctcatcccggggagctgggatcctcttttccgcacttggggaagacgaatgccgaccattggctcagacaccataccacacaggcatttctggaggcatttcgcggcgttattatgggaagttgcgcggaccggggccttcgcgctacagccgaggagtctcagcgcctgccaggcgggagccgcacttccggcgaggtgtcttcgggagggggcgcca

SEQ ID NO: 109585 - DNA, 932 bp, Homo sapiens
  misc_feature 1..932: note = chr14:37116709-37117641
  misc_feature 1..932: note = Hyper
  source 1..932: mol_type = genomic DNA
acacctgcgcgccctcgactggggcccgctccagcagtgaagacccaggcccttccctgggccgtggctgctcttggtgcctcatgggagcgcccggggtagggactcggctagtgacctgtaggacatgaggggcgagctgggagccgattcgcccacggcgtctccttcgccatggaggccccccacccattccactccggggttgcggccacgcaccataagagcaccttcaggtctgagctctttaggggtgggagtaggcagttcgtgagtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggcaaatcggggaaggttagaggtgggggacctgcctgagccgggacaaaaaactttggagctagggccttctaaccctggagacttgccgactccggggcgggctctcgcactcaagtcccgagatgggatgattttccaactttcgtccagcctctccttccgctcccgccgctctgctagcactcccgcactctctccctgggtcacaaccctcgcctgcggaatacctgtctgaagggcgcgtcagtagaagcttcgtttcatactacct

SEQ ID NO: 109586 - DNA, 1424 bp, Homo sapiens
  misc_feature 1..1424: note = chr14:37123336-37124760
  misc_feature 1..1424: note = Hyper
  source 1..1424: mol_type = genomic DNA
ctagaaagccacagccgctgtggaggaggtaagaggtcagctctttcgttggtcctggtgagggtaaaatttttaggcaggaggagcactgactggcaaagggaagaggaaagggttcgccctggaccccacaaatccgcctcttggagcaaacagcctgcaggtagaggggcctattagagcctgcccagttcccgggagggccaaccccagccagtaagaagacctgaggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcccagctagctgtgttaattatgggttctaattttattgcaactcggcacctcctggtttgttcccactatagtggtcttaaaaagaaacacacacaggcataccccagaatgaatccccgggaaggcaaaggtagattttttcggtgcttgagttgatgctctgagagcgcgctgagagtctcgggcatgtcttggcactcttggaaacaaattgcagccaagagcacggttcttccggtcctctccttgctcctctgtgcgccgctcggccgcgggactcctggaacatgttgtgcaccgcccgagtggctgcggacctcacctcgacgccctggatagccggggccaggaggagacgagcaggcagtctcccgccctcacctagtcagctgcgacctccgcggcgtggactcttggccagcagtgaggaggacaaggttgcagatcctctttgctgcgggttctgggtccggccttgggcggcattctgtcttctaaagtgtggaggtgggtagaagagtgtccactttcagtgtagacacctgaggtatgggggcttctttgggggctccagcgtgagctgctcctgcagattagggaaatggagagaacaacaatggggacatggtggaattcagatttccccctgttaattaacaatatgatttcgcttagtccaagtg

SEQ ID NO: 109587 - DNA, 3790 bp, Homo sapiens
  misc_feature 1..3790: note = chr14:37124976-37128766
  misc_feature 1..3790: note = Hyper
  source 1..3790: mol_type = genomic DNA
gtagcccctgggggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactccggcctgcgagttgattcagactcctcggaagccagaaattgggtctagagtgggttggtccctccgtcagcagttcgggcccagccgaagcttggggcctagagggcagacgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccccgggtgatcggaaacaggcaggcggagaattaaaagcgggtttcagacagcaacaggcccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagcttctggctgtcacttgccgctgcagtttcagggaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggtcggtccaggttggggatacagggaggggtcctcgcgttccgcacaacctgtagtgcttgggtctgacttcggcagccctcgggtacagtctgccgggctagattcccgttgcttctccgcgtctctccgcgggccgctctagcgccgggaagggggcgccgcaggtgactgcccgcggcactgggacggctgacagatttatggagacttcacagcatctggctggggtccgcgagggcagggcggagtccggtcgatccgatgctggggtctaaagcttccccagccacacgcctgggccgagtcgcccccagagtccccggcccctgctccccttgggcgggtgtacacaaggatccggccagcgccgagtgtactggttcctcccacccagtgtagccccctccttcacactctcggcccggcttccagtctcccactgagtaaatatttatccagagagcgagtcgcccctcggaggaggcctcgacgcggctagggaaaggctttttggcttctccctggcctgagccagctgcaggccttactggtgttttggttttggtcttaaatttctccttttagtcgaaattcttccgatctctttgagatcttctgagtccagagtgagcagtgtaaccaggcggcagactccagctgacccttgttcttgttctaggtcctgcatccttacattcatcgggactgaccagaccttagtgttctctcttttccttccttcatcctctttctctgcctcagatccgtcgtctctcggtcggtctcagcgggtcgctgactacctcgccctagcactcggtccgcgccccgggaaggcttcagcatcaccctcttctgctgggatcccgctgaccctgtctgcagcttcggcttctcttgctcccagagcggggtcttcggcttgccgcggatacttagtggcccaaaacacctaaaattgactcttcctgcgctcttgagaatgc

SEQ ID NO: 109588 - DNA, 167 bp, Homo sapiens; identical to SEQ ID NO: 76720
  misc_feature 1..167: note = chr14:37129080-37129247
  misc_feature 1..167: note = Hyper
  source 1..167: mol_type = genomic DNA

SEQ ID NO: 109589 - DNA, 799 bp, Homo sapiens; identical to SEQ ID NO: 76721
  misc_feature 1..799: note = chr14:37130018-37130817
  misc_feature 1..799: note = Hyper
  source 1..799: mol_type = genomic DNA

SEQ ID NO: 109590 - DNA, 200 bp, Homo sapiens; identical to SEQ ID NO: 76722
  misc_feature 1..200: note = chr14:37131143-37131343
  misc_feature 1..200: note = Hyper
  source 1..200: mol_type = genomic DNA

SEQ ID NO: 109591 - DNA, 54 bp, Homo sapiens; identical to SEQ ID NO: 76723
  misc_feature 1..54: note = chr14:37131834-37131888
  misc_feature 1..54: note = Hyper
  source 1..54: mol_type = genomic DNA

SEQ ID NO: 109592 - DNA, 1189 bp, Homo sapiens
  misc_feature 1..1189: note = chr14:37132193-37133382
  misc_feature 1..1189: note = Hyper
  source 1..1189: mol_type = genomic DNA
gcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcac

SEQ ID NO: 109593 - DNA, 86 bp, Homo sapiens; identical to SEQ ID NO: 35247
  misc_feature 1..86: note = chr14:37133668-37133754
  misc_feature 1..86: note = Hyper
  source 1..86: mol_type = genomic DNA

SEQ ID NO: 109594 - DNA, 54 bp, Homo sapiens
  misc_feature 1..54: note = chr14:37135721-37135775
  misc_feature 1..54: note = Hyper
  source 1..54: mol_type = genomic DNA
ccgcaacaacttccccgccgccgccccgcacgcggtgaacgggttggagaaggg

SEQ ID NO: 109595 - DNA, 615 bp, Homo sapiens
  misc_feature 1..615: note = chr14:37136003-37136618
  misc_feature 1..615: note = Hyper
  source 1..615: mol_type = genomic DNA
acccccgccaggggccgggagcgctcgtcagggcgctgggggtctggggcggcagctccccggggcgaggctctgggaagcgcctccaggcctgtcggcctccgggagcttggggaggcggctcccgaagccctttcggcggctctcgttgggggtagagttaaccaaagaaggcgcttctgaagggccgagcggagcagccctggggcctcagagccgcgccttcacgcccgcgaaacgcgcgccccgggtctcggccccacggtgcgactgcggctgcggggtcctcacgttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaagtctaaattcatcaccgtcctggagtcaag

SEQ ID NO: 109596 - DNA, 52 bp, Homo sapiens; identical to SEQ ID NO: 76730
  misc_feature 1..52: note = chr14:37641710-37641762
  misc_feature 1..52: note = Hyper
  source 1..52: mol_type = genomic DNA

SEQ ID NO: 109597 - DNA, 30 bp, Homo sapiens; identical to SEQ ID NO: 76731
  misc_feature 1..30: note = chr14:37641962-37641992
  misc_feature 1..30: note = Hyper
  source 1..30: mol_type = genomic DNA

SEQ ID NO: 109598 - DNA, 201 bp, Homo sapiens; identical to SEQ ID NO: 76732
  misc_feature 1..201: note = chr14:37666791-37666992
  misc_feature 1..201: note = Hyper
  source 1..201: mol_type = genomic DNA

SEQ ID NO: 109599 - DNA, 438 bp, Homo sapiens; identical to SEQ ID NO: 76733
  misc_feature 1..438: note = chr14:38052765-38053203
  misc_feature 1..438: note = Hyper
  source 1..438: mol_type = genomic DNA

SEQ ID NO: 109600 - DNA, 249 bp, Homo sapiens; identical to SEQ ID NO: 76734
  misc_feature 1..249: note = chr14:38057123-38057372
  misc_feature 1..249: note = Hyper
  source 1..249: mol_type = genomic DNA

SEQ ID NO: 109601 - DNA, 30 bp, Homo sapiens; identical to SEQ ID NO: 76735
  misc_feature 1..30: note = chr14:38057802-38057832
  misc_feature 1..30: note = Hyper
  source 1..30: mol_type = genomic DNA

SEQ ID NO: 109602 - DNA, 339 bp, Homo sapiens
  misc_feature 1..339: note = chr14:38060644-38060983
  misc_feature 1..339: note = Hyper
  source 1..339: mol_type = genomic DNA
gctcctggtggtcaccgaggcgctgcctagaggcaggctggcgggcaacgtagagccgtaaggcgagtattgcagtgcctgttcgtatgccttgaagtccagcttatgctgctgctccgaggaggacatgaggttgttgatggagaacgggtggttgaaggagtagtgggggtcccctttcaggtgcagctgggactcgtggggtgccaagccgtgtgccgggtgagaggcgggcacagaggccagcgccccgggcccggagcttatggggggcgcagttgaggaggctggagtcttcaactccgaggcgccccctgtcgccgtcgccccactgtggtc

SEQ ID NO: 109603 - DNA, 160 bp, Homo sapiens; identical to SEQ ID NO: 76737
  misc_feature 1..160: note = chr14:38061931-38062091
  misc_feature 1..160: note = Hyper
  source 1..160: mol_type = genomic DNA

SEQ ID NO: 109604 - DNA, 30 bp, Homo sapiens; identical to SEQ ID NO: 76738
  misc_feature 1..30: note = chr14:38063973-38064003
  misc_feature 1..30: note = Hyper
  source 1..30: mol_type = genomic DNA

SEQ ID NO: 109605 - DNA, 30 bp, Homo sapiens; identical to SEQ ID NO: 76739
  misc_feature 1..30: note = chr14:38064995-38065025
  misc_feature 1..30: note = Hyper
  source 1..30: mol_type = genomic DNA

SEQ ID NO: 109606 - DNA, 30 bp, Homo sapiens; identical to SEQ ID NO: 76740
  misc_feature 1..30: note = chr14:38065668-38065698
  misc_feature 1..30: note = Hyper
  source 1..30: mol_type = genomic DNA

SEQ ID NO: 109607 - DNA, 128 bp, Homo sapiens; identical to SEQ ID NO: 35255
  misc_feature 1..128: note = chr14:38072551-38072679
  misc_feature 1..128: note = Hyper
  source 1..128: mol_type = genomic DNA

SEQ ID NO: 109608 - DNA, 175 bp, Homo sapiens; identical to SEQ ID NO: 76742
  misc_feature 1..175: note = chr14:38677313-38677488
  misc_feature 1..175: note = Hyper
  source 1..175: mol_type = genomic DNA

SEQ ID NO: 109609 - DNA, 30 bp, Homo sapiens; identical to SEQ ID NO: 35257
  misc_feature 1..30: note = chr14:38678172-38678202
  misc_feature 1..30: note = Hyper
  source 1..30: mol_type = genomic DNA

SEQ ID NO: 109610 - DNA, 819 bp, Homo sapiens; identical to SEQ ID NO: 76744
  misc_feature 1..819: note = chr14:38678518-38679337
  misc_feature 1..819: note = Hyper
  source 1..819: mol_type = genomic DNA

SEQ ID NO: 109611 - DNA, 182 bp, Homo sapiens; identical to SEQ ID NO: 76745
  misc_feature 1..182: note = chr14:38679732-38679914
  misc_feature 1..182: note = Hyper
  source 1..182: mol_type = genomic DNA

SEQ ID NO: 109612 - DNA, 30 bp, Homo sapiens; identical to SEQ ID NO: 76746
  misc_feature 1..30: note = chr14:38680274-38680304
  misc_feature 1..30: note = Hyper
  source 1..30: mol_type = genomic DNA

SEQ ID NO: 109613 - DNA, 1319 bp, Homo sapiens
  misc_feature 1..1319: note = chr14:38724150-38725469
  misc_feature 1..1319: note = Hyper
  source 1..1319: mol_type = genomic DNA
ttgaagggtagacatcgtgctctgtgatccccatcgaggaatctcaggaatagatgttactgaattgtcttgttcagggacaagtggtgtctctcccagcttctcgtcgaccctgattggccatgttctctgcggcacggggctggttgcagtggccggcgggcgcctggtgggcaccccggtccccccaagggtcggctgtccttccccactggtcacacaagagcggccgtccttccccagctcgaagcccgtagcacattcgcaggcaaagcctcccaagtcgtctaggcagttagggagctctgcgcatttgccagcacggaggtacctcccggggcagggacacaacacatcgcccgagagtttgtcccagcgagcgccgatttcgtccgcgatgcaagtaactgagatcgggagctgtccccggcagagcgcactcacctcggtcccaggtggactgaagtccagagcggcgctgtgcagctggaagggcgcgcgatagctcaagttagaggcggccccggggcgcggcgcaggacacaagacctcaaactggtacttgcacaggtagccgttggcgcgcaggtggcatcgcatctccttccagcctgcgggctcgaccccaccggtggcctggagtaccgcgcatctccgcgcggtgcaggagcgttggggctcctccacccactgcagcgtgtcgctttcgagaccgccggggtcggaggacagccaggagaaaccccgcaaaggctcgttctccagggtgcagtgggaacgcctgcgctccagtgcgacccagaacagcaggtctttggagccccctccgggccctgggcctgcccgcaggagcgcgagcacagcgcgcagctcggcgcccgcacgcacggtgctgagcgccccacctcgcaggatgcaggcctcctcggccgcctgccgcttcatggtagcgtggtgcaggctgtagcaggcccccgaggccgagcagccagcacggtcggcagtggggtgttcgccgccgcccggcccgggccagagcgcctgccagaggaggcacagggcgaacgccggcctcattctctgaggccccgcacgcagagctgctcccaacttggatctgtcccgctcgaggacgcagagctgtgtctggagcgcggtcaccgccctctacagctggcttccccaacccggttccccctcccttcccctccgccctcgctcccgacggaccccccaactgccaagaatccccccgcgggcccagcggccaacagtttcccttaggccgcgacaggaaatgtgtgcggagcgctgccagg

SEQ ID NO: 109614 - DNA, 23 bp, Homo sapiens
  misc_feature 1..23: note = chr14:40221669-40221692
  misc_feature 1..23: note = Hypo
  source 1..23: mol_type = genomic DNA
cgagagtccgtctcaaaaaaaaa

SEQ ID NO: 109615 - DNA, 638 bp, Homo sapiens
  misc_feature 1..638: note = chr14:42074205-42074843
  misc_feature 1..638: note = Hyper
  source 1..638: mol_type = genomic DNA
ttggtgcaactccaccgccctccagtgaagtcccagaagcgatcaagtttaaagtgaaagggggatggaagcattttttctccctatgccttcggagtctgtggcttcagtttgctgcaggttctctccgtggacttctcagaaacctcaactttccacttcgagggacagaaagctacaaggaaaacgctgatggttttggtggagattctcctggacttcagtggtgtcctctggtacatctgtccgcggtgtccctttggtttatttctgtggtcttcctgcgcagtccctcagcggctcggagtttggccttccagctctccaactcagatcctgagcctcctaagctcccgcggagaccctgaagtcccggatctggcgccgctcgccgacctggagggaggctgcaccgctgaagtgcagtctcggagctgcgctcctctggaacaaagcagccagacgtggcttgagtggattcctaagccaaggattggatccggagtaccaggggcagagagggggagcagaggaaagaaaggagatgtgaggagtttccacctaaagcacttcactcctcgtgttcttccccgacagagatagctgtgtggttcttccttacgcgtgggtgcaggtgt

SEQ ID NO: 109616 - DNA, 1289 bp, Homo sapiens
  misc_feature 1..1289: note = chr14:42075097-42076386
  misc_feature 1..1289: note = Hyper
  source 1..1289: mol_type = genomic DNA
ggtgctctcagtgtccgaagaccacgtgctggtgaacccacaatgagaagcgaaagggtttcaggactctagcagaaaggaagagcaagatttcactcagggtttcttagaagaaagagttaactttgctcactggcttttccaggatggagggagtggggatagggtcggggagagaagcattgggagtcttgtcggagtctcaagcaaaaccaggcgagggctccgggcagatccattcccgcagggccctgtctaacctcctttccagtcgcacctctttcctgctttagaccctgcgtctgtgccggtgaccttagagactaggtctggcttatgaagactgttgggctccctttctgcccttcacatagtaaaatgtgaccaactgcagtattcgtaatgtctgatgctgagctgagttgattcccaaatataaatgttcttttcagaatccgctcccatctgattagtaagcaaatcaccacccacaactaaggggacagcggaagccagcctcagatgactgaaacccccaagtcagtagctctcctcaaaatttccggcgggttattatagataatgacttttcccaccgccctaagcagccgaagcttgactcagtgatgattctctctatcccgtaactgcgaggaagtgggcgatcagcaaattgcccttttgcaggaggctggggacgcccctggaagttcgctttcattctccaggttttctgccttttcccttcccccttcctgcaacgcccccgcgcctcctcagcctggggatttcctggcgcttcgccggccctctccgcaaccccctgataaatcggttcagaaccagtctggctgggaggcccgagggctgacagcagcggagcggccccggccggggtctcacggactctcggggtctggccgacacggccgctcccgtcactgcagcgcgggctgagctcacggccgcgcgcccgccgccgccgccgccgccgccttcatgctgcagcgcagggctcagttccacgcggccaggaggccgccgttgcccacacgcgacgctttgggaagcccagctcccgggtccgccccggccgcggccgcagccccggacctcggctgcttgcctcgcgcctgaactgcggactcgccccagcgcggtggccagcgggcggggcgctgtgttccgcggcgcgcagggaggcggtgagcgtgtgcagagctgcccgaacggaggactatgtatgtgtgtgcgcgtgtttgcgtgtgtttgagcgtgtttttccttct

SEQ ID NO: 109617 - DNA, 1091 bp, Homo sapiens
  misc_feature 1..1091: note = chr14:42076628-42077719
  misc_feature 1..1091: note = Hyper
  source 1..1091: mol_type = genomic DNA
ggcccttctgtgttccggaaagatcctggatgttggctaccttttcaagtcatcttggcatgtctctagtgttttgtaagccgctttccagctagctgcgtgtgtgtgtgcgcgcgcgtgtgtacgcgcgcgcctatctgatgcatttgactgtcttttatccaactgcccagaagcaaatgtgttaactcggcgatgccccttcatgcccgggttcttgcagagctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtcaccagctcttgaattacgtggattcgggttggaggagaacttgaaggaaacgtgattaaagggctatgcgagaacgctctctttgctgcccgcggtccggtgggcttcgaagccaatcgtgagaaggaccggttccctccgtgctgcttcctccccgtgcagtgctgggtgtgcgtgtgcgagtgtgagtgcaagtgcgcgcgcgcccgggtgcgagtgtgtgtgagtgtgagcgtgtgtctgtgtgtgcgtgcgcggccgccctgcctctgcccgctccccgggcgcggagccgcgggtttcatggggcgattgcagcgattcccccacccagagcgacctgcgggcagcggcggcagtggcaggagccgcctttccgattccctacgatgcgggtgctgagctatggcaaagggcagcgaagtgacgagcgagacccgcgtacgactgtgaaagccacctggagccaccttgccgggattgtacctgc

SEQ ID NO: 109618 - DNA, 705 bp, Homo sapiens
  misc_feature 1..705: note = chr14:42078784-42079489
  misc_feature 1..705: note = Hyper
  source 1..705: mol_type = genomic DNA
atttcactcctttctcgaagacattagaattaacaagataaagcacttccaaagtagtctcatcaatgttttattccatagtgaagacggtctgaataatttaactaaggagtgttcgtttgtctcccgcctttgggagctgcttgctggctacattcagcggaggatttggcccagccaagctcagggtgccctgcttcaggaggcagtgactggggctgctggggggcggggggttctctttgctaacgccgtttaggaagtgtaggggcgctgcctgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacggctttgacactttctccgggcagggcggaagagctcagcggaccccctggcagacagcaagcgcatcgtggccgaggcggccgcctggatgcgagaggagggagatgcccagagccacagaggagcgtggagggcggtggtgtcctgtctttgcctgcaaaacctttctctctctctccctccccgcgacaatgaatattg

SEQ ID NO: 109619 - DNA, 93 bp, Homo sapiens; identical to SEQ ID NO: 76760
  misc_feature 1..93: note = chr14:44004339-44004432
  misc_feature 1..93: note = Hypo
  source 1..93: mol_type = genomic DNA

SEQ ID NO: 109620 - DNA, 25 bp, Homo sapiens
  misc_feature 1..25: note = chr14:45382862-45382887
  misc_feature 1..25: note = Hypo
  source 1..25: mol_type = genomic DNA
ggtctcgaaacgctagcctccagtt

SEQ ID NO: 109621 - DNA, 30 bp, Homo sapiens; identical to SEQ ID NO: 76762
  misc_feature 1..30: note = chr14:45434972-45435002
  misc_feature 1..30: note = Hypo
  source 1..30: mol_type = genomic DNA

SEQ ID NO: 109622 - DNA, 25 bp, Homo sapiens
  misc_feature 1..25: note = chr14:45997179-45997204
  misc_feature 1..25: note = Hypo
  source 1..25: mol_type = genomic DNA
agtgaaactccgtctcaaaaaaaaa

SEQ ID NO: 109623 - DNA, 81 bp, Homo sapiens; identical to SEQ ID NO: 76764
  misc_feature 1..81: note = chr14:46293369-46293450
  misc_feature 1..81: note = Hypo
  source 1..81: mol_type = genomic DNA

SEQ ID NO: 109624 - DNA, 182 bp, Homo sapiens; identical to SEQ ID NO: 76765
  misc_feature 1..182: note = chr14:46443145-46443327
  misc_feature 1..182: note = Hypo
  source 1..182: mol_type = genomic DNA

SEQ ID NO: 109625 - DNA, 35 bp, Homo sapiens; identical to SEQ ID NO: 76766
  misc_feature 1..35: note = chr14:48095553-48095588
  misc_feature 1..35: note = Hypo
  source 1..35: mol_type = genomic DNA

SEQ ID NO: 109626 - DNA, 28 bp, Homo sapiens
  misc_feature 1..28: note = chr14:48135049-48135077
  misc_feature 1..28: note = Hypo
  source 1..28: mol_type = genomic DNA
caccatggactcctgcgttgcctcagcc

SEQ ID NO: 109627 - DNA, 2636 bp, Homo sapiens
  misc_feature 1..2636: note = chr14:48143051-48145687
  misc_feature 1..2636: note = Hyper
  source 1..2636: mol_type = genomic DNA
gccctggaacccagacgcgcggacttagcagtccgttcattcatgcacttgctcatccattcacacaaacatgtcccttaattgtgtctggcaccgagaatcttgcctgctattttcccctcccgaagtcagtgctcatggcaaccgctggtgcagaacgcaactcaactgtcaccccacttcctgagccggaaaatcaaggcatgtaggcattcacagaaaaaggaaaaggtggagaggaggaggcggcgggggcggagaggggtggggagactcacggggtcacactggaagcttccctggggggtggggggaaaccgtgacaccgacaccgtggcatgcaaggagccaaaccattattaaatcaaagactgctggagctcggattccccgcggggataaatcaagtgcaaagccgctcgttcgcacgagtgcgttgctgccggctaaacccaactccgagccagagcccaggcgccggggaagcggctcgcagcccaatccgcagcgcgctcgctgcctctttatcgctcccaataacgtgatgaagtgtaaatcaaatgccacgccgggaggggccccggaacggcgcgagtcgtgcattttcgctcaccagcctatcttgcctaagaatcacaaggtcacgatagcgtcgcgattccactcaccgtacactccttggccagagatcccctccaggaggactgtcagcagccacacgagaccgtacagtaaatccatcttcacgtgaacatgaacatatccagcccagggggtacgcaacgggaccttcaggaggccggcggccagccaggcgcgctccactcgcgcccgggccaagccgaggtgcccgggaaccgctcgccgaaggaggaagcgccgtccgtctgtccttccccggcggcggcggcgagcggagcgcaggagccccgcactccacacactcatgcacacacacactcacacacactcacacactctcccacaacacaataccctgacacacactcacacgcacgccgcactcacaccgggtgcctgggaaaatcgcagacgccggggaggagcagggggcggtgatgggaaggggagctgcgaggcgaagtgttcttcagggaagcgggctcgagtctccgcagctgcggcggcggcggcggcgcgctgggccggcggcgggcgcgggcagggggccgggggtgccgcgcggtaggagcctggcttggacagccgaggagcaggaagtggcctctgacccaggacaccgagcagggctctcttgcctggattcgcctttacaaagtaactcgcgaaggtccccggaggggcgtcaagcggcgacagcggcccgcccgcccgcagtccgaagcccccagccctgctgtcttgccttcccccattccatcagttgccattgcaacgccaatcctgttacacgatacagactcgcatcgccgaacggggagaggaggaagaggaggaggaggaagaggaggaggaggaagaggaggagtggggctaggggaacgggggtggggaagagggaagggaggagggggaagaaggaggaggaaagggtccaacagggagcggagtgtgcgtctggagctcgcttgggcacaccagcccagccgccaccgccaccgctctccaaaatagcctttagcgcccggccagcgtagaggtgctctggccggccgcaccaattcccggagccgaaagcagagtccaggcaccgccacttgcaagagagggagaatgccaggcaaatacccgatccgcacacacgtctacgcgtgcccaccggcactgcgcgcgtcctcttcgcttccgcgccgcccccgccaggtggagggggtggggacggtcgggacaggcgggagtttagaggagggagccgcagaaggggttccccgcttgagctaacgtagtggtggcatccagaggtgaacgcgggagcggccgcctgcggagggcacccggctgcgtggcgtccgctcgggccgctgctgcggcagaggtgccctggttgggcggctgggcgcctggggttcgacgccggccgggatccctgggtgtgcgcggagatgcgcgccgcggaggcgaatggagggaggaggagaaggagaaagaggagaaagaggagaaggaggaggaggaggaggagggcgaagcggcaagcgcggggcgcaggcggaccggcggccgggctgctgggctgctgggctgccggggaggaaggctgtgtgtggtcacgttgtgcgctacgtgctgagagcgcgagctgctagccgcagccgggcgacgtcaaagccgggtgcgcggctctgccgcctgcctccgcgcctcctctgcccctcctttgctctgccttcctgtgtcagccgagctcatcagtatggacaacgccgaaaggctccgcgaggccggcggcatctggcctccaacctcccccgccaaagcgctccctcgcctctcggggagctccgcggtggcgaatgcccgttatgtatttctgatgccgccgtctgcgtttgcacgctgaagggccagctaccaccttagacccagggtaattacatgacacgctatctcctctccgccgcccaaggtcttccaggatccgttatgcttggcta

SEQ ID NO: 109628 - DNA, 30 bp, Homo sapiens; identical to SEQ ID NO: 76774
  misc_feature 1..30: note = chr14:48852289-48852319
  misc_feature 1..30: note = Hypo
  source 1..30: mol_type = genomic DNA

SEQ ID NO: 109629 - DNA, 45 bp, Homo sapiens; identical to SEQ ID NO: 76775
  misc_feature 1..45: note = chr14:50098049-50098094
  misc_feature 1..45: note = Hypo
  source 1..45: mol_type = genomic DNA

SEQ ID NO: 109630 - DNA, 171 bp, Homo sapiens; identical to SEQ ID NO: 35279
  misc_feature 1..171: note = chr14:50155136-50155307
  misc_feature 1..171: note = Hyper
  source 1..171: mol_type = genomic DNA

SEQ ID NO: 109631 - DNA, 180 bp, Homo sapiens; identical to SEQ ID NO: 43975
  misc_feature 1..180: note = chr14:50233117-50233297
  misc_feature 1..180: note = Hypo
  source 1..180: mol_type = genomic DNA

SEQ ID NO: 109632 - DNA, 144 bp, Homo sapiens; identical to SEQ ID NO: 43976
  misc_feature 1..144: note = chr14:50233597-50233741
  misc_feature 1..144: note = Hypo
  source 1..144: mol_type = genomic DNA

SEQ ID NO: 109633 - DNA, 52 bp, Homo sapiens; identical to SEQ ID NO: 76779
  misc_feature 1..52: note = chr14:50287126-50287178
  misc_feature 1..52: note = Hypo
  source 1..52: mol_type = genomic DNA

SEQ ID NO: 109634 - DNA, 30 bp, Homo sapiens; identical to SEQ ID NO: 76780
  misc_feature 1..30: note = chr14:50316746-50316776
  misc_feature 1..30: note = Hypo
  source 1..30: mol_type = genomic DNA

SEQ ID NO: 109635 - DNA, 20 bp, Homo sapiens
  misc_feature 1..20: note = chr14:50333655-50333675
  misc_feature 1..20: note = Hypo
  source 1..20: mol_type = genomic DNA
caacctcgaatcagccgttt

SEQ ID NO: 109636 - DNA, 120 bp, Homo sapiens; identical to SEQ ID NO: 76782
  misc_feature 1..120: note = chr14:50333975-50334095
  misc_feature 1..120: note = Hypo
  source 1..120: mol_type = genomic DNA

SEQ ID NO: 109637 - DNA, 20 bp, Homo sapiens
  misc_feature 1..20: note = chr14:50334335-50334355
  misc_feature 1..20: note = Hypo
  source 1..20: mol_type = genomic DNA
gactccgtctcaaaaaaaaa

SEQ ID NO: 109638 - DNA, 39 bp, Homo sapiens; identical to SEQ ID NO: 76784
  misc_feature 1..39: note = chr14:50337688-50337727
  misc_feature 1..39: note = Hypo
  source 1..39: mol_type = genomic DNA

SEQ ID NO: 109639 - DNA, 29 bp, Homo sapiens
  misc_feature 1..29: note = chr14:50434015-50434044
  misc_feature 1..29: note = Hypo
  source 1..29: mol_type = genomic DNA
catttatgcataaacgatcacatgacatg

SEQ ID NO: 109640 - DNA, 53 bp, Homo sapiens; identical to SEQ ID NO: 76786
  misc_feature 1..53: note = chr14:50474165-50474218
  misc_feature 1..53: note = Hypo
  source 1..53: mol_type = genomic DNA

SEQ ID NO: 109641 - DNA, 28 bp, Homo sapiens
  misc_feature 1..28: note = chr14:50681829-50681857
  misc_feature 1..28: note = Hypo
  source 1..28: mol_type = genomic DNA
aggcgtgagccaccgcgcccggcaaggt

SEQ ID NO: 109642 - DNA, 77 bp, Homo sapiens; identical to SEQ ID NO: 76788
  misc_feature 1..77: note = chr14:50777921-50777998
  misc_feature 1..77: note = Hypo
  source 1..77: mol_type = genomic DNA

SEQ ID NO: 109643 - DNA, 20 bp, Homo sapiens
  misc_feature 1..20: note = chr14:50828512-50828532
  misc_feature 1..20: note = Hypo
  source 1..20: mol_type = genomic DNA
agccctggcagtcctcgctc

SEQ ID NO: 109644 - DNA, 18 bp, Homo sapiens
  misc_feature 1..18: note = chr14:50888271-50888289
  misc_feature 1..18: note = Hypo
  source 1..18: mol_type = genomic DNA
gcccggcaacaaaataaa

SEQ ID NO: 109645 - DNA, 469 bp, Homo sapiens; identical to SEQ ID NO: 76791
  misc_feature 1..469: note = chr14:51026665-51027134
  misc_feature 1..469: note = Hyper
  source 1..469: mol_type = genomic DNA

SEQ ID NO: 109646 - DNA, 36 bp, Homo sapiens; identical to SEQ ID NO: 76792
  misc_feature 1..36: note = chr14:51027845-51027881
  misc_feature 1..36: note = Hyper
  source 1..36: mol_type = genomic DNA

SEQ ID NO: 109647 - DNA, 281 bp, Homo sapiens
  misc_feature 1..281: note = chr14:51338697-51338978
  misc_feature 1..281: note = Hyper
  source 1..281: mol_type = genomic DNA
gtgtgtgtgtgtggccgcgaacagcctgacccgggcggagcgcaccctcgggccgcgtctcccccgccgtaccagcctgcctgaccgcgcggaggaggagggcgggcgcggtgccgccggggcgggaaggtcgcgggcggctgctccggactgcagctcccgcggcggtggcggcgtatcgggacacggcgcgggatggacgcgcaggactgccaggcggccgcatcgcccgagccgcccgggcccccagcccgtagctgcgtggccgcctggtgggacat

SEQ ID NO: 109648 - DNA, 49 bp, Homo sapiens; identical to SEQ ID NO: 35282
  misc_feature 1..49: note = chr14:51410296-51410345
  misc_feature 1..49: note = Hyper
  source 1..49: mol_type = genomic DNA

SEQ ID NO: 109649 - DNA, 171 bp, Homo sapiens; identical to SEQ ID NO: 76795
  misc_feature 1..171: note = chr14:51410569-51410740
  misc_feature 1..171: note = Hyper
  source 1..171: mol_type = genomic DNA

SEQ ID NO: 109650 - DNA, 126 bp, Homo sapiens; identical to SEQ ID NO: 76796
  misc_feature 1..126: note = chr14:51411033-51411159
  misc_feature 1..126: note = Hyper
  source 1..126: mol_type = genomic DNA

SEQ ID NO: 109651 - DNA, 1725 bp, Homo sapiens
  misc_feature 1..1725: note = chr14:51560287-51562012
  misc_feature 1..1725: note = Hyper
  source 1..1725: mol_type = genomic DNA
ggtctggcccagagccgggctcatcagtattccgcctgcggcgtctccccgaccctccgccgtgcctcaccaggtccgcctatccagcagcgacagactcccgccgtccgcgcgaccccaccgcccccatcccagtccctccccgagggttcgcagcccgccctgccctcgagcgtgcctagcggccctgggcactggcgcggctctacccagctatgcagtgctttcccacacactggccgcggccactggctgcagacccgccgcggaaagggggcgccctgagtcccgctcgcaggcagcgcgccccgagagacccgctctaaggcatccccgcaacaactctgtgggggcattcaactcccccgtgcgccggttaagattcccccatgcctcctgcaatgcaccagaccagggaggtaaacatcgaaggcacctgcattgcgcccccactgggatgcgctgtgcgcaagagacggggaccgtctgctgcaaaaccggatgatcggagacgcagggagttaggagtgggttttcttaggactcaccttatgtagtttccacatggcccccagagccttgacttcgtggctggagtgtttgccctcctccaagcactggtagcacacgggcatcttgcattgcacgcagtacatgctgtggttctccagctcgtggtctgtgcaggtggagaccttgcgtgggctcagcctccggctcacacgaccctgggccgggggcaccaggcggtgcttggctaggggcccccggggcgggtggcagcgcaggcggcacggatcgcagtagaagacatcgcactgttcgcacatgacggtggcttccttgggcgccttctcgcagagctggcacttgagggccgcggctttgctctgctggtagcggtcaattaccccttccagtacgcgattcttggggaagccgcggagcccccggtcatccaggatgaggctgcggtgacactgggggcaggtgatacaggagttgcggggcaccggggccagggccggtgacaagtgggtggccggtggcggcatagccgggggaaacacgcggacgccgttgggggacttctggcacggggtagtgggggcgctggcgaaccccccgtaggagccatagccgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaactcctcttccatctcctccatggggaccggtctgggaggagacagcgacggctgcagcgggtgcctgagctggcgaggtggccgacgggcccgtcttgtccagcaccctggccagcggcggcggctgtggtggtggtgccttcccgcgcagcactggcacggacacccagagaggcgctagctctgtgagccgcagccgcgtagccgccgcgccgcgcgccagcccggaccgcccctacctgccctcctagtcccgccccggcccatgagcagcggcccattgggcggggggcaagagatcgaagctctcattggccaccagacccgtccgtctcctcgtctccgcaggccacagggggttcggtagagtctgagg

SEQ ID NO: 109652 - DNA, 425 bp, Homo sapiens; identical to SEQ ID NO: 35288
  misc_feature 1..425: note = chr14:51562235-51562660
  misc_feature 1..425: note = Hyper
  source 1..425: mol_type = genomic DNA

SEQ ID NO: 109653 - DNA, 165 bp, Homo sapiens; identical to SEQ ID NO: 76801
  misc_feature 1..165: note = chr14:51849769-51849934
  misc_feature 1..165: note = Hypo
  source 1..165: mol_type = genomic DNA

SEQ ID NO: 109654 - DNA, 39 bp, Homo sapiens; identical to SEQ ID NO: 76802
  misc_feature 1..39: note = chr14:52119506-52119545
  misc_feature 1..39: note = Hyper
  source 1..39: mol_type = genomic DNA

SEQ ID NO: 109655 - DNA, 70 bp, Homo sapiens; identical to SEQ ID NO: 76803
  misc_feature 1..70: note = chr14:52226939-52227009
  misc_feature 1..70: note = Hypo
  source 1..70: mol_type = genomic DNA

SEQ ID NO: 109656 - DNA, 30 bp, Homo sapiens; identical to SEQ ID NO: 76804
  misc_feature 1..30: note = chr14:52241137-52241167
  misc_feature 1..30: note = Hypo
  source 1..30: mol_type = genomic DNA

SEQ ID NO: 109657 - DNA, 17 bp, Homo sapiens
  misc_feature 1..17: note = chr14:52321531-52321548
  misc_feature 1..17: note = Hypo
  source 1..17: mol_type = genomic DNA
gccgtggctctttctta

SEQ ID NO: 109658 - DNA, 23 bp, Homo sapiens
  misc_feature 1..23: note = chr14:52395020-52395043
  misc_feature 1..23: note = Hypo
  source 1..23: mol_type = genomic DNA
tacaggcgcggtggctcacgcct

SEQ ID NO: 109659 - DNA, 30 bp, Homo sapiens; identical to SEQ ID NO: 76807
  misc_feature 1..30: note = chr14:52484814-52484844
  misc_feature 1..30: note = Hypo
  source 1..30: mol_type = genomic DNA

SEQ ID NO: 109660 - DNA, 1924 bp, Homo sapiens
  misc_feature 1..1924: note = chr14:52534580-52536504
  misc_feature 1..1924: note = Hyper
  source 1..1924: mol_type = genomic DNA
ccgagggcagcgccccgcgcttgacctcctcgtaagcgcctacctgctcccaggtggccaggaaggcgtgggtgggggtaaagcgcgcagagcgcgggaagccagcgcgcacatagcgggcggccaggcccagcactgcgggggaggtgtcctctcggtacaggactcggcctctgccgtggctcgtgtcgatgtccgccagaaaaggggcgatggccgggaagtcggtggggaaatcatagtccacatactgcgtttccctggggaagtcctgagtggagatgatgccgttggtgcccacctgggagaggagagggacaaaaaggtgacagtcgctcaagcccaaggacgctaccctttcgcgcagggagggaagggaactgacttaggcaaaaagcctctctctccttccccactggccagggagtctggattcagggaaacaagcgcaacttttgcgactgtcccagctccgcgctgcagtaggtccaggggccctaaaactcgttcacctatcttctcactcccctcacaaccccggagccccatgtcctcggagaggaagcctccaggtctgaagagggaacaccccagctccgcagacgggcacagccttctcgcggtcctaactgcaaagcccgctggccgccctagcaacgccaccttttctgcctgggacgcgtacgtggctgcgaacaattcttgctctcccctccaggtcattcttgctcccctacagcagcggggcaggcagcggcatcgctctctggccgggtaccaccgcaagggtgctggggggctccaggagtggggtctgtttcctcccctctggaggcagggtttccgtgagaccgaccccagggaagaagctgcgggaaaagtgccaggagggggctgaacttacgtagaggttgctgaatcgggcttcgtagaagtgcaggggattcgccagcttcaccacggctgagctttcgtcgtcgccttcctgcaggagctggtccccccacgactccccgtgtgggaagagctcgtctgggtgcagcgccgcggcccgcaacattagcaacggcagcagcagtagcactggtaacgacgacagcaccggccgcccggccacccggtccccctccatgctcgctcggccgtgcgcttacccgctgcacaacgcgtcccgccccggcctccagcccactctccgcgccgcgccagcctcgaacctggatctccgcgggcgcctgggcggggcgggactccaggcccacccagcaagctaattggctgaggccctcggctggggaccaatcaccggctctgagaaagttcggcagtggccaccacatctggttctcgttaacttttctaaggcagcggccgctggagcagcggggctggcggggtaaaagctcctggccagggctgcctggagctgccccttccactccgcccccagggagctcccgggtcatcctctcatccgggctgccccgcggcccccaaggagccccacccccgggaccaaatggcccgcaaggtttggggcagcggcgttgcaggagatgagctcagcgcaaagggaaccccgcagcggcgagtgcggctgctggcctgcgcgctgtggccccaacaggctggcagggcgcgggcgggtggcggggttgcggtatgagctttgctccctgccctggggtcccgggcgctcctggctctggaggcctggccatcggtccgaaaagcaaagggacattgtcgtggtcccctcggccgcttcgctccacccagagacgccctgaggagaagcgagcctttgtacgaaggcagagggctgactcctaagttctgtccccctcccgaaggccggccgctagggaagacttggccaccctctggaagtaccttcccccgggaaaaccgcagcaggaaagac

SEQ ID NO: 109661 - DNA, 1101 bp, Homo sapiens
  misc_feature 1..1101: note = chr14:52734481-52735582
  misc_feature 1..1101: note = Hyper
  source 1..1101: mol_type = genomic DNA
gggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggccgcggatgcggggcgggaagggtggagcggatcgggatggacgcggcgccaggcgagctgcgccctgggccaggaaggtttgctgctgagttccccaaattggattccttccacagccccgagatataactcagtttgcggagcgaaatgagggaaag

SEQ ID NO: 109662 - DNA, 46 bp, Homo sapiens; identical to SEQ ID NO: 76821
  misc_feature 1..46: note = chr14:52780697-52780743
  misc_feature 1..46: note = Hyper
  source 1..46: mol_type = genomic DNA

SEQ ID NO: 109663 - DNA, 30 bp, Homo sapiens; identical to SEQ ID NO: 76822
  misc_feature 1..30: note = chr14:52780977-52781007
  misc_feature 1..30: note = Hyper
  source 1..30: mol_type = genomic DNA

SEQ ID NO: 109664 - DNA, 554 bp, Homo sapiens; identical to SEQ ID NO: 76823
  misc_feature 1..554: note = chr14:52781428-52781982
  misc_feature 1..554: note = Hyper
  source 1..554: mol_type = genomic DNA

SEQ ID NO: 109665 - DNA, 89 bp, Homo sapiens; identical to SEQ ID NO: 76824
  misc_feature 1..89: note = chr14:52940008-52940097
  misc_feature 1..89: note = Hypo
  source 1..89: mol_type = genomic DNA

SEQ ID NO: 109666 - DNA, 30 bp, Homo sapiens; identical to SEQ ID NO: 76825
  misc_feature 1..30: note = chr14:53259141-53259171
  misc_feature 1..30: note = Hypo
  source 1..30: mol_type = genomic DNA

SEQ ID NO: 109667 - DNA, 1018 bp, Homo sapiens; identical to SEQ ID NO: 76826
  misc_feature 1..1018: note = chr14:53416802-53417820
  misc_feature 1..1018: note = Hyper
  source 1..1018: mol_type = genomic DNA

SEQ ID NO: 109668 - DNA, 30 bp, Homo sapiens; identical to SEQ ID NO: 76827
  misc_feature 1..30: note = chr14:53819535-53819565
  misc_feature 1..30: note = Hypo
  source 1..30: mol_type = genomic DNA

SEQ ID NO: 109669 - DNA, 222 bp, Homo sapiens; identical to SEQ ID NO: 76828
  misc_feature 1..222: note = chr14:54421079-54421301
  misc_feature 1..222: note = Hyper
  source 1..222: mol_type = genomic DNA

SEQ ID NO: 109670 - DNA, 630 bp, Homo sapiens
  misc_feature 1..630: note = chr14:54422341-54422971
  misc_feature 1..630: note = Hyper
  source 1..630: mol_type = genomic DNA
cttcaactcacaaaccgcgatccttggaaaccatcctccaaagcagtgcttggaggcctctaaggcccccggaccaactcccgctggaagaagcctgcagggactcgggaatcacgggaacctttcccgtcggttccgggcctggagggccaggaagagccgcgcgtccgcctttcgtcccgccaggaactccccataggacacgacaccgcaggaacaagcgtcctgggagcccctgggatcttggctgtcgtctctagggaccctacaccgtgaaatgatagaggcgaggttccttgggttccgcaagtcgacgaaaatagctcgtggagaaggcgcgtcctgcaactgcagttcgcaagctctcagggcgccccgccagctgggggccagattgggtgacactcccctcgacgcagcctccggagcggcgcgcactctccagaggccagcaggactgcgctctctaccgcagaacctgctccagctaggtgttctctccccatctcgccgtcgctctgccccctcactctctctggacctcagagccggttctctccttcctcctcccgcgctttccgtccggggatcgcaacctccagcccgtgggcaacgcgttcagcccaagac

SEQ ID NO: 109671 - DNA, 106 bp, Homo sapiens; identical to SEQ ID NO: 76831
  misc_feature 1..106: note = chr14:54423369-54423475
  misc_feature 1..106: note = Hyper
  source 1..106: mol_type = genomic DNA

SEQ ID NO: 109672 - DNA, 461 bp, Homo sapiens; identical to SEQ ID NO: 76832
  misc_feature 1..461: note = chr14:54430146-54430607
  misc_feature 1..461: note = Hyper
  source 1..461: mol_type = genomic DNA

SEQ ID NO: 109673 - DNA, 30 bp, Homo sapiens; identical to SEQ ID NO: 76833
  misc_feature 1..30: note = chr14:54687020-54687050
  misc_feature 1..30: note = Hyper
  source 1..30: mol_type = genomic DNA

SEQ ID NO: 109674 - DNA, 42 bp, Homo sapiens; identical to SEQ ID NO: 76834
  misc_feature 1..42: note = chr14:54687254-54687296
  misc_feature 1..42: note = Hyper
  source 1..42: mol_type = genomic DNA

SEQ ID NO: 109675 - DNA, 17 bp, Homo sapiens
  misc_feature 1..17: note = chr14:55370202-55370219
  misc_feature 1..17: note = Hypo
  source 1..17: mol_type = genomic DNA
cttaaaatccatttccg

SEQ ID NO: 109676 - DNA, 39 bp, Homo sapiens; identical to SEQ ID NO: 43985
  misc_feature 1..39: note = chr14:55517158-55517197
  misc_feature 1..39: note = Hypo
  source 1..39: mol_type = genomic DNA

SEQ ID NO: 109677 - DNA, 233 bp, Homo sapiens; identical to SEQ ID NO: 76837
  misc_feature 1..233: note = chr14:55519752-55519985
  misc_feature 1..233: note = Hypo
  source 1..233: mol_type = genomic DNA

SEQ ID NO: 109678 - DNA, 52 bp, Homo sapiens; identical to SEQ ID NO: 76838
  misc_feature 1..52: note = chr14:55596101-55596153
  misc_feature 1..52: note = Hyper
  source 1..52: mol_type = genomic DNA

SEQ ID NO: 109679 - DNA, 30 bp, Homo sapiens; identical to SEQ ID NO: 15822
  misc_feature 1..30: note = chr14:55664068-55664098
  misc_feature 1..30: note = Hypo
  source 1..30: mol_type = genomic DNA

SEQ ID NO: 109680 - DNA, 321 bp, Homo sapiens; identical to SEQ ID NO: 76840
  misc_feature 1..321: note = chr14:55765285-55765606
  misc_feature 1..321: note = Hypo
  source 1..321: mol_type = genomic DNA

SEQ ID NO: 109681 - DNA, 74 bp, Homo sapiens; identical to SEQ ID NO: 76841
  misc_feature 1..74: note = chr14:55766010-55766084
  misc_feature 1..74: note = Hypo
  source 1..74: mol_type = genomic DNA

SEQ ID NO: 109682 - DNA, 30 bp, Homo sapiens; identical to SEQ ID NO: 43988
  misc_feature 1..30: note = chr14:56077686-56077716
  misc_feature 1..30: note = Hypo
  source 1..30: mol_type = genomic DNA

SEQ ID NO: 109683 - DNA, 267 bp, Homo sapiens; identical to SEQ ID NO: 43989
  misc_feature 1..267: note = chr14:57045520-57045787
  misc_feature 1..267: note = Hypo
  source 1..267: mol_type = genomic DNA

SEQ ID NO: 109684 - DNA, 1364 bp, Homo sapiens
  misc_feature 1..1364: note = chr14:57260863-57262227
  misc_feature 1..1364: note = Hyper
  source 1..1364: mol_type = genomic DNA
cattttaggccaattcgttaaaccagccgtctaaacgggccctggcactgggtatccgaccgctccacgcgccagctggtgaggcctggagttggaaccggaagccgtctccagccggcctcctaggccctaggtgcccgggtgggcacacttccgcgagggcccggggacagcgccggccaagtcttgcgggcaactgcacactcggttccgggaggcaggtactccaggtcgggagccctgaggccaagcctgtctcagttcccacgtcaagaggaagcctgggcttcggagcccaccctgcctggggccgcggtcccggagcgcggcgggaagaacgcccacgtcacctcccggtgttgttacacccacaatcaccacactctgacccccgcaaagaccacagaggagtaggaagagggctgccctcgtactccccaagccacccccgcctctgagcgcggaggcacgatgttctggggctcgagccttcgcatccaccgggccagcgctaaccaccggccgccgccctggaggggacccggcggccccgccacgtgcggctgcgagtttcagacccgcttccggggggcggcggccgtcggaggcctgggttggggggtcgtgagccggatgttccccgcagctggccagaaagctgcctctgagcctcttgagcaactccctgcctcctccggtagtctctctggactctccaagtgacttgctgggggcaccgggcgcggggagggcaggcccccggggtgacgcaggtgtgtactttacagccagagaaggcctagctttcagggacattggcttagtttgttgggtgagacgtgggggtggagaatgggagcactgtctctttgccaaattttccagagaaaccccgggactagctctgtccctggtgccccggctactgccagcgggtccttagcgctgtcgattgcgcgcaccggagcccgaagtcttccccaccgctggcaggagagccccgcgagctctcccggacgtgtcgggtcctaaaggggagagctgagcagccacttcagggattgcactccgaggtggccgaggcagggaggagcgctggccccgcgaaggaggcctcaaccttaggacaacccgggcgtcccgggcgaaggtctcgatctgccggagccactgcctttcaggcatcgctccattaaagccagggaggagagggtcattggccagcgacccgccctccttacgtccggaggtcaccccacgcctacaggcaggtttttctgtctcctttgcagaacactatgcgtttgttacaacgattaaatgaagaacacagaagtctctggctctgccgggcagaacgcctc

SEQ ID NO: 109685 - DNA, 1881 bp, Homo sapiens
  misc_feature 1..1881: note = chr14:57263796-57265677
  misc_feature 1..1881: note = Hyper
  source 1..1881: mol_type = genomic DNA
agggcggaaacggggcgactaggggaatcaggttttatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcccatttgcgtgggatgcgctggtctcctgcccgactcttttgtgttcctcttttgcatgattaaaaacacgtttctatatgcactaaaccatcacctagcactggcacgcctggttttgggttacagctttgtccgtataataacagcgaagttctccctgggtgtgagatgcgggttcgaacatgtggtgtgcgcgccagggctggccgcttccggttaagtggacgcggggacttgactgcgtcccctgccttgcaggtaactggaatgggttgcctggcaagttggccctgcccgggacgccgaagggaccgcttccccattccagagcctgcctctggccttcagggccgctgacaggtccgaaaagaaagagaaggcactcagttttaaaaaaaagagatctagaggactggggaaaaggggatgagccaaggcaaactgggaattgctcgggcttcccccgaaagcctcagctcagtgccgggggagaccccaacggagggccagactcccccaaatccagtggccgaagacctggatttcctgggaggatccccgggggcccgaggcaggcccagctgggccccgtctgctcgggacgcgggaggcctcagccgtggcgggagcccccgctgtggcggcctcgcccttcgaggccaggagaagcggccccctcctaagccgtcagcggctcatcctaccgggagacctggaaaaccagcagccgcgggccctgctgggcttgctttcgccgccccggccccttctccccggccagtggaccccgctcgccgtcccgtctgtcagtctcggttttagctccttcgggcgcagggcgctcgcctcccggccgggccaccccaccctccaatccccgaggccgacccgacccctgcactccgccaggccgcgaggtttcccagcgaccggcgccccggcccgcggccgacctggaggcctgactgcagggctcgggcggggccctctctcggctctggctggcggcccactcccgcgggcgtacaggcctcgccaccgggcctcggccttgccgcggcccacagcgccctgggaccggcgcccccgaggcctgagaactacgcccggggggcgcgggctgaggctcaagagaggtcctaggtgcgggccagggatggagccagcccagagagaaaggggaaaacccggcaaggcaagagcctcagtctcgcccctgcctggcccgccaggctgtgagtggggcccattgggcagcgccaacctggggagtccggcgtctgccccagctgggggccctcggggcagagatgtgagtgctgttcccaggtaactccgactgggcactggggagttagaaaagccagctctttagccagagcgcctagggcgcggcggagagcgggccgcccggcaccacgttccttctggcagttccgccccagcctcccagcgtcttgcgcctgtggcggcggcagtacgggcctggggggtcacccacaggaaaggtgagattagcagcaccatgtgggagaggggttgaggaaacccaccattatctaaaacttggaggtttccaaagccggaacttaattgag

SEQ ID NO: 109686 - DNA, 313 bp, Homo sapiens
  misc_feature 1..313: note = chr14:57270936-57271249
  misc_feature 1..313: note = Hyper
  source 1..313: mol_type = genomic DNA
agtgccacctcctctcgcatgaagatgtctgggtaccgggtcttggcaaacagtgcttccagcacatctagctgcgcccgagtgaacgtcgtcctctcccggcgctgtttccggggggtggctgcgggacaagaagcccagggccctttagggtgggggagcagtttctcagtcataggcgtttccgcgggttctccgacgcccctgccctccaccccgcagcagtcccccgttcctcacagcccttcagccgggagcctaccaatgctctccccaccgtctccccagccttgctccccggggacccaggaca

SEQ ID NO: 109687 - DNA, 37 bp, Homo sapiens; identical to SEQ ID NO: 76854
  misc_feature 1..37: note = chr14:57271647-57271684
  misc_feature 1..37: note = Hyper
  source 1..37: mol_type = genomic DNA

SEQ ID NO: 109688 - DNA, 401 bp, Homo sapiens
  misc_feature 1..401: note = chr14:57272009-57272410
  misc_feature 1..401: note = Hyper
  source 1..401: mol_type = genomic DNA
agggtgttgcatccccggagggtgggcatggggaagaggggtgcgggagtgcagcagggctcacttacccgggtagcccacggaggggtgcagcaagtccatacccgaagtggtcagactcagcccattgactgcgtaaggcggttgcttaagataagacatcatgctaaggttgtttggaggtgcaaagtcggcccaaatcgggggtacccagctggaagatcttgatgcgcccggggtggacaggttcagagtccttggtgggtgggtttggagcagtggaactaagggcaaagcaaacaaacaaacagaggggctggtttactgcttcggaggcagcagctcttccacgttccagcactaacttaaaaagagcacggactaggcgaggcagaggcttt

SEQ ID NO: 109689 - DNA, 30 bp, Homo sapiens; identical to SEQ ID NO: 11888
  misc_feature 1..30: note = chr14:57273051-57273081
  misc_feature 1..30: note = Hyper
  source 1..30: mol_type = genomic DNA

SEQ ID NO: 109690 - DNA, 2824 bp, Homo sapiens
  misc_feature 1..2824: note = chr14:57274417-57277241
  misc_feature 1..2824: note = Hyper
  source 1..2824: mol_type = genomic DNA
gattctctccacaaccggcctaggtatgcactctgcatagaaggcatgggcccttcaatctaactttcaaagctcttttcctctcgaagcagggtccagaacggggaaaagaaataacttttgaaaaatccacgcctcactatgactgctcacgaggtggcctctggagaactcatacctagaagctgaccgcggtcgcgcggcgagttccggcagccggtcggcgaccgcacctccgggcgcgagtgcctgggtcccgcgttcctgcccggcagccccgcagccccgcagccccgcagccccgcagccccgcaggcctggcgcccgaggtcccgctccactgcccgcgccccccgcgcagccttatatctaacggtcaattcgtgcaatctgtcgcttctccctcccccacgccttgttttttttttcttccaagaagcccatctaccagttgctgtgtcctcgctcaacaataattacctcgtccgagaattaattataataaatgttttcttgataaactaacgagataatccgaggggcacacgtcccttaattacaggccgccatgctcctctctgcttctcgtccgggctgattaattttctgcatgatggaaaggaaacaaaactacgcggactggcgactggcctgcggctgggaagacgacgaagaggaggaaagaaagaaaaaggagacgtgtgggcaccgcggaaaacggccggcgctggcctctctccggcgaactcgagtgaaagtttctggcctcggggaatcaaataactctgccacccgcgagggagggaggaagaaacgtgccaaaagggttggccttgactattaattatcgttgggagaaagccccggtgttagcgctgaggtctgggtgtctaccttactctggggggaggagttccctctcctactcccctctgttgctaataacttttggtgcctgtaaaaagtcccgagctgagcaggagaaatcctgaccccgaagctctaggatggaggggagaatttctaggagcgacttccccgtcccctccccaagcaatccaccaccgcagggtcggcgccgctcggccttcgctccccgcgcaccagttctatctgtgaaggaagcaaaagccaactcggtggaatcctgacaggggacttgggtttccaaaaatatgtcccgaaatcgggcatcgatttcaagagtcacttgaacgcaacaacgcgaagacttcttgggagtttgcagagcgacccgtcgcccgcgcccggcgctggcagggaccttcggatggttcttactgggccgatccatggcacaggctgggcctcggcgaacccctcggcccccgcccggccccgagccacgacacctcattgtcctggagcctgggaagggggtgcgcgagcgcgcgggcgagccctgcctctccccgccagagaacagctgaggggccgcggtcccagcgggaggattccggtccctggcccggccgcggccttgggcggagcaggggccactagctgccacttctgcccgccccaggtgcgcgcggagggctacgtggggcgggccgcgacccggcaaagtcatgttgaaaaaacactcttcacgttcgctcggcctggtgaccagggtcggggaccacgacaaccgggggttgggaggctgcgtaattacaacccagggtggtttggattttggggggtggtggatatttaaaaacaaaaaggagatctggaagcttttgggagaaacagacaaccgagctgtgctaggctgagggagaggaggccaaagagagcgagcagtgagcgccggggcggacgagaagccagcgctcccagcctcctcggttatccgctccggtttccgctcacgttcaacaggggccgacaggggctcgagcggcggcccccggcccaggccgacccgcaagcgaaccgagcttccggcgcgcgggcccaaggaggcgcctggctttttattattgttgtttcaatccatccatctagttacatctgcatctttttgtctcggactctaaaaaggtccctgggatccatccaaacgaccccaaccaaatctgggggccaaaacgcaaagatcgcgggagaagcccagaacggcgttgacataaaaacaaaaccacaaacaaaaccttccaaaacaccccagattacattcgcagcgtttcgacgacgttttgcagaagcgacgacccccaggagcacgctctctgcctctctcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttaccttacagcctcatgggaggttagaaaaagtcaaatatcctttaaattccaaatagccagctatcctaaaagaaatcaagagtattgagttagaaaccttgcagtcttcacccttccatgaaaagtcaaacacaaccaaaaaaaattttttttaaagaacgaaaatgaggaaggcggctagagttctaaacacgcgtgggcccctctgcaatacatacaaagtagatgtggcgagtgagggctgctctagcaatttttatttttaatcacagtggaggctgtgttggagctgaggccggtcccgctctcagggagatttgctgagaaagcgcctctctggcaactttttgacgcaaactctccaac

SEQ ID NO: 109691 - DNA, 1746 bp, Homo sapiens
  misc_feature 1..1746: note = chr14:57277879-57279625
  misc_feature 1..1746: note = Hyper
  source 1..1746: mol_type = genomic DNA
cttctctattccctacgcccttataaatatccttacacatataaataaatgatccccgagtgagagaccccggcttctggtaggttcctggggttttttggaattgagaagcccacgacagactgcagggaacacgaaccccggaatctaatctcagggcccatttaggagaagtagctgggaccacatcgggcctcgaggatgcgagtgtgaggtcgacaagatatcgtggaagagagcgaacgagggaggcccccgttggaaacagtttctgtgttagaacaaacgccaccaaacgaccgacactgcgaggcctggagctacctgggctggcgccgcccgagccccgggctgcgagcccagaggctgggaagtgatgggacctgggggcccgagccggagagtgcgacccccagcccaacttttttgcctggcatagaaagcagggaccggacaggtttcaaacggatccgagtccctagaaaagcaaaaacagactgggcggagtgtggggtggggggtggctagtggaactggtgagtgtgtgtgaataagctgggtgggggtgggagcagaagacagctcttgcttcacaacacccagtgcaggaaaagaaaaataaaatctcttcctaaataccccaccccccgccacccacccaccaccaactaccatcaccaccacggccagtgggcccaaagaaacagctcgctgcctttaatttggggacctatgttaatgaagttggtaattaattcgtcgctttgttgtcggttcttatactgtatgtgtactcaaatgtggccgtccttgggatttacagcaattaacgaattacgggagtgcgcacgaggcagcaagctctcggcagccgggctccggctcgggctcggcctggggctggggactccgcggcagcggcccctgtcacaggtgtccctagagctttgggccctggcggcccctcgagcccccgaggggcccggagcccgcccagctccttcccggccctctgcagcagctccagtccggagacccgctggctgtcgcgttcccaggagtcaagagtttctaggggcccgggcgggggggagggtgagtaccgaccttttttctcaccccacccccactgtactgaaacacctggcggccgcccccgaagcctttaatggggatggtggtgaggagggggtaacaaatgccccgggcgttatgaccctcgtggcgctggctgtcggaggcactggttgggtgcgcttggtcagagtcatgatgctttcgatgaaggaaaggcaaatccacctcgatcacctgaagcagagtctccttcctacccctagaaaagacaacgtttcccccagtttgatcacaatgatgtttaaagcataaaagagccgaaaaagaaaaatggacgttgtgaatctggcagaggggaaggccggaggaaggccttggggacagtgggcatggggtgggatggagaatgatcagaacatgcgcttgtgagctaaaccaagtaaaccattttggactgggagatccatctgccgtagggtccagtgtccagggtaacctttcaagcccgatgtagaggtttgcgatgtcctcccagatggcgggggcagctgaatctccctaaaaatccccctgttctattcgacaggggcagatttatgcatggtggggcgtgagagggttttgcccttccagcggccggcagcagacagctcccgcttctcctttgcc

SEQ ID NO: 109692 - DNA, 30 bp, Homo sapiens; identical to SEQ ID NO: 76864
  misc_feature 1..30: note = chr14:57280814-57280844
  misc_feature 1..30: note = Hyper
  source 1..30: mol_type = genomic DNA

SEQ ID NO: 109693 - DNA, 126 bp, Homo sapiens; identical to SEQ ID NO: 35328
  misc_feature 1..126: note = chr14:57281138-57281264
  misc_feature 1..126: note = Hyper
  source 1..126: mol_type = genomic DNA

SEQ ID NO: 109694 - DNA, 1395 bp, Homo sapiens
  misc_feature 1..1395: note = chr14:57283299-57284694
  misc_feature 1..1395: note = Hyper
  source 1..1395: mol_type = genomic DNA
catacctgagatacacggtgcaaacgcccccggctccctcctttcccaattcacccacttcttaatttgagtttcttaatgtgcaagcgccagggccggctgtggtcaggcgggctattttctggcaagtgtggcgcggggctggacgcccctgccggcgggtcgccgggtctcgagctgcgccgccccgctggaggcgccggggctgcctggctctccgcgcaaacctcgcgcccttccgtttgcgcgcatggagccgggtgagggcggccgcggccaccgcgcgatggaggatttggaagctcagagccagctggtacattttgagaaatttagcaaaccagactgggctgcctcggaaactgggttctgttctgactcatttgcagaaaagttatggggaaaaacatcttgtaaaattaaggttatgtttggcgggtacagtcttgagcgcacatggtcatccggcgaatcagccaagttttccaaagcgccccctctccagctctcaggccaggggagcaaagcgtaggtgtgtgcgtgtgcgtgtgcgcgcgcgcgtgtctctgtgtctgcgtgtgtgctcgcaagcgcgtgtgggtttggggtggggggacatcctgacctttctacaccctagtgcgtcccaactccagactgggaggagacgtctgcggcctctggtcttttcccttcttggacgaggtgcggccagctgagacctcacaccggccacctcggacccagtgcgccgagctaggggagacggcgcgggactgggggacccctgggatcccgccctcgtagcggaaggagtggcagcccttggtgccgggcctggtccttgaggctgccggccctccggggcgccaggactcgaggacgcggtttgcccccgcagtcctaagatccccggggccgtgacagcttggggaaggggcaaactctgtttggtctccacgaagtgcttcgatgttcgcaaaagggtaggcccctcttgcttggggtcctacacccctcggaactggctctgcccctgcctcttccccagcacagtctcccagctaaggctcagacagccggggaaaggggcgcccccatcactattccccacaacccgccccagtgtgagccagggcgcggctgcaggctgacaggcgcaccgtgaccacgccgtcacttcccttcaccaaaggttagatgggaggcgtgcaccctctggggagttcgcaaagcttctcgctttgatcagccgcgcgcagtgccagggagagatattgctggggtctgagtccgtcggaagtgtctagaaaagaagagagaggagcaggtaatcagactttggcggctgccctggagacactttcacacatccagcctcgtggaggaggaagg

SEQ ID NO: 109695 - DNA, 242 bp, Homo sapiens; identical to SEQ ID NO: 76869
  misc_feature 1..242: note = chr14:58332163-58332405
  misc_feature 1..242: note = Hyper
  source 1..242: mol_type = genomic DNA

SEQ ID NO: 109696 - DNA, 233 bp, Homo sapiens
  misc_feature 1..233: note = chr14:58332640-58332873
  misc_feature 1..233: note = Hyper
  source 1..233: mol_type = genomic DNA
tgcagctcctgctcccgcgcccgggctctgactccaccgcccggcgcagcaccggctccgcatcacagcggcggcggcggcggcggcggcggagcggcccccactcgggccggcctctccgtcagcctggcagctctcccgcgcgccacccggagcactgctgcccgaatagcgccccctcacctccgacgcccaccgtggccgggggcgggtgtgggcgccccacctggtcg

SEQ ID NO: 109697 - DNA, 22 bp, Homo sapiens
  misc_feature 1..22: note = chr14:58404059-58404081
  misc_feature 1..22: note = Hypo
  source 1..22: mol_type = genomic DNA
acaggcgcgagccaccgcacct

SEQ ID NO: 109698 - DNA, 41 bp, Homo sapiens; identical to SEQ ID NO: 76872
  misc_feature 1..41: note = chr14:58410326-58410367
  misc_feature 1..41: note = Hypo
  source 1..41: mol_type = genomic DNA

SEQ ID NO: 109699 - DNA, 39 bp, Homo sapiens; identical to SEQ ID NO: 76873
  misc_feature 1..39: note = chr14:58599573-58599612
  misc_feature 1..39: note = Hypo
  source 1..39: mol_type = genomic DNA

SEQ ID NO: 109700 - DNA, 100 bp, Homo sapiens; identical to SEQ ID NO: 35334
  misc_feature 1..100: note = chr14:58618341-58618441
  misc_feature 1..100: note = Hyper
  source 1..100: mol_type = genomic DNA

SEQ ID NO: 109701 - DNA, 60 bp, Homo sapiens; identical to SEQ ID NO: 76875
  misc_feature 1..60: note = chr14:58797784-58797844
  misc_feature 1..60: note = Hyper
  source 1..60: mol_type = genomic DNA

SEQ ID NO: 109702 - DNA, 40 bp, Homo sapiens; identical to SEQ ID NO: 43992
  misc_feature 1..40: note = chr14:58893188-58893228
  misc_feature 1..40: note = Hypo
  source 1..40: mol_type = genomic DNA

SEQ ID NO: 109703 - DNA, 36 bp, Homo sapiens; identical to SEQ ID NO: 76877
  misc_feature 1..36: note = chr14:58922879-58922915
  misc_feature 1..36: note = Hypo
  source 1..36: mol_type = genomic DNA

SEQ ID NO: 109704 - DNA, 30 bp, Homo sapiens; identical to SEQ ID NO: 76878
  misc_feature 1..30: note = chr14:59014447-59014477
  misc_feature 1..30: note = Hypo
  source 1..30: mol_type = genomic DNA

SEQ ID NO: 109705 - DNA, 30 bp, Homo sapiens; identical to SEQ ID NO: 76879
  misc_feature 1..30: note = chr14:59649485-59649515
  misc_feature 1..30: note = Hypo
  source 1..30: mol_type = genomic DNA

SEQ ID NO: 109706 - DNA, 987 bp, Homo sapiens
  misc_feature 1..987: note = chr14:59931116-59932103
  misc_feature 1..987: note = Hyper
  source 1..987: mol_type = genomic DNA
ggccgcgcccagctgcgcggggtccggggaggtccggtagaggcagccgtggaagctctgcgccgccgcgagttcccggggcgccccgagcagctcccagggcaaggagaagcccagggccgtcagccaggcgcccgccagcagctgcagcgcgcggcggcggccgatcttctcccgcggcggccgcacgatagcgcagtaacggtccaacgagatgagcgccacgctgagcgtggacacgatgccgaagcacgagctgaagaagcggctggcggcgcagaagccgcgccagggccccgcggcggcggcaggcgccgaacccccgggcggagtgaagaggtccaggaaggcggcgggcaggcagagcagcgccgtgagcagatccgatagggacagcgacaggatgaaggcgttggtgacggtgcggagctgccggtgcttcacaatcacccccatcaccgcgcagttgccaaggctagacagcaggaagatgagcaggaggacgagcgcctgggccgccactgcagctccgtgcgacagcagcggcgccgcctccgggcctagcggccgcctcaccgccgcccccgcctcccgcgctgccccggacccgccaaggccgccgccaccgggagcggcagctgtgccgcctccgcttgcgtcgctcaggttccccagcgccgcggtcgccacggtgctgaaggagagcacggccgccgtggccgcggaggaagtcccgccaggtgggccggccgcggagggggcgccggagtgctggctgcccagtaaggccatgctcgctggtgggcggggcggctgcggctcctccatggggcccagtggcggccgcggatctcctcatcccgcaccgggggcggcggccgctaggtcggagtggtggctcggggccgggggctagcggccgccgcggggagctgggctcggccggaggggtggcggtcgctggggacctggcggagcctttgacgt

SEQ ID NO: 109707 - DNA, 352 bp, Homo sapiens; identical to SEQ ID NO: 76883
  misc_feature 1..352: note = chr14:60043255-60043607
  misc_feature 1..352: note = Hyper
  source 1..352: mol_type = genomic DNA

SEQ ID NO: 109708 - DNA, 479 bp, Homo sapiens
  misc_feature 1..479: note = chr14:60097193-60097672
  misc_feature 1..479: note = Hyper
  source 1..479: mol_type = genomic DNA
ccatcttggtggaatcggcagtggcctgcatcgtgcgggctttgggggctcgccgtggctctcctcgggggcgccgagcgtgcactcaagcgttggtgcccggctgctgcggctgggctcgcagtggccgcgcggctgcggagagactgaggctgcaccaggcggcgcgcggtgaggggcgggagcgtcgctggcgccgcagtctgcgcggccggcagcgaatcagcgcggcgcggccccggagccgcctgcgcgcatggggatgcgggcgccgctccacgcgacagcgttggctgggctgcccaagggtgctaccctggagacgggtaaagcggttctggccgcgaaggcgctgacgcggacagtgggtgggaggtttgggaggaggggaaaaagggctgacggtgggggtgagaggaggaggacttgggctgttcctgggagttcttgactcccagaatatgcgaggtgcatattct

SEQ ID NO: 109709 - DNA, 260 bp, Homo sapiens; identical to SEQ ID NO: 76886
  misc_feature 1..260: note = chr14:60336793-60337053
  misc_feature 1..260: note = Hyper
  source 1..260: mol_type = genomic DNA

SEQ ID NO: 109710 - DNA, 758 bp, Homo sapiens
  misc_feature 1..758: note = chr14:60385979-60386737
  misc_feature 1..758: note = Hyper
  source 1..758: mol_type = genomic DNA
cgatcatgggccctgcgagtctgtgggtagcggctcaccctgctggactgcgcagatccagagaacgacacgagacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaaaagcctgtccgagatcgactagaagaccctcggaaggtccctctcttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctgccagcgagaagctcccgccgtttcccaggagccccaggtggggtcttccggttggacccctgcttccgctgattggttggaggtcgccaccacgtgatg

SEQ ID NO: 109711 - DNA, 407 bp, Homo sapiens; identical to SEQ ID NO: 76889
  misc_feature 1..407: note = chr14:60794473-60794880
  misc_feature 1..407: note = Hyper
  source 1..407: mol_type = genomic DNA

SEQ ID NO: 109712 - DNA, 30 bp, Homo sapiens; identical to SEQ ID NO: 76890
  misc_feature 1..30: note = chr14:60798457-60798487
  misc_feature 1..30: note = Hyper
  source 1..30: mol_type = genomic DNA

SEQ ID NO: 109713 - DNA, 1101 bp, Homo sapiens
  misc_feature 1..1101: note = chr14:60951858-60952959
  misc_feature 1..1101: note = Hyper
  source 1..1101: mol_type = genomic DNA
ggatatatttcgtaacgaccttttcaatatagcattcttcacaggaacatgtgggcagagccagaactggaagacgagaggcccccttgagcccatggcgacattcccagccccttcccgggccaagcccaacgagcgcttcagaaatcgttgttgagtcggggcacgacttgaagttttggggatggggtgggaagcacccgcataaccgcttatgcgtgggattgcaacaagcatccggatcttccagggttcacggacacccagatttctccacaggatatgccctttaaagtaaacgctctgaatatgtcccttggtggcgtgtgtacaaccacgtgtagcaaaattctaacgaaagcccttccccaacacccgggtaaacctagagaaacagtgcgatttcgcatttacgaatttaccacgaagaataaaaaaattggaggttttcacagaacagccaattcgcattacggcatacgcctgaggcggggttcctgtctaccgtgcccctcagagcccaggaaccacagcccgtgcgcctcccgcagtgggagttcgccggccgactcccaccctcacagcctcctgtcctggcttcccctcgcccgaggctgcaacaccgcatcccccccatcccccgccgcgccctcagcctcgggccgcaccaacccaggggataaggcgactccggtcgctctgaggggcagggccagccagccccctcccacccacgcacacgctccccctcagagccgccggcccagagaaaaaccgccacatgcagctcccttccacacgcacctaaacagctcctctggacccgaacgcccacaccctccctccctggggtcccaaactccactcaggacgccacagcggatcctaactacaaacggtccccggagccctgggctggactcgctcagccccgcccccacgcccctggtaccagccctgagagaccccgcggagcacgccgcgggagccgcagatcgcgctgaagagcagcgagatcgcgctctggacgagacctgcgcggctgcaaccgctccttcttcgcgggtggaagcgcggaataagccccgtaaaaccacagaa

SEQ ID NO: 109714 - DNA, 853 bp, Homo sapiens
  misc_feature 1..853: note = chr14:60973239-60974092
  misc_feature 1..853: note = Hyper
  source 1..853: mol_type = genomic DNA
atacttcttcctgttcgtcccttccccttgtgaagctggtgaacaaataagtgattccaaggtgccctggcgcagtctatttcctttgggttaataaaattaaatcaagtcccttgcgatggcgaagatggatctcctgatagtagtccccaacctccaggcacttctcagtcccttcctgccaagccaccagacagtgctcctactctgccacacgcagcccgcacccttctggcggctcccgcgaggccaactcagactctcagttccagttgcccgcgagcctcagacacgcagaagctaaagcgccctcatctaattatttgcagaactattatccaagaaatgggccatgggataaatattcccatttcctggatggggcccctagactgtccacttgctcacaaagattaagggtaagaaaccagctctccccgaatgtgccgcttccaaactgtccagtaaaagggcgagagggagacgtgtggtctcctggggcatggacaacctctcccacctcagcagctaggcgctgggatcggggtcggctctcggctcggctcgcgggctgtaaggtctccgcggaccccaccgcctcttctgcgcgctaagggtgagcgccaagcaatttcgcgagcaatagccggcaaagtaaccaccccgagagggaaaataaacctctgcaaactggagcaagggggtgctttcctcccctggccagaagctccgggatcgcagccctcccgggtccggcttcatccctgcccggccaccgaggccctctttttctgcaccgcggattctcctccgcctgcgtgttcggggcccttgtatccgatgtttctttcta

SEQ ID NO: 109715 - DNA, 47 bp, Homo sapiens; identical to SEQ ID NO: 35348
  misc_feature 1..47: note = chr14:60974368-60974415
  misc_feature 1..47: note = Hyper
  source 1..47: mol_type = genomic DNA

SEQ ID NO: 109716 - DNA, 1476 bp, Homo sapiens
  misc_feature 1..1476: note = chr14:60975384-60976860
  misc_feature 1..1476: note = Hyper
  source 1..1476: mol_type = genomic DNA
gaaaaatgagaagatcgcttccccccaccggcttcctgctcccaccgcaaggtttgctgtttcgttacaactaaacttgcgaattctcggagcatttcagtttggcccagtcctctttgtcctctggagacctctcgaccgagacaacgcatcgccccaaagtgaattcctgaattcctgtggcatcactgcctatttggtgggaaaaagggagggaggggtagagcggggtgggggagggaggagtagtgaacgctgccgcactcgcctctctttttctcccagacactcgcatgtcttttcaacctccaggttctgcaaaatactgaagaaaagtccaggagctaacggcgggcgctgtcgagcacggggaggtgctgaaatagtcctggcgtgctgattcaagctttgattggcagagccacccggtgactgacagggggtctccatggcgcccgcgccgccaatccgcccaccccaatagcggagccagctcgcctgccggcgtgcctgagccgagccgagcccgaaccccaagccgcggagccagcacctcctccagtcggggtcgtccgctcccggccgttgagccaccgccgccacccggtagtgtgtcccgctgccccaatccgcctcatcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacaggtcggtacctagaggcctccgcgctttgagcgcaccggggaggaggcgggtggaggcacctctggcgcccttacccagtccctggcgactccaattcagcaggagttgggagcgcggtctgtcttgggttaagagccctgcgttctgggctcctggccgggagttcccttgc

SEQ ID NO: 109717 - DNA, 1005 bp, Homo sapiens
  misc_feature 1..1005: note = chr14:60977284-60978289
  misc_feature 1..1005: note = Hyper
  source 1..1005: mol_type = genomic DNA
ttttgcggaagagcccggcctcatcccccaggcccaaatgctccttacaatcctttttgcctttaggtcgggccgacccgatccaacgcgatcgcgggagcacttgctcaggcgtaagccccaggcagacgcaccgttagaaatggtatcccatgtccctgggaccgatctgtccttgtcacccacacttcgtttatttcctgacagtcctgtaaatctcccaaaagtgcacaacaaacagggaggacactgcaagcccagtatataaaagacctgggagctgcggcgctgagaaagggcgcgaatcatggtggggcacaacagtagggacccgcggaggggcggccgcggactcctgcccgacctctgtcgccttgccgagtaatcctcgccttaactgctggggtcttcggaagaacctctagccgccgggctggagggacgcaggaggtggtgggggcgggcgacgggcggctgtgttacgagctgtgacccgtgttccctttcttccccgtagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattc

SEQ ID NO: 109718 - DNA, 30 bp, Homo sapiens; identical to SEQ ID NO: 76903
  misc_feature 1..30: note = chr14:60978879-60978909
  misc_feature 1..30: note = Hyper
  source 1..30: mol_type = genomic DNA

SEQ ID NO: 109719 - DNA, 1842 bp, Homo sapiens
  misc_feature 1..1842: note = chr14:60981157-60982999
  misc_feature 1..1842: note = Hyper
  source 1..1842: mol_type = genomic DNA
ggtcaggctcttttccggcttataaacatttcaaccacactccagtttcaccaaaaaaaacgacggcccctgctccccaaatgccgcagttcctctcgcctccactttaatgacccactccacttccacccgtcactccctcctttcccttcgccagtttgtttataaaaaatctgggagggaggggagaagacgatgggggtggggagggcttgctctttgtttacattaaacaaatgacaggcaaagagctcaagcaaagtcttccttgacctcgttccctctccctaattttaacaaaaaggaaaaaaatattgtatccaaagagaatgtgaatggggcgggaggagaggagaagcagcttttcgctctattcaacggggacgcgagagcgcggacgatttccgctccttttgtgaggcggagcccgggggcggccgtgaatggggggtctgtggagcggccggcggggctgtcaggcggctctgcgtaatcagggctaatgacggcggccgggcgctcggcgggacaatgcgcggggccgcggggttttgtcggcctgaatggctaataggtttgcctgtgagctgcgagggggcggtgtcggggaggaggcggcggcgaggggagaaggggtcattgtccgcgcgctggcccgggcgccgaggcgtgtccctgcctgcgccgcgcggctacccccgtgcccggcgccgccgacgggaaggcagcggcggggaggccccctggaggcctgctgggaaatggcggctggagcggcgggcgcgtgggtcccctcggggaggcgccccaagccacggtccgctcccaaagagaagcccagactgggcccacagtacccgggaaggtgagtccttactcgggggcccagatctccccacggaggccacagatctgggtccccgaggaaggagagccccccttttcgcgcacccaccttttccatccagcgccccgcgaactcgcggacgtgtaggcctcgagccactcctactgttgggctgcgtgactcagcggctcgaggagagaaacctctcaaaaccgggggaccgagacggggttcaatttaaacctaggtgggagaatgagcccacaagcgcgcgcccctgcagctgcggaggcgcgcgcccgcccaccctcgggcgcctgaagtcgcagcggttgcagagcctcgagcccgtggatgcggcgcgcgccgcggtctgggcctgcgcgagaggctgccgcccgcgtcgggcctgggcctacgcgtgtctggcctgggcctgccggtgcaacagcagttgtcgccaccggtcctaggccgcgccgagcgagtcgccgagaggggcgggaagaggggagaggtccgagaccagggagcgggacctaaagggggctttccgcgcccgacaggtccgccggggttagccttcgaggcggggagagggagcggggtccttcaaggaccgcatgttcgcgatagcacatttgagccctggcaggccacctgggccgccttctttcggaaaccttgcggggtttccaagcaaggtttacaatgggaaactttatttcccattgtaagctcttacaaatctcctctggctagatccttccttgcagctctctttgctaggatttatattcccaaacttcttcagacgtgccctaccgcgagggaacgaactggttttcttcccgttttcacctccttgtctggagacaaaggggtgtgagggcgatcccagagctgaacaagcagtttcacgcctccctgcccgctcatgctgtttccgcttgccctgtggtttgctctgcctggaacgccgccccctacctcaa

SEQ ID NO: 109720 - DNA, 724 bp, Homo sapiens
  misc_feature 1..724: note = chr14:61104140-61104864
  misc_feature 1..724: note = Hyper
  source 1..724: mol_type = genomic DNA
cctaccccccagtgccggcgaggccccctggcagatggaagctgctgactgatgggggctgccgagcgcgagggagctgagtgaggcccttgcgccctaggcggttgcaccccggacccctgcagctgtggacgccggagctgtgcgcagtcatcctgagccagcccgcggggcccgatcggaagggacgcctctcctaagagctggcctggagtcctggagcctccaagcgggcaagtaggggccgcaaaggctgggctgggcctccgctgaggccctcgggggcctctgggccctcatggcctggaggccgcgcggcccaagcccctagagcagaggccgcgctagcctgcaggggtcgacgcagggccggaggcagcggcttttccttcccactccgggttgaccctaaagacacgatttaacgtggcggcggcagctgcccacgctgtctggaggagcagggcgcctgggatgcggcggcgaaactggcccggaggggggcccaggcctcacgcgcccggctctctcccagctctcctcctcctccttctcgggctcagaaagccttccagccgcggccccagccctccccccagcctgtgctgggctccgctttccctccatcaactccaagccgaattcaatccgagaaggctcctttgagcttttgtgtttgctgggggagatgtgggcgcaggagggatcgcgttacaactttcat

SEQ ID NO: 109721 - DNA, 254 bp, Homo sapiens; identical to SEQ ID NO: 76910
  misc_feature 1..254: note = chr14:61108567-61108821
  misc_feature 1..254: note = Hyper
  source 1..254: mol_type = genomic DNA

SEQ ID NO: 109722 - DNA, 1157 bp, Homo sapiens; identical to SEQ ID NO: 76911
  misc_feature 1..1157: note = chr14:61109111-61110268
  misc_feature 1..1157: note = Hyper
  source 1..1157: mol_type = genomic DNA

SEQ ID NO: 109723 - DNA, 299 bp, Homo sapiens
  misc_feature 1..299: note = chr14:61110508-61110807
  misc_feature 1..299: note = Hyper
  source 1..299: mol_type = genomic DNA
catctggaatatgcgcgctctggatttagtgccaggggttttacaaagagtttatgactgtgacagaaaattgtccttttaacaagtttacaagcagtaatcacgggggcttttacaggaccagcgctcttgctcctcgccggatctgcagacatttccaagattcaccaactaagggagcaggaagtgggccggggcgccctgcgagacacaacttccacgagcctaaaattatcccaggcggagctgggagagtggagggtagtcaccggagtaggaagagacggcatgtaagaaat

SEQ ID NO: 109724 - DNA, 608 bp, Homo sapiens; identical to SEQ ID NO: 76914
  misc_feature 1..608: note = chr14:61114114-61114722
  misc_feature 1..608: note = Hyper
  source 1..608: mol_type = genomic DNA

SEQ ID NO: 109725 - DNA, 1613 bp, Homo sapiens; identical to SEQ ID NO: 76915
  misc_feature 1..1613: note = chr14:61114997-61116610
  misc_feature 1..1613: note = Hyper
  source 1..1613: mol_type = genomic DNA

SEQ ID NO: 109726 - DNA, 160 bp, Homo sapiens; identical to SEQ ID NO: 76916
  misc_feature 1..160: note = chr14:61116868-61117028
  misc_feature 1..160: note = Hyper
  source 1..160: mol_type = genomic DNA

SEQ ID NO: 109727 - DNA, 358 bp, Homo sapiens; identical to SEQ ID NO: 35364
  misc_feature 1..358: note = chr14:61118778-61119136
  misc_feature 1..358: note = Hyper
  source 1..358: mol_type = genomic DNA

SEQ ID NO: 109728 - DNA, 34 bp, Homo sapiens; identical to SEQ ID NO: 76918
  misc_feature 1..34: note = chr14:61120426-61120460
  misc_feature 1..34: note = Hyper
  source 1..34: mol_type = genomic DNA

SEQ ID NO: 109729 - DNA, 141 bp, Homo sapiens; identical to SEQ ID NO: 76919
  misc_feature 1..141: note = chr14:61123540-61123681
  misc_feature 1..141: note = Hyper
  source 1..141: mol_type = genomic DNA

SEQ ID NO: 109730 - DNA, 393 bp, Homo sapiens; identical to SEQ ID NO: 76920
  misc_feature 1..393: note = chr14:61124304-61124697
  misc_feature 1..393: note = Hyper
  source 1..393: mol_type = genomic DNA

SEQ ID NO: 109731 - DNA, 507 bp, Homo sapiens
  misc_feature 1..507: note = chr14:61188120-61188627
  misc_feature 1..507: note = Hyper
  source 1..507: mol_type = genomic DNA
atccccgcagtgccccgcggtcggttcgctttcatgccgaggggaggggattacccgggctttgggctgcggggccaggagcgcagaaagcgctttgatttacaagctgaggctgagccgccgtcgccgtctgcgagggtgactcaccgggggtgcgggtgggaggtagatccggagaggggcctaaaccaggcaactgggccggcggcggggtgggtgtggagtttatggggtggggcgggggggacgaagaagccagcagtggagcgtgggggagtcccagggagcgtgcccggctcgcgagcggaggcggcggagcagctggcctgctcgcggtgcccccttgccaccctctgccccggccctgcggattccgttggtttccgagcgcgggatccgcggcctctagtgggcgcagggcaggtggctcggcgtaaccaaagcgccttctctggacctctccgcatatctgcggaaggcgcacgcacatcccggtgcaccttttgt

SEQ ID NO: 109732 - DNA, 190 bp, Homo sapiens; identical to SEQ ID NO: 76923
  misc_feature 1..190: note = chr14:61655782-61655972
  misc_feature 1..190: note = Hyper
  source 1..190: mol_type = genomic DNA

SEQ ID NO: 109733 - DNA, 384 bp, Homo sapiens
  misc_feature 1..384: note = chr14:61747354-61747738
  misc_feature 1..384: note = Hyper
  source 1..384: mol_type = genomic DNA
tgaagaggctgttggcgatggcgccgcagggcgcgatgggcaggccggccgcgctgcgctggtagggggcgcactcgttgacagggtggcgcagcgcgctggggagtccgctcagctgcgcgtcgtcgcgggacacgccgtagcgccggttgttctggtagaagttggtcagctcgtagtagaggtacactgggccctggaagagctcgggcagcgagaagtaccaggcgcacgagcaggggggcggcagcgcccggccctggccagccgcggcgcacaccgagcagttaccggtgcccgggtcgcctgtatagtcgtactccagctccttgatgccgttggaggagtagtagaggcccaggcccaggccgatgaaggccaggc

SEQ ID NO: 109734 - DNA, 107 bp, Homo sapiens; identical to SEQ ID NO: 76926
  misc_feature 1..107: note = chr14:61748097-61748204
  misc_feature 1..107: note = Hyper
  source 1..107: mol_type = genomic DNA

SEQ ID NO: 109735 - DNA, 237 bp, Homo sapiens; identical to SEQ ID NO: 76927
  misc_feature 1..237: note = chr14:61788181-61788418
  misc_feature 1..237: note = Hyper
  source 1..237: mol_type = genomic DNA

SEQ ID NO: 109736 - DNA, 483 bp, Homo sapiens; identical to SEQ ID NO: 35370
  misc_feature 1..483: note = chr14:61788722-61789205
  misc_feature 1..483: note = Hyper
  source 1..483: mol_type = genomic DNA

SEQ ID NO: 109737 - DNA, 30 bp, Homo sapiens; identical to SEQ ID NO: 76929
  misc_feature 1..30: note = chr14:61943693-61943723
  misc_feature 1..30: note = Hyper
  source 1..30: mol_type = genomic DNA

SEQ ID NO: 109738 - DNA, 140 bp, Homo sapiens; identical to SEQ ID NO: 76930
  misc_feature 1..140: note = chr14:62148179-62148319
  misc_feature 1..140: note = Hypo
  source 1..140: mol_type = genomic DNA

SEQ ID NO: 109739 - DNA, 708 bp, Homo sapiens
  misc_feature 1..708: note = chr14:62279298-62280006
  misc_feature 1..708: note = Hyper
  source 1..708: mol_type = genomic DNA
gctgggctctcaggacgccggcggcggccgcagggctggcggctgctgggcgcggggcggcgcggggcggcgcggcgcggcgggggcgcgcggcaggaggggctgtgcgcggcgcggcccccgagcgcaccgggcctgccgaggagcgcgcgcccggccgggctcggcgccggtttcccgaacctgggcggccgtcgggcagccccctcgtccgaccatggcgactgacagtgagtgcgctccggccgcggaggccaggggtggggggaggccgcggtgcccagggtgggaagttcgatttcagacgctgcctttgtgctggctcgcggcagcagcggccgggtccctctccgctcctcacccttggctgcctggcggggcttgaaagggcaggtggccctggcggcgcgccccgcgagggatgtggcagaagggcgtgcgcctggcgccgaggcggagggaccctcgatgccgtgtggcagcggggcctgccatcgcagcccttcgcgggcactgcccccaggcccagagccagccttcagcgagccgggcaaacgaaggcactgcgcgtttttggcgctgtgagttcaaggttcgcctcgagttctgggtcgggtttgtgcgtctgccttttggggatcagggtggcttgcatggctcggctgcccggtggcccacgggctgtattcgcagcgggcagcacaaggc

SEQ ID NO: 109740 - DNA, 23 bp, Homo sapiens
  misc_feature 1..23: note = chr14:62483117-62483140
  misc_feature 1..23: note = Hypo
  source 1..23: mol_type = genomic DNA
agttatggcattggccgggtgtg

SEQ ID NO: 109741 - DNA, 30 bp, Homo sapiens; identical to SEQ ID NO: 76936
  misc_feature 1..30: note = chr14:62523769-62523799
  misc_feature 1..30: note = Hypo
  source 1..30: mol_type = genomic DNA

SEQ ID NO: 109742 - DNA, 735 bp, Homo sapiens
  misc_feature 1..735: note = chr14:62583664-62584399
  misc_feature 1..735: note = Hyper
  source 1..735: mol_type = genomic DNA
cactgagccaaaccccgctgcttcctcagccgctgaaagtgccgccccacccctctccccaaacccgacctccgtaggggacaccgagccaaggcctgcagcgagtgacctgcccggggaggcgcgggaccgaggctcacctacccgggcccgcgagtctcgcccagccccagcctcccaacccactctgccggccccaacttaggcgagcgcagtcgggacccttctgtcggggctctttgttcgccgcccctcggcgttccagctctcaaccttgctcccagcagcccccgccggcgcactcgacctacaggaaagttgctcccgagctgtggaggggcgtcatcgcctcctagcaacgctcctagcaaccgggtaacatctgctccctgtggtccaatgcgagctgagaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaaggtatgtctggattcatccagccaggtgccttcctccgagctcagaagggactcctttccttgagggggaggatagggacgtgttccgggatcc

SEQ ID NO: 109743 - DNA, 1357 bp, Homo sapiens
  misc_feature 1..1357: note = chr14:63511856-63513213
  misc_feature 1..1357: note = Hyper
  source 1..1357: mol_type = genomic DNA
caaaaatgtgttctgcggtgccaccagccctctcttgccccccggcatcctgggtctggagagcagcggccaggatccgcggcgggggagggggggatgcaggcaaagaaggtggaggaagaggaggaaaaggtggaagagaagattgagccgaaagaagagggggcgcggcggcggcgacggggtcccctgactgtgtctccagcccgacccggatgagcagctctggggaggaggaccaggcagttcatggtagtagcgctcccccggccgccgctgcccagactgtggcggtgccgcacacggggctcgggaactgcaggctccgcggggcacagtgcgcctgcgccgcccccgctgtcgctgtcccgccggtgctgatgctgaggctgctgctgaggctgctaccgcggcggccggcgcctgggcgcgggctctgcatctctccccctgctggggagcgcaagcgggaactcaagcccccaccctcccaatccccctcagctcagaccgagaccccttccccgcgccttcgtctcccggtctcctcgtccaccccctcgcgcagcgagctccgggctgaacagcgtagcccaacttctgggctgtgcgcctggtggttgctcctctccccggagatcgaggcaagcgatcgctgtccaatcgggccggtggaatgggagaagagggtgccagagagagcagtggccagtcggaggctcacatctcggcgtctcccgctcgggtcccgaatccgggctgctggcgcggacgcggctcccggggcggaggtgcgggcaggctccagctccagccccagccgaggctgagagcagggcagggactggctgggcggcgcgcggggacgcagagcagccacctgacgctgctaccgcccccctccgggctccggcgcctgaaaccttcctgaacactggcgctttccgcaccgcccttaccccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgccagggtggagcagggcacgaatcacctctaacaaaccccccaatttccaggcgttgagaacggacagcagcggcaccgttacaaacagtcc

SEQ ID NO: 109744 - DNA, 30 bp, Homo sapiens; identical to SEQ ID NO: 35381
  misc_feature 1..30: note = chr14:63670862-63670892
  misc_feature 1..30: note = Hyper
  source 1..30: mol_type = genomic DNA

SEQ ID NO: 109745 - DNA, 88 bp, Homo sapiens; identical to SEQ ID NO: 43993
  misc_feature 1..88: note = chr14:64022981-64023069
  misc_feature 1..88: note = Hypo
  source 1..88: mol_type = genomic DNA

SEQ ID NO: 109746 - DNA, 37 bp, Homo sapiens; identical to SEQ ID NO: 76945
  misc_feature 1..37: note = chr14:64222413-64222450
  misc_feature 1..37: note = Hypo
  source 1..37: mol_type = genomic DNA

SEQ ID NO: 109747 - DNA, 78 bp, Homo sapiens; identical to SEQ ID NO: 76946
  misc_feature 1..78: note = chr14:64760774-64760852
  misc_feature 1..78: note = Hyper
  source 1..78: mol_type = genomic DNA

SEQ ID NO: 109748 - DNA, 181 bp, Homo sapiens; identical to SEQ ID NO: 76947
  misc_feature 1..181: note = chr14:64761073-64761254
  misc_feature 1..181: note = Hyper
  source 1..181: mol_type = genomic DNA

SEQ ID NO: 109749 - DNA, 59 bp, Homo sapiens; identical to SEQ ID NO: 76948
  misc_feature 1..59: note = chr14:64932461-64932520
  misc_feature 1..59: note = Hyper
  source 1..59: mol_type = genomic DNA

SEQ ID NO: 109750 - DNA, 141 bp, Homo sapiens; identical to SEQ ID NO: 76949
  misc_feature 1..141: note = chr14:65005802-65005943
  misc_feature 1..141: note = Hypo
  source 1..141: mol_type = genomic DNA

SEQ ID NO: 109751 - DNA, 300 bp, Homo sapiens
  misc_feature 1..300: note = chr14:65007311-65007611
  misc_feature 1..300: note = Hyper
  source 1..300: mol_type = genomic DNA
aaatctgttgggtcacgggccagtcactccgacctaggcaagcctgtggtggagctggaagagtttgtgagggcggtcccgggagcggattgggtctgggagttcccagaggcggctataagaaccgggaactgggcgcggggagctgagttgctggtagtgcccgtggtgcttggttcgaggtggccgttagttgactccgcggagttcatctccctggttttcccgtcctaacgtcgctcgcctttcagtcaggatgtctgcccgtggcccggctatcggcatcgacctgggcaccac

SEQ ID NO: 109752 - DNA, 44 bp, Homo sapiens; identical to SEQ ID NO: 76952
  misc_feature 1..44: note = chr14:65008676-65008720
  misc_feature 1..44: note = Hyper
  source 1..44: mol_type = genomic DNA

SEQ ID NO: 109753 - DNA, 342 bp, Homo sapiens
  misc_feature 1..342: note = chr14:65008937-65009279
  misc_feature 1..342: note = Hyper
  source 1..342: mol_type = genomic DNA
cctgctgggcaagttcgacctgaccgggattccccctgcgcctcgcggggtcccccaaatcgaggttaccttcgacattgacgccaatggcatccttaacgttaccgccgccgacaagagcaccggtaaggaaaacaaaatcaccatcaccaatgacaaaggtcgtctgagcaaggacgacattgaccggatggtgcaggaggcggagcggtacaaatcggaagatgaggcgaatcgcgaccgagtcgcggccaaaaacgccctggagtcctatacctacaacatcaagcagacggtggaagacgagaaactgaggggcaagattagcgagcaggacaaaaa

SEQ ID NO: 109754 - DNA, 340 bp, Homo sapiens; identical to SEQ ID NO: 76955
  misc_feature 1..340: note = chr14:65016476-65016816
  misc_feature 1..340: note = Hyper
  source 1..340: mol_type = genomic DNA

SEQ ID NO: 109755 - DNA, 149 bp, Homo sapiens; identical to SEQ ID NO: 76956
  misc_feature 1..149: note = chr14:65086478-65086627
  misc_feature 1..149: note = Hypo
  source 1..149: mol_type = genomic DNA

SEQ ID NO: 109756 - DNA, 395 bp, Homo sapiens; identical to SEQ ID NO: 76957
  misc_feature 1..395: note = chr14:65170679-65171074
  misc_feature 1..395: note = Hyper
  source 1..395: mol_type = genomic DNA

SEQ ID NO: 109757 - DNA, 98 bp, Homo sapiens; identical to SEQ ID NO: 76958
  misc_feature 1..98: note = chr14:65171275-65171373
  misc_feature 1..98: note = Hyper
  source 1..98: mol_type = genomic DNA

SEQ ID NO: 109758 - DNA, 92 bp, Homo sapiens; identical to SEQ ID NO: 76959
  misc_feature 1..92: note = chr14:65171678-65171770
  misc_feature 1..92: note = Hyper
  source 1..92: mol_type = genomic DNA

SEQ ID NO: 109759 - DNA, 161 bp, Homo sapiens; identical to SEQ ID NO: 43995
  misc_feature 1..161: note = chr14:65233318-65233479
  misc_feature 1..161: note = Hypo
  source 1..161: mol_type = genomic DNA

SEQ ID NO: 109760 - DNA, 30 bp, Homo sapiens; identical to SEQ ID NO: 76961
  misc_feature 1..30: note = chr14:65236314-65236344
  misc_feature 1..30: note = Hypo
  source 1..30: mol_type = genomic DNA

SEQ ID NO: 109761 - DNA, 532 bp, Homo sapiens; identical to SEQ ID NO: 76962
  misc_feature 1..532: note = chr14:65239262-65239794
  misc_feature 1..532: note = Hypo
  source 1..532: mol_type = genomic DNA

SEQ ID NO: 109762 - DNA, 63 bp, Homo sapiens; identical to SEQ ID NO: 43997
  misc_feature 1..63: note = chr14:65273132-65273195
  misc_feature 1..63: note = Hypo
  source 1..63: mol_type = genomic DNA

SEQ ID NO: 109763 - DNA, 30 bp, Homo sapiens; identical to SEQ ID NO: 76964
  misc_feature 1..30: note = chr14:65282538-65282568
  misc_feature 1..30: note = Hypo
  source 1..30: mol_type = genomic DNA

SEQ ID NO: 109764 - DNA, 30 bp, Homo sapiens; identical to SEQ ID NO: 76965
  misc_feature 1..30: note = chr14:65310281-65310311
  misc_feature 1..30: note = Hypo
  source 1..30: mol_type = genomic DNA

SEQ ID NO: 109765 - DNA, 78 bp, Homo sapiens; identical to SEQ ID NO: 76966
  misc_feature 1..78: note = chr14:65345911-65345989
  misc_feature 1..78: note = Hyper
  source 1..78: mol_type = genomic DNA

SEQ ID NO: 109766 - DNA, 57 bp, Homo sapiens; identical to SEQ ID NO: 76967
  misc_feature 1..57: note = chr14:65346254-65346311
  misc_feature 1..57: note = Hyper
  source 1..57: mol_type = genomic DNA

SEQ ID NO: 109767 - DNA, 179 bp, Homo sapiens; identical to SEQ ID NO: 76968
  misc_feature 1..179: note = chr14:65406280-65406459
  misc_feature 1..179: note = Hypo
  source 1..179: mol_type = genomic DNA

SEQ ID NO: 109768 - DNA, 30 bp, Homo sapiens; identical to SEQ ID NO: 76969
  misc_feature 1..30: note = chr14:65493283-65493313
  misc_feature 1..30: note = Hypo
  source 1..30: mol_type = genomic DNA

SEQ ID NO: 109769 - DNA, 155 bp, Homo sapiens; identical to SEQ ID NO: 76970
  misc_feature 1..155: note = chr14:65604586-65604741
  misc_feature 1..155: note = Hypo
  source 1..155: mol_type = genomic DNA

SEQ ID NO: 109770 - DNA, 29 bp, Homo sapiens
  misc_feature 1..29: note = chr14:65619090-65619119
  misc_feature 1..29: note = Hypo
  source 1..29: mol_type = genomic DNA
ttcaagggccgggcgcggtggctcacgcc

SEQ ID NO: 109771 - DNA, 89 bp, Homo sapiens; identical to SEQ ID NO: 76972
  misc_feature 1..89: note = chr14:65694375-65694464
  misc_feature 1..89: note = Hypo
  source 1..89: mol_type = genomic DNA

SEQ ID NO: 109772 - DNA, 33 bp, Homo sapiens; identical to SEQ ID NO: 76973
  misc_feature 1..33: note = chr14:66499270-66499303
  misc_feature 1..33: note = Hypo
  source 1..33: mol_type = genomic DNA

SEQ ID NO: 109773 - DNA, 93 bp, Homo sapiens; identical to SEQ ID NO: 76974
  misc_feature 1..93: note = chr14:66560626-66560719
  misc_feature 1..93: note = Hypo
  source 1..93: mol_type = genomic DNA

SEQ ID NO: 109774 - DNA, 201 bp, Homo sapiens; identical to SEQ ID NO: 76975
  misc_feature 1..201: note = chr14:66792112-66792313
  misc_feature 1..201: note = Hypo
  source 1..201: mol_type = genomic DNA

SEQ ID NO: 109775 - DNA, 181 bp, Homo sapiens; identical to SEQ ID NO: 44002
  misc_feature 1..181: note = chr14:67688245-67688426
  misc_feature 1..181: note = Hypo
  source 1..181: mol_type = genomic DNA

SEQ ID NO: 109776 - DNA, 40 bp, Homo sapiens; identical to SEQ ID NO: 76977
  misc_feature 1..40: note = chr14:67876449-67876489
  misc_feature 1..40: note = Hypo
  source 1..40: mol_type = genomic DNA

SEQ ID NO: 109777 - DNA, 216 bp, Homo sapiens; identical to SEQ ID NO: 76978
  misc_feature 1..216: note = chr14:67878803-67879019
  misc_feature 1..216: note = Hyper
  source 1..216: mol_type = genomic DNA

SEQ ID NO: 109778 - DNA, 30 bp, Homo sapiens; identical to SEQ ID NO: 44003
  misc_feature 1..30: note = chr14:67879219-67879249
  misc_feature 1..30: note = Hypo
  source 1..30: mol_type = genomic DNA

SEQ ID NO: 109779 - DNA, 143 bp, Homo sapiens; identical to SEQ ID NO: 76980
  misc_feature 1..143: note = chr14:67886180-67886323
  misc_feature 1..143: note = Hypo
  source 1..143: mol_type = genomic DNA

SEQ ID NO: 109780 - DNA, 82 bp, Homo sapiens; identical to SEQ ID NO: 76981
  misc_feature 1..82: note = chr14:67886563-67886645
  misc_feature 1..82: note = Hypo
  source 1..82: mol_type = genomic DNA

SEQ ID NO: 109781 - DNA, 206 bp, Homo sapiens; identical to SEQ ID NO: 76982
  misc_feature 1..206: note = chr14:67893599-67893805
  misc_feature 1..206: note = Hypo
  source 1..206: mol_type = genomic DNA

SEQ ID NO: 109782 - DNA, 30 bp, Homo sapiens; identical to SEQ ID NO: 76983
  misc_feature 1..30: note = chr14:67906990-67907020
  misc_feature 1..30: note = Hypo
  source 1..30: mol_type = genomic DNA

SEQ ID NO: 109783 - DNA, 256 bp, Homo sapiens; identical to SEQ ID NO: 76984
  misc_feature 1..256: note = chr14:68067573-68067829
  misc_feature 1..256: note = Hypo
  source 1..256: mol_type = genomic DNA

SEQ ID NO: 109784 - DNA, 30 bp, Homo sapiens; identical to SEQ ID NO: 76985
  misc_feature 1..30: note = chr14:68142255-68142285
  misc_feature 1..30: note = Hypo
  source 1..30: mol_type = genomic DNA

SEQ ID NO: 109785 - DNA, 86 bp, Homo sapiens; identical to SEQ ID NO: 76986
  misc_feature 1..86: note = chr14:68187960-68188046
  misc_feature 1..86: note = Hypo
  source 1..86: mol_type = genomic DNA

SEQ ID NO: 109786 - DNA, 30 bp, Homo sapiens; identical to SEQ ID NO: 44006
  misc_feature 1..30: note = chr14:68231335-68231365
  misc_feature 1..30: note = Hypo
  source 1..30: mol_type = genomic DNA

SEQ ID NO: 109787 - DNA, 36 bp, Homo sapiens; identical to SEQ ID NO: 44007
  misc_feature 1..36: note = chr14:68284131-68284167
  misc_feature 1..36: note = Hypo
  source 1..36: mol_type = genomic DNA

SEQ ID NO: 109788 - DNA, 200 bp, Homo sapiens; identical to SEQ ID NO: 76989
  misc_feature 1..200: note = chr14:68841379-68841579
  misc_feature 1..200: note = Hypo
  source 1..200: mol_type = genomic DNA

SEQ ID NO: 109789 - DNA, 61 bp, Homo sapiens; identical to SEQ ID NO: 76990
  misc_feature 1..61: note = chr14:69014044-69014105
  misc_feature 1..61: note = Hypo
  source 1..61: mol_type = genomic DNA

SEQ ID NO: 109790 - DNA, 198 bp, Homo sapiens; identical to SEQ ID NO: 76991
  misc_feature 1..198: note = chr14:69143363-69143561
  misc_feature 1..198: note = Hypo
  source 1..198: mol_type = genomic DNA

SEQ ID NO: 109791 - DNA, 40 bp, Homo sapiens; identical to SEQ ID NO: 76992
  misc_feature 1..40: note = chr14:69245934-69245974
  misc_feature 1..40: note = Hypo
  source 1..40: mol_type = genomic DNA

SEQ ID NO: 109792 - DNA, 30 bp, Homo sapiens; identical to SEQ ID NO: 76993
  misc_feature 1..30: note = chr14:69657584-69657614
  misc_feature 1..30: note = Hypo
  source 1..30: mol_type = genomic DNA

SEQ ID NO: 109793 - DNA, 1557 bp, Homo sapiens; identical to SEQ ID NO: 76994
  misc_feature 1..1557: note = chr14:69726355-69727912
  misc_feature 1..1557: note = Hyper
  source 1..1557: mol_type = genomic DNA

SEQ ID NO: 109794 - DNA, 32 bp, Homo sapiens; identical to SEQ ID NO: 76995
  misc_feature 1..32: note = chr14:69728306-69728338
  misc_feature 1..32: note = Hyper
  source 1..32: mol_type = genomic DNA

SEQ ID NO: 109795 - DNA, 174 bp, Homo sapiens; identical to SEQ ID NO: 76996
  misc_feature 1..174: note = chr14:69867022-69867196
  misc_feature 1..174: note = Hypo
  source 1..174: mol_type = genomic DNA

SEQ ID NO: 109796 - DNA, 30 bp, Homo sapiens; identical to SEQ ID NO: 76997
  misc_feature 1..30: note = chr14:69867731-69867761
  misc_feature 1..30: note = Hypo
  source 1..30: mol_type = genomic DNA

SEQ ID NO: 109797 - DNA, 58 bp, Homo sapiens; identical to SEQ ID NO: 35395
  misc_feature 1..58: note = chr14:69950779-69950837
  misc_feature 1..58: note = Hyper
  source 1..58: mol_type = genomic DNA

SEQ ID NO: 109798 - DNA, 228 bp, Homo sapiens; identical to SEQ ID NO: 76999
  misc_feature 1..228: note = chr14:69951108-69951336
  misc_feature 1..228: note = Hyper
  source 1..228: mol_type = genomic DNA

SEQ ID NO: 109799 - DNA, 372 bp, Homo sapiens; identical to SEQ ID NO: 77000
  misc_feature 1..372: note = chr14:70014616-70014988
  misc_feature 1..372: note = Hyper
  source 1..372: mol_type = genomic DNA

SEQ ID NO: 109800 - DNA, 569 bp, Homo sapiens
  misc_feature 1..569: note = chr14:70038456-70039025
  misc_feature 1..569: note = Hyper
  source 1..569: mol_type = genomic DNA
ttggcgcgctgggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccg

SEQ ID NO: 109801 - DNA, 30 bp, Homo sapiens; identical to SEQ ID NO: 77001
  misc_feature 1..30: note = chr14:70236264-70236294
  misc_feature 1..30: note = Hypo
  source 1..30: mol_type = genomic DNA

SEQ ID NO: 109802 - DNA, 602 bp, Homo sapiens; identical to SEQ ID NO: 77002
  misc_feature 1..602: note = chr14:70345928-70346530
  misc_feature 1..602: note = Hyper
  source 1..602: mol_type = genomic DNA

SEQ ID NO: 109803 - DNA, 86 bp, Homo sapiens; identical to SEQ ID NO: 77003
  misc_feature 1..86: note = chr14:70346797-70346883
  misc_feature 1..86: note = Hyper
  source 1..86: mol_type = genomic DNA

SEQ ID NO: 109804 - DNA, 624 bp, Homo sapiens
  misc_feature 1..624: note = chr14:70653682-70654306
  misc_feature 1..624: note = Hyper
  source 1..624: mol_type = genomic DNA
ggaagattaatcacacgccgctgcaagtcaccgggtcgccaggggccgaggaggcttcccttttggtgccccaccggaaggccggatgtgttcctatcacgtacccacattccacccccgctcaactccctcctccccccacccccttcgggtgtttcttgaccacccaggagcttggctgcgcctgctgcagtctgcgtttctgataaattgaaaccagttttaattcttctgcccgggagacctaaccgccgaatgcgttcggaggtatgttttttaatcgccaggaaagggggagagagagagaaagagagagagagagagagaggaaaggaggagagaagagaagagaagcggggggcggggggagagagagagagagagagaaggaagctgcgatgagcgggtaaatttatggtactgcattaaaggcatttcttctatttaaccccaccccgccaccaccaccactaccacaccgttaaaaataaaatacaatgaattaagacgaagaactgcttttttccccggagcaaattgctttcatcatctttcccagtggctcgggtcctctgggcaggtcagccagggcctgtaggagcagcagcgctagcctctgaatca

SEQ ID NO: 109805 - DNA, 1764 bp, Homo sapiens
  misc_feature 1..1764: note = chr14:70654366-70656130
  misc_feature 1..1764: note = Hyper
  source 1..1764: mol_type = genomic DNA
cgtgtgtgttgggggatcgggggagggttagttatatatttcgattctctccaccgagtcccggatcacgcagaccaccaggggctggagagtgcagcactggagaaaccctccttctccctcgcccccttggccccagcggtgggtgctctggggctgcagctcccgacccgcggcggtggagtcccgagattggggtgagcgcgtgcgtgcgtatgtgcacgcgggcgcgcgccgagtggataacgcgcttccctgctagcccccaaacccggcggacactcacagcaccagaagcacaacacgccctggcccaggtggcacacatatgccgacatgcatccagcacacacaacacagcagtcagtctccccaaacagcacccgctaccaacccagcatgctcacgatccaactgtacccacctgcccaggcatctctctctgcccctccccacccggcggcaccctcctgtagacacccactctgccagatctgcccccccaacactgcatacacaatgtacactttccggggcaccctcaccccacttctcctggcactaaatccacaggaaggcggttcatatgaatgatcttgagaaataacttaaccccgttactcacaatcagggatcctcttaggggcatcccaagccccccaacctctacctcccatgtctcggctgcccgctaagggggaagggcaggaggctcaccccattactcaccgtttcctctcggcctcccgagcggagtgggcaagggaggggggtgaggaaggtacgcgatgcccccgccgcccggcgcctcaccggtcgcagcggctcatcgcccccgcgggctgcccgccggccgcagccgcgtccggggcatgtcagtccgccgccgccgccctcccgccggggttcgtgggctcgcagctgtcagggagctgcggggcagcgcatctggagcgcggggtctgggagggagggtgtctggggccagggcgaggggccccgggaggggtccttccgcacggatttcagaaagagggaaaccccgacccagagcggtgactggaatctacgcccgggagaggcccggagtcccggccgcgggcggcgggggattcctgcaggaaggggcaggaaggcaagcagcccggcgcgccctggcggctccgagggacctgggctcgggcttgcggtcgcgtcgcctgggctttccctgggctgggagcgcgccgggtctccgccttgcacgctgtcaccgcgggagacgtctcggcctcgccgcgcgcagaggggacgcgcggagaggctggtttctgggcgagcggagagctttgcccattaagctgccggaagaagccaaatcaaaaagccaatctccaagcctccaaacggaacgtcaccctatcagctgggagacagcgccgcactgactgacaagccgcgcatatttatcctcgcgcgcggaggggagactctcagaacgctcctcgaccagcagcgaggaagtcgagcccgcatcccgcatcccgcatcccgcatccagagcccccgagggacgaattcagatccaacccctgccccgcggccacccaccctagtcgttggagcctggcgcccgcgcctcccggccggcagcacgtcaaaacggcggcgcgtcctgacctggattccgccgagttgggagctccaggcagcaggcgggcgcgcggcaccggctttccccttgtcctcaggagacgctgcctgcaattccgaaattaagtctcc

SEQ ID NO: 109806 - DNA, 349 bp, Homo sapiens; identical to SEQ ID NO: 77010
  misc_feature 1..349: note = chr14:70701157-70701506
  misc_feature 1..349: note = Hypo
  source 1..349: mol_type = genomic DNA

SEQ ID NO: 109807 - DNA, 18 bp, Homo sapiens
  misc_feature 1..18: note = chr14:70725489-70725507
  misc_feature 1..18: note = Hypo
  source 1..18: mol_type = genomic DNA
agcactttgggaggccga

SEQ ID NO: 109808 - DNA, 17 bp, Homo sapiens
  misc_feature 1..17: note = chr14:70725747-70725764
  misc_feature 1..17: note = Hypo
  source 1..17: mol_type = genomic DNA
aacgaaaaagaagccac

SEQ ID NO: 109809 - DNA, 30 bp, Homo sapiens; identical to SEQ ID NO: 77013
  misc_feature 1..30: note = chr14:70904873-70904903
  misc_feature 1..30: note = Hypo
  source 1..30: mol_type = genomic DNA

SEQ ID NO: 109810 - DNA, 138 bp, Homo sapiens; identical to SEQ ID NO: 77014
  misc_feature 1..138: note = chr14:71659705-71659843
  misc_feature 1..138: note = Hypo
  source 1..138: mol_type = genomic DNA

SEQ ID NO: 109811 - DNA, 30 bp, Homo sapiens; identical to SEQ ID NO: 77015
  misc_feature 1..30: note = chr14:72286297-72286327
  misc_feature 1..30: note = Hypo
  source 1..30: mol_type = genomic DNA

SEQ ID NO: 109812 - DNA, 888 bp, Homo sapiens
  misc_feature 1..888: note = chr14:72398598-72399486
  misc_feature 1..888: note = Hyper
  source 1..888: mol_type = genomic DNA
atattccaaatgcagcgtgtggtgtgcatgttgaatacataaaaatgacgaggttaggaacaatatcgctgacggtcgcggtgtcccgttttaatttagagggcgccagcaacacgtcagtgagggagattcagaagccgccgggcacctcaccccgggccgggaatccctaagagaaccttgacgccgctgaagtttccggaccgggccagtttggaattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcg

SEQ ID NO: 109813 - DNA, 459 bp, Homo sapiens; identical to SEQ ID NO: 35410
  misc_feature 1..459: note = chr14:72399780-72400239
  misc_feature 1..459: note = Hyper
  source 1..459: mol_type = genomic DNA

SEQ ID NO: 109814 - DNA, 195 bp, Homo sapiens; identical to SEQ ID NO: 77019
  misc_feature 1..195: note = chr14:72720654-72720849
  misc_feature 1..195: note = Hypo
  source 1..195: mol_type = genomic DNA

SEQ ID NO: 109815 - DNA, 30 bp, Homo sapiens; identical to SEQ ID NO: 15833
  misc_feature 1..30: note = chr14:72892242-72892272
  misc_feature 1..30: note = Hypo
  source 1..30: mol_type = genomic DNA

SEQ ID NO: 109816 - DNA, 30 bp, Homo sapiens; identical to SEQ ID NO: 44013
  misc_feature 1..30: note = chr14:72976891-72976921
  misc_feature 1..30: note = Hypo
  source 1..30: mol_type = genomic DNA

SEQ ID NO: 109817 - DNA, 202 bp, Homo sapiens; identical to SEQ ID NO: 77022
  misc_feature 1..202: note = chr14:73029646-73029848
  misc_feature 1..202: note = Hypo
  source 1..202: mol_type = genomic DNA

SEQ ID NO: 109818 - DNA, 30 bp, Homo sapiens; identical to SEQ ID NO: 77023
  misc_feature 1..30: note = chr14:73138163-73138193
  misc_feature 1..30: note = Hypo
  source 1..30: mol_type = genomic DNA

SEQ ID NO: 109819 - DNA, 30 bp, Homo sapiens; identical to SEQ ID NO: 77024
  misc_feature 1..30: note = chr14:73140382-73140412
  misc_feature 1..30: note = Hypo
  source 1..30: mol_type = genomic DNA

SEQ ID NO: 109820 - DNA, 250 bp, Homo sapiens; identical to SEQ ID NO: 44015
  misc_feature 1..250: note = chr14:73140612-73140862
  misc_feature 1..250: note = Hypo
  source 1..250: mol_type = genomic DNA

SEQ ID NO: 109821 - DNA, 151 bp, Homo sapiens; identical to SEQ ID NO: 77026
  misc_feature 1..151: note = chr14:73146774-73146925
  misc_feature 1..151: note = Hypo
  source 1..151: mol_type = genomic DNA

SEQ ID NO: 109822 - DNA, 319 bp, Homo sapiens; identical to SEQ ID NO: 77027
  misc_feature 1..319: note = chr14:73147249-73147568
  misc_feature 1..319: note = Hypo
  source 1..319: mol_type = genomic DNA

SEQ ID NO: 109823 - DNA, 175 bp, Homo sapiens; identical to SEQ ID NO: 77028
  misc_feature 1..175: note = chr14:73149208-73149383
  misc_feature 1..175: note = Hypo
  source 1..175: mol_type = genomic DNA

SEQ ID NO: 109824 - DNA, 30 bp, Homo sapiens; identical to SEQ ID NO: 44018
  misc_feature 1..30: note = chr14:73150302-73150332
  misc_feature 1..30: note = Hypo
  source 1..30: mol_type = genomic DNA

SEQ ID NO: 109825 - DNA, 37 bp, Homo sapiens; identical to SEQ ID NO: 44019
  misc_feature 1..37: note = chr14:73157349-73157386
  misc_feature 1..37: note = Hypo
  source 1..37: mol_type = genomic DNA

SEQ ID NO: 109826 - DNA, 149 bp, Homo sapiens; identical to SEQ ID NO: 5153
  misc_feature 1..149: note = chr14:73167750-73167899
  misc_feature 1..149: note = Hypo
  source 1..149: mol_type = genomic DNA

SEQ ID NO: 109827 - DNA, 143 bp, Homo sapiens; identical to SEQ ID NO: 77032
  misc_feature 1..143: note = chr14:73168818-73168961
  misc_feature 1..143: note = Hypo
  source 1..143: mol_type = genomic DNA

SEQ ID NO: 109828 - DNA, 151 bp, Homo sapiens; identical to SEQ ID NO: 44021
  misc_feature 1..151: note = chr14:73172944-73173095
  misc_feature 1..151: note = Hypo
  source 1..151: mol_type = genomic DNA

SEQ ID NO: 109829 - DNA, 255 bp, Homo sapiens; identical to SEQ ID NO: 77034
  misc_feature 1..255: note = chr14:73174955-73175210
  misc_feature 1..255: note = Hypo
  source 1..255: mol_type = genomic DNA

SEQ ID NO: 109830 - DNA, 30 bp, Homo sapiens; identical to SEQ ID NO: 44023
  misc_feature 1..30: note = chr14:73176464-73176494
  misc_feature 1..30: note = Hypo
  source 1..30: mol_type = genomic DNA

SEQ ID NO: 109831 - DNA, 67 bp, Homo sapiens; identical to SEQ ID NO: 77036
  misc_feature 1..67: note = chr14:73178102-73178169
  misc_feature 1..67: note = Hypo
  source 1..67: mol_type = genomic DNA

SEQ ID NO: 109832 - DNA, 202 bp, Homo sapiens; identical to SEQ ID NO: 77037
  misc_feature 1..202: note = chr14:73178763-73178965
  misc_feature 1..202: note = Hypo
  source 1..202: mol_type = genomic DNA

SEQ ID NO: 109833 - DNA, 146 bp, Homo sapiens; identical to SEQ ID NO: 44026
  misc_feature 1..146: note = chr14:73180113-73180259
  misc_feature 1..146: note = Hypo
  source 1..146: mol_type = genomic DNA

SEQ ID NO: 109834 - DNA, 80 bp, Homo sapiens; identical to SEQ ID NO: 77039
  misc_feature 1..80: note = chr14:73185163-73185243
  misc_feature 1..80: note = Hypo
  source 1..80: mol_type = genomic DNA

SEQ ID NO: 109835 - DNA, 38 bp, Homo sapiens; identical to SEQ ID NO: 77040
  misc_feature 1..38: note = chr14:73185482-73185520
  misc_feature 1..38: note = Hypo
  source 1..38: mol_type = genomic DNA

SEQ ID NO: 109836 - DNA, 30 bp, Homo sapiens; identical to SEQ ID NO: 77041
  misc_feature 1..30: note = chr14:73189045-73189075
  misc_feature 1..30: note = Hypo
  source 1..30: mol_type = genomic DNA

SEQ ID NO: 109837 - DNA, 146 bp, Homo sapiens; identical to SEQ ID NO: 44028
  misc_feature 1..146: note = chr14:73194579-73194725
  misc_feature 1..146: note = Hypo
  source 1..146: mol_type = genomic DNA

SEQ ID NO: 109838 - DNA, 513 bp, Homo sapiens; identical to SEQ ID NO: 77043
  misc_feature 1..513: note = chr14:73195193-73195706
  misc_feature 1..513: note = Hypo
  source 1..513: mol_type = genomic DNA

SEQ ID NO: 109839 - DNA, 30 bp, Homo sapiens; identical to SEQ ID NO: 44031
  misc_feature 1..30: note = chr14:73196936-73196966
  misc_feature 1..30: note = Hypo
  source 1..30: mol_type = genomic DNA

SEQ ID NO: 109840 - DNA, 30 bp, Homo sapiens; identical to SEQ ID NO: 44032
  misc_feature 1..30: note = chr14:73197190-73197220
  misc_feature 1..30: note = Hypo
  source 1..30: mol_type = genomic DNA

SEQ ID NO: 109841 - DNA, 103 bp, Homo sapiens; identical to SEQ ID NO: 77046
  misc_feature 1..103: note = chr14:73197913-73198016
  misc_feature 1..103: note = Hypo
  source 1..103: mol_type = genomic DNA

SEQ ID NO: 109842 - DNA, 52 bp, Homo sapiens; identical to SEQ ID NO: 77047
  misc_feature 1..52: note = chr14:73198555-73198607
  misc_feature 1..52: note = Hypo
  source 1..52: mol_type = genomic DNA

SEQ ID NO: 109843 - DNA, 30 bp, Homo sapiens; identical to SEQ ID NO: 77048
  misc_feature 1..30: note = chr14:73199030-73199060
  misc_feature 1..30: note = Hypo
  source 1..30: mol_type = genomic DNA

SEQ ID NO: 109844 - DNA, 243 bp, Homo sapiens; identical to SEQ ID NO: 77049
  misc_feature 1..243: note = chr14:73202777-73203020
  misc_feature 1..243: note = Hypo
  source 1..243: mol_type = genomic DNA

SEQ ID NO: 109845 - DNA, 30 bp, Homo sapiens; identical to SEQ ID NO: 77050
  misc_feature 1..30: note = chr14:73207724-73207754
  misc_feature 1..30: note = Hypo
  source 1..30: mol_type = genomic DNA

SEQ ID NO: 109846 - DNA, 30 bp, Homo sapiens; identical to SEQ ID NO: 77051
  misc_feature 1..30: note = chr14:73207963-73207993
  misc_feature 1..30: note = Hypo
  source 1..30: mol_type = genomic DNA

SEQ ID NO: 109847 - DNA, 470 bp, Homo sapiens; identical to SEQ ID NO: 77052
  misc_feature 1..470: note = chr14:73209578-73210048
  misc_feature 1..470: note = Hypo
  source 1..470: mol_type = genomic DNA

SEQ ID NO: 109848 - DNA, 76 bp, Homo sapiens; identical to SEQ ID NO: 77053
  misc_feature 1..76: note = chr14:73226814-73226890
  misc_feature 1..76: note = Hypo
  source 1..76: mol_type = genomic DNA

SEQ ID NO: 109849 - DNA, 28 bp, Homo sapiens
  misc_feature 1..28: note = chr14:73231480-73231508
  misc_feature 1..28: note = Hypo
  source 1..28: mol_type = genomic DNA
gagccaccgcgcccggcctgttttcctg

SEQ ID NO: 109850 - DNA, 32 bp, Homo sapiens; identical to SEQ ID NO: 77055
  misc_feature 1..32: note = chr14:73232361-73232393
  misc_feature 1..32: note = Hypo
  source 1..32: mol_type = genomic DNA

SEQ ID NO: 109851 - DNA, 182 bp, Homo sapiens; identical to SEQ ID NO: 77056
  misc_feature 1..182: note = chr14:73263871-73264053
  misc_feature 1..182: note = Hypo
  source 1..182: mol_type = genomic DNA

SEQ ID NO: 109852 - DNA, 144 bp, Homo sapiens; identical to SEQ ID NO: 77057
  misc_feature 1..144: note = chr14:73273275-73273419
  misc_feature 1..144: note = Hypo
  source 1..144: mol_type = genomic DNA

SEQ ID NO: 109853 - DNA, 30 bp, Homo sapiens; identical to SEQ ID NO: 15844
  misc_feature 1..30: note = chr14:73275087-73275117
  misc_feature 1..30: note = Hypo
  source 1..30: mol_type = genomic DNA

SEQ ID NO: 109854 - DNA, 30 bp, Homo sapiens; identical to SEQ ID NO: 77059
  misc_feature 1..30: note = chr14:73280813-73280843
  misc_feature 1..30: note = Hypo
  source 1..30: mol_type = genomic DNA

SEQ ID NO: 109855 - DNA, 260 bp, Homo sapiens; identical to SEQ ID NO: 77060
  misc_feature 1..260: note = chr14:73299836-73300096
  misc_feature 1..260: note = Hypo
  source 1..260: mol_type = genomic DNA

SEQ ID NO: 109856 - DNA, 412 bp, Homo sapiens; identical to SEQ ID NO: 77061
  misc_feature 1..412: note = chr14:73302316-73302728
  misc_feature 1..412: note = Hypo
  source 1..412: mol_type = genomic DNA

SEQ ID NO: 109857 - DNA, 19 bp, Homo sapiens
  misc_feature 1..19: note = chr14:73305454-73305473
  misc_feature 1..19: note = Hypo
  source 1..19: mol_type = genomic DNA
actccgtctcaaaaaaaaa

SEQ ID NO: 109858 - DNA, 30 bp, Homo sapiens; identical to SEQ ID NO: 77063
  misc_feature 1..30: note = chr14:73306326-73306356
  misc_feature 1..30: note = Hypo
  source 1..30: mol_type = genomic DNA

SEQ ID NO: 109859 - DNA, 50 bp, Homo sapiens; identical to SEQ ID NO: 77064
  misc_feature 1..50: note = chr14:73309119-73309169
  misc_feature 1..50: note = Hypo
  source 1..50: mol_type = genomic DNA

SEQ ID NO: 109860 - DNA, 48 bp, Homo sapiens; identical to SEQ ID NO: 77065
  misc_feature 1..48: note = chr14:73313912-73313960
  misc_feature 1..48: note = Hypo
  source 1..48: mol_type = genomic DNA

SEQ ID NO: 109861 - DNA, 590 bp, Homo sapiens; identical to SEQ ID NO: 77066
  misc_feature 1..590: note = chr14:73318385-73318975
  misc_feature 1..590: note = Hypo
  source 1..590: mol_type = genomic DNA

SEQ ID NO: 109862 - DNA, 30 bp, Homo sapiens; identical to SEQ ID NO: 44043
  misc_feature 1..30: note = chr14:73331141-73331171
  misc_feature 1..30: note = Hypo
  source 1..30: mol_type = genomic DNA

SEQ ID NO: 109863 - DNA, 30 bp, Homo sapiens; identical to SEQ ID NO: 77068
  misc_feature 1..30: note = chr14:73332342-73332372
  misc_feature 1..30: note = Hypo
  source 1..30: mol_type = genomic DNA

SEQ ID NO: 109864 - DNA, 256 bp, Homo sapiens; identical to SEQ ID NO: 77069
  misc_feature 1..256: note = chr14:73333000-73333256
  misc_feature 1..256: note = Hypo
  source 1..256: mol_type = genomic DNA

SEQ ID NO: 109865 - DNA, 75 bp, Homo sapiens; identical to SEQ ID NO: 77070
  misc_feature 1..75: note = chr14:73333616-73333691
  misc_feature 1..75: note = Hypo
  source 1..75: mol_type = genomic DNA

SEQ ID NO: 109866 - DNA, 36 bp, Homo sapiens; identical to SEQ ID NO: 77071
  misc_feature 1..36: note = chr14:73349481-73349517
  misc_feature 1..36: note = Hypo
  source 1..36: mol_type = genomic DNA

SEQ ID NO: 109867 - DNA, 42 bp, Homo sapiens; identical to SEQ ID NO: 77072
  misc_feature 1..42: note = chr14:73352048-73352090
  misc_feature 1..42: note = Hypo
  source 1..42: mol_type = genomic DNA

SEQ ID NO: 109868 - DNA, 38 bp, Homo sapiens; identical to SEQ ID NO: 77073
  misc_feature 1..38: note = chr14:73352791-73352829
  misc_feature 1..38: note = Hypo
  source 1..38: mol_type = genomic DNA

SEQ ID NO: 109869 - DNA, 76 bp, Homo sapiens; identical to SEQ ID NO: 35411
  misc_feature 1..76: note = chr14:73358964-73359040
  misc_feature 1..76: note = Hyper
  source 1..76: mol_type = genomic DNA

SEQ ID NO: 109870 - DNA, 196 bp, Homo sapiens; identical to SEQ ID NO: 77075
  misc_feature 1..196: note = chr14:73359294-73359490
  misc_feature 1..196: note = Hyper
  source 1..196: mol_type = genomic DNA

SEQ ID NO: 109871 - DNA, 30 bp, Homo sapiens; identical to SEQ ID NO: 77076
  misc_feature 1..30: note = chr14:73392384-73392414
  misc_feature 1..30: note = Hypo
  source 1..30: mol_type = genomic DNA

SEQ ID NO: 109872 - DNA, 23 bp, Homo sapiens
  misc_feature 1..23: note = chr14:73472913-73472936
  misc_feature 1..23: note = Hypo
  source 1..23: mol_type = genomic DNA
accgcgcccggccaaaacacatt

SEQ ID NO: 109873 - DNA, 30 bp, Homo sapiens; identical to SEQ ID NO: 77078
  misc_feature 1..30: note = chr14:73591774-73591804
  misc_feature 1..30: note = Hypo
  source 1..30: mol_type = genomic DNA

SEQ ID NO: 109874 - DNA, 157 bp, Homo sapiens; identical to SEQ ID NO: 77079
  misc_feature 1..157: note = chr14:73602342-73602499
  misc_feature 1..157: note = Hypo
  source 1..157: mol_type = genomic DNA

SEQ ID NO: 109875 - DNA, 30 bp, Homo sapiens; identical to SEQ ID NO: 44046
  misc_feature 1..30: note = chr14:73691528-73691558
  misc_feature 1..30: note = Hypo
  source 1..30: mol_type = genomic DNA

SEQ ID NO: 109876 - DNA, 30 bp, Homo sapiens; identical to SEQ ID NO: 77081
  misc_feature 1..30: note = chr14:73704186-73704216
  misc_feature 1..30: note = Hyper
  source 1..30: mol_type = genomic DNA

SEQ ID NO: 109877 - DNA, 49 bp, Homo sapiens; identical to SEQ ID NO: 77082
  misc_feature 1..49: note = chr14:73704924-73704973
  misc_feature 1..49: note = Hyper
  source 1..49: mol_type = genomic DNA

SEQ ID NO: 109878 - DNA, 30 bp, Homo sapiens; identical to SEQ ID NO: 15848
  misc_feature 1..30: note = chr14:73958845-73958875
  misc_feature 1..30: note = Hypo
  source 1..30: mol_type = genomic DNA

SEQ ID NO: 109879 - DNA, 109 bp, Homo sapiens; identical to SEQ ID NO: 44048
  misc_feature 1..109: note = chr14:73959120-73959229
  misc_feature 1..109: note = Hypo
  source 1..109: mol_type = genomic DNA

SEQ ID NO: 109880 - DNA, 46 bp, Homo sapiens; identical to SEQ ID NO: 77085
  misc_feature 1..46: note = chr14:74058905-74058951
  misc_feature 1..46: note = Hyper
  source 1..46: mol_type = genomic DNA

SEQ ID NO: 109881 - DNA, 196 bp, Homo sapiens; identical to SEQ ID NO: 77086
  misc_feature 1..196: note = chr14:74079595-74079791
  misc_feature 1..196: note = Hyper
  source 1..196: mol_type = genomic DNA

SEQ ID NO: 109882 - DNA, 110 bp, Homo sapiens; identical to SEQ ID NO: 77087
  misc_feature 1..110: note = chr14:74208209-74208319
  misc_feature 1..110: note = Hyper
  source 1..110: mol_type = genomic DNA

SEQ ID NO: 109883 - DNA, 66 bp, Homo sapiens; identical to SEQ ID NO: 77088
  misc_feature 1..66: note = chr14:74252666-74252732
  misc_feature 1..66: note = Hyper
  source 1..66: mol_type = genomic DNA

SEQ ID NO: 109884 - DNA, 241 bp, Homo sapiens; identical to SEQ ID NO: 77089
  misc_feature 1..241: note = chr14:74254402-74254643
  misc_feature 1..241: note = Hyper
  source 1..241: mol_type = genomic DNA

SEQ ID NO: 109885 - DNA, 30 bp, Homo sapiens; identical to SEQ ID NO: 77090
  misc_feature 1..30: note = chr14:74273409-74273439
  misc_feature 1..30: note = Hypo
  source 1..30: mol_type = genomic DNA

SEQ ID NO: 109886 - DNA, 20 bp, Homo sapiens
  misc_feature 1..20: note = chr14:74529016-74529036
  misc_feature 1..20: note = Hypo
  source 1..20: mol_type = genomic DNA
tgactaggccgggtgcggtg

SEQ ID NO: 109887 - DNA, 2518 bp, Homo sapiens
  misc_feature 1..2518: note = chr14:74706015-74708533
  misc_feature 1..2518: note = Hyper
  source 1..2518: mol_type = genomic DNA
cgacattgcctgcggcgggagctgccagctttttggaattcctaatcgctcctggccccggtgattggctgctcagctctgaccccacttgggctgccgcctggttggataaaaggggaatctccttgggctccagagcattagacaccggagggggcacctgggaccaacttcgcgaagcgggaagcccggcgggggggtggggggagctaaagacctgcggcctcagcccctccaaagaacagggagatgacggggaaagcaggggaagcgctgagcaagcccaaatccgagacagtggccaagagtacctcggggggcgccccggccaggtgcactgggttcggcatccaggagatcctgggcttgaacaaggagcccccgagctcccacccgcgggcagcgctcgacggcctggcccccgggcacttgctggcggcgcgctcagtgctcagccccgcgggggtgggcggcatggggcttctggggcccggggggctccctggcttctacacgcagcccaccttcctggaagtgctgtccgacccgcagagcgtccacttgcagccattgggcagagcatcggggccgctggacaccagccagacggccagctcgggtaggtgaggagaggttgcgctgctgcctgactggggggcgacagccgggagccccgcgccgtcggctctcgcttgctggaccaggcctccaggcggaaaagttcctgccaggccgggggtcgccgcctgggccttgggccgacgcgcctggtgatggggcccgggaggatgcttcggcgtccgcagggtttcggccccaagcgtttcgggcggccgcgcagttctccagtccccgcgtcgggcagggctcggccacggcactctgttggagccccactgaaaactgggtttggggtgtcggagcccgtggtgcagagtcgccggccgtgtcggagggccccagcaccgctgctccactgcggccccggcctggtgtaggatccgcactcctcgagcccgatgctgttccggctccggccccatccctggtgtccaaagttgtctgattcccaaatcccgcgctggtcaactggggtttatttttcacccccacgagctcagacaacccggccatcgcggcagctaaagcggccgccatcctctcccacgtaagcgccactatatactggagcccggggacgcgcgggctcggggaccctgggtgacctctccgccttctccccgcgctgctttccgggaggtgtgtcgcggcccgctcgaacctccgattcctgtttgagcttggcaattcccccgatttttcgttgcgttttactttgttttacgtggaaaggcaacgaaaaccagcgcgtcgcaggctctcgggcctcgagtagggacgcattgtgccgccttgcgaaaaggacggtgctcggcagcccccagtcttcccggagcccagctccccacgcctccgctccgctcctcgctcctcgaggccaactttccggcccggggcattggggctggccgcgcagggcagggcgcagcagggtcgcgagcgctgccggggatctctgcggccccctaaggctgcctcgctctccgtcgtcccggtcccaagcgcgccggggcctttgcctctcttacaacgaaatctgttcaaaacctccggattcgggccccggcgcgggagaggtcagcctgagctcagggatgggacggccaccggggcgcccgcaggcttcctggggagacagagcaggtccccgccgctcgcggaggcagcccggggtggggccctcgcgggtttcgggcacagcggagcgcgtcccccactctgccgcatgtccctacgcccgcttttcagattctgaagatgtttcctccagcgatcgaaaaatgtccaaatctgctttaaaccagaccaagaaacggaagaagcggcgacacaggtgaggcccccgctttctgttacctctcctgcccgcgcaccccgctgccgtcccccgttccgggatcgggtctctcggaccctattttcgccgacaacggatctgaggtccgaggccgtgccagggcgcagaccacgggttgtttggcggaatctgcccgggggccttggcgtcggcaccggttgagcaggatgagtggccgccgggaaagcggcccggttcgggctttctcctccttgttcaggagaaaggaaaggctccaacacaggccaaactgagccacagagtgggggcggtccccagatccccgcaccagtacattctgagagccacacagacccggcggcgggcagattagctcccacctcctgccagagccggttctttgccctcggcctcaaccgccgcccccatttctctcccggggtccctgtcctctctgccaactccctaagctttctgctcccaccgttctccaaagctggagcgatctctgcactgacagagcattttcttttggcttctgctcattcgtgattctgaccgagtcgcttcccttctgtg

SEQ ID NO: 109888 - DNA, 333 bp, Homo sapiens; identical to SEQ ID NO: 77097
  misc_feature 1..333: note = chr14:74708774-74709107
  misc_feature 1..333: note = Hyper
  source 1..333: mol_type = genomic DNA

SEQ ID NO: 109889 - DNA, 86 bp, Homo sapiens; identical to SEQ ID NO: 77098
  misc_feature 1..86: note = chr14:74717661-74717747
  misc_feature 1..86: note = Hypo
  source 1..86: mol_type = genomic DNA

SEQ ID NO: 109890 - DNA, 387 bp, Homo sapiens; identical to SEQ ID NO: 77099
  misc_feature 1..387: note = chr14:74724894-74725281
  misc_feature 1..387: note = Hyper
  source 1..387: mol_type = genomic DNA

SEQ ID NO: 109891 - DNA, 36 bp, Homo sapiens; identical to SEQ ID NO: 77100
  misc_feature 1..36: note = chr14:74824362-74824398
  misc_feature 1..36: note = Hypo
  source 1..36: mol_type = genomic DNA

SEQ ID NO: 109892 - DNA, 30 bp, Homo sapiens; identical to SEQ ID NO: 77101
  misc_feature 1..30: note = chr14:74824734-74824764
  misc_feature 1..30: note = Hypo
  source 1..30: mol_type = genomic DNA

SEQ ID NO: 109893 - DNA, 565 bp, Homo sapiens
  misc_feature 1..565: note = chr14:74892548-74893113
  misc_feature 1..565: note = Hyper
  source 1..565: mol_type = genomic DNA
ccccagctcactccccgctccgtgcctagctctgcgctcccgcggcgcccccagaccgccccttacctgtcccgccgcggacggtcccgcctcctccgcggggctcgggggctcggcatgggccggtgagcgacggcgcccccgcctcgcggtcgcggtggaactcccaggagggctcccctgctctcgtccccgcgtccctgagcagccgccgcttcagcaccgcggacagctcccgcccgcagcccgccgccgccgcccgccccgccccgcgcggtcccgggagccccgcatcctggccgggccccgccgccgccgccgccgcgcagccctcggcccggcccgaggcggctccgcgccgacttgggagagcagcgaggagggtccccctccttcccgcctcccgccgccgccgcctccctctcgcttccgtgctccgtgctcccttccacgctccggaatcagcccaccaggcactccggacccggctccggggcggggcggggcgggaagtcgggggagcccggaggaggcggcgaagcgaggggcgcgcagctggaacccg

SEQ ID NO: 109894 - DNA, 1330 bp, Homo sapiens
  misc_feature 1..1330: note = chr14:75077895-75079225
  misc_feature 1..1330: note = Hyper
  source 1..1330: mol_type = genomic DNA
tgcgaaaggatttaacgtcggggctccgggagagttggtaagaaaggatgaggatgatgatctatctgccttcaactcttcgaaagcggatcaaatcttccaatcccgattttggaacctcggggctgtttcccgaagtactaaagacagagggacgagggtatgagagcggcgccctctcctctcgcctgcacgcccctccacaaatgagccctggctcccctctgtaccctccaaacttccctctcccatgctcaccccgtgagccgccctcgcggcggggttgggggcgcagccccagaccgctgtggggtccccaggcgtgggagagccggcgcggcccgggtccggggtgctggttgctgctggcccaggggagtgcttctccgggtctgcgcaggtggctggacacgccgcgactgctgcgcgcgggacggcctcctggcctccgcctcggtgggcctcctggggctcccccagcccggctgggcccgctccacgggctgcaagcccgcgacaggcgcgtcctgctcccggaacagactgtacaccttggctgcagccgctgccgggtagctgcccccagggcgccgcagtcgattcgcgtctccaccagccggctcgtatctccctacggggtccctttgggcatgacccgcgcccacgaagagagccagggtgagcggcaggaagcctctccaggggttccgcagggcgcgccccgggctgcgggctttggtccgcggcctcatggcgcggggcggctggagagtggtgcgcgcgggcaccgcgaagagctttgtggtcggcacgctggacgcccgcgggctgttctcccggccccgcccggcggccagcttctctgagtctagggggccctgaagcggccgactgggggcccggctctcggcggaacgagggctgcgcgccccgagcctcgagtccgcgctcctactccagctgggctcgcacggctgctgcaccttcgcgcctcctccctgtgcctgcagccgtctgaaggggacccggacggttttatttttggaaacctcccccggctttttcgtctcttttatccacaccaggccccctcctcggagggacagctcagccccctcattaccggagagggagcgaggaattccagcaacacccactttggcaccgggaagccagcgggcggcgagcgggcggcgagggggattaacccgtgcggagcagggggcggcgcggggctgacccaggcgctggtcgggcagatggcgcctgccacgaccgggacactgggccgcctttctcctgctctgggcaagttcgaactgcagacctg

SEQ ID NO: 109895 - DNA, 30 bp, Homo sapiens; identical to SEQ ID NO: 77106
  misc_feature 1..30: note = chr14:75326230-75326260
  misc_feature 1..30: note = Hypo
  source 1..30: mol_type = genomic DNA

SEQ ID NO: 109896 - DNA, 30 bp, Homo sapiens; identical to SEQ ID NO: 77107
  misc_feature 1..30: note = chr14:75332119-75332149
  misc_feature 1..30: note = Hypo
  source 1..30: mol_type = genomic DNA

SEQ ID NO: 109897 - DNA, 80 bp, Homo sapiens; identical to SEQ ID NO: 77108
  misc_feature 1..80: note = chr14:75389373-75389453
  misc_feature 1..80: note = Hypo
  source 1..80: mol_type = genomic DNA

SEQ ID NO: 109898 - DNA, 30 bp, Homo sapiens; identical to SEQ ID NO: 77109
  misc_feature 1..30: note = chr14:75411978-75412008
  misc_feature 1..30: note = Hypo
  source 1..30: mol_type = genomic DNA

SEQ ID NO: 109899 - DNA, 30 bp, Homo sapiens; identical to SEQ ID NO: 77110
  misc_feature 1..30: note = chr14:75422033-75422063
  misc_feature 1..30: note = Hyper
  source 1..30: mol_type = genomic DNA

SEQ ID NO: 109900 - DNA, 43 bp, Homo sapiens; identical to SEQ ID NO: 77111
  misc_feature 1..43: note = chr14:75422408-75422451
  misc_feature 1..43: note = Hyper
  source 1..43: mol_type = genomic DNA

SEQ ID NO: 109901 - DNA, 51 bp, Homo sapiens; identical to SEQ ID NO: 77112
  misc_feature 1..51: note = chr14:75446328-75446379
  misc_feature 1..51: note = Hypo
  source 1..51: mol_type = genomic DNA

SEQ ID NO: 109902 - DNA, 18 bp, Homo sapiens
  misc_feature 1..18: note = chr14:75517394-75517412
  misc_feature 1..18: note = Hypo
  source 1..18: mol_type = genomic DNA
gcccggccagaaggtcat

SEQ ID NO: 109903 - DNA, 19 bp, Homo sapiens
  misc_feature 1..19: note = chr14:75749479-75749498
  misc_feature 1..19: note = Hypo
  source 1..19: mol_type = genomic DNA
aaaaaattttcaggccggg

SEQ ID NO: 109904 - DNA, 209 bp, Homo sapiens; identical to SEQ ID NO: 77115
  misc_feature 1..209: note = chr14:75760140-75760349
  misc_feature 1..209: note = Hypo
  source 1..209: mol_type = genomic DNA

SEQ ID NO: 109905 - DNA, 51 bp, Homo sapiens; identical to SEQ ID NO: 77116
  misc_feature 1..51: note = chr14:75791653-75791704
  misc_feature 1..51: note = Hypo
  source 1..51: mol_type = genomic DNA

SEQ ID NO: 109906 - DNA, 30 bp, Homo sapiens; identical to SEQ ID NO: 77117
  misc_feature 1..30: note = chr14:75938324-75938354
  misc_feature 1..30: note = Hypo
  source 1..30: mol_type = genomic DNA

SEQ ID NO: 109907 - DNA, 34 bp, Homo sapiens; identical to SEQ ID NO: 77118
  misc_feature 1..34: note = chr14:75996120-75996154
  misc_feature 1..34: note = Hypo
  source 1..34: mol_type = genomic DNA

SEQ ID NO: 109908 - DNA, 232 bp, Homo sapiens; identical to SEQ ID NO: 77119
  misc_feature 1..232: note = chr14:76001805-76002037
  misc_feature 1..232: note = Hypo
  source 1..232: mol_type = genomic DNA

SEQ ID NO: 109909 - DNA, 34 bp, Homo sapiens; identical to SEQ ID NO: 77120
  misc_feature 1..34: note = chr14:76101271-76101305
  misc_feature 1..34: note = Hypo
  source 1..34: mol_type = genomic DNA

SEQ ID NO: 109910 - DNA, 69 bp, Homo sapiens; identical to SEQ ID NO: 77121
  misc_feature 1..69: note = chr14:76597656-76597725
  misc_feature 1..69: note = Hyper
  source 1..69: mol_type = genomic DNA

SEQ ID NO: 109911 - DNA, 890 bp, Homo sapiens; identical to SEQ ID NO: 77122
  misc_feature 1..890: note = chr14:76604575-76605465
  misc_feature 1..890: note = Hyper
  source 1..890: mol_type = genomic DNA

SEQ ID NO: 109912 - DNA, 169 bp, Homo sapiens; identical to SEQ ID NO: 77123
  misc_feature 1..169: note = chr14:76744173-76744342
  misc_feature 1..169: note = Hypo
  source 1..169: mol_type = genomic DNA

SEQ ID NO: 109913 - DNA, 109 bp, Homo sapiens; identical to SEQ ID NO: 35428
  misc_feature 1..109: note = chr14:76795936-76796045
  misc_feature 1..109: note = Hyper
  source 1..109: mol_type = genomic DNA

SEQ ID NO: 109914 - DNA, 255 bp, Homo sapiens; identical to SEQ ID NO: 77125
  misc_feature 1..255: note = chr14:76819137-76819392
  misc_feature 1..255: note = Hyper
  source 1..255: mol_type = genomic DNA

SEQ ID NO: 109915 - DNA, 443 bp, Homo sapiens; identical to SEQ ID NO: 77126
  misc_feature 1..443: note = chr14:76842512-76842955
  misc_feature 1..443: note = Hyper
  source 1..443: mol_type = genomic DNA

SEQ ID NO: 109916 - DNA, 810 bp, Homo sapiens
  misc_feature 1..810: note = chr14:76843184-76843994
  misc_feature 1..810: note = Hyper
  source 1..810: mol_type = genomic DNA
agagaaagcctttcccgcgggcgctttgttttattatttccatcctggggaccaaaaatgatcccggcaagagagagaaaatcgaacgtgccgcggcggtttggaaactgcaggcggccagtgccgctctcgcctcgcggtctccgtggggcgccccgagggtgcgcacgtggcgcggcggatccagggcgcccgggggatgcgggcccagcgctgcgtcgtaggcaaagttcgttctcggctttgggggaggctgtgaccagcggaacagaagggcaccatttccctgctccgaggcggctttgcgctcgcggtgccagaacctggggttatccgagcggcgtgggcgcgggcggcagccggcgccgcgagaagcgactctcagaaaccgcgggtctccagccccggggcagcgcgccaagagcgcagagtgggaaagtgaactgatcgcctaagcagcgggtggtcaacccgcgtgtcatgtccgggctctcggggatcccactctatccacctacggtttccctcccgacaccctccacggtcgccgctccacctgctcgggtacctgcccgggtctccccttgggcgctgcgcaccccacggcgcccccggcgggtgtcccggaggcaggttgtgtgcgcgtgcaaagtggtccctcggaaggcttaataataataatacataaaactctaggttcttacggacagctttcctgcttaactttgtgctcgtcttcctcttttttttctgacgcaaactaaattctccaagtcagcgtttctccagttccaccgtgctttcatttgt

SEQ ID NO: 109917 - DNA, 180 bp, Homo sapiens; identical to SEQ ID NO: 77129
  misc_feature 1..180: note = chr14:76998049-76998229
  misc_feature 1..180: note = Hypo
  source 1..180: mol_type = genomic DNA

SEQ ID NO: 109918 - DNA, 415 bp, Homo sapiens; identical to SEQ ID NO: 77130
  misc_feature 1..415: note = chr14:77227599-77228014
  misc_feature 1..415: note = Hyper
  source 1..415: mol_type = genomic DNA

SEQ ID NO: 109919 - DNA, 247 bp, Homo sapiens; identical to SEQ ID NO: 77131
  misc_feature 1..247: note = chr14:77228556-77228803
  misc_feature 1..247: note = Hyper
  source 1..247: mol_type = genomic DNA

SEQ ID NO: 109920 - DNA, 258 bp, Homo sapiens; identical to SEQ ID NO: 77132
  misc_feature 1..258: note = chr14:77242433-77242691
  misc_feature 1..258: note = Hypo
  source 1..258: mol_type = genomic DNA

SEQ ID NO: 109921 - DNA, 222 bp, Homo sapiens; identical to SEQ ID NO: 77133
  misc_feature 1..222: note = chr14:77519615-77519837
  misc_feature 1..222: note = Hyper
  source 1..222: mol_type = genomic DNA

SEQ ID NO: 109922 - DNA, 578 bp, Homo sapiens; identical to SEQ ID NO: 77134
  misc_feature 1..578: note = chr14:77591173-77591751
  misc_feature 1..578: note = Hyper
  source 1..578: mol_type = genomic DNA

SEQ ID NO: 109923 - DNA, 188 bp, Homo sapiens
  misc_feature 1..188: note = chr14:77600201-77600389
  misc_feature 1..188: note = Hyper
  source 1..188: mol_type = genomic DNA
ggtggcagcagaagccggcgcaggccaggccgatggcgaaccagaggtagagcatgaggatgacgaacatttcagaacccaggacagctcctgcagggcacggggaggggaaacaccagagccgctttacacccaggccaccggcataactgcgatctaggcaggctttccaccgggagggagggaga

SEQ ID NO: 109924 - DNA, 93 bp, Homo sapiens; identical to SEQ ID NO: 77137
  misc_feature 1..93: note = chr14:77606256-77606349
  misc_feature 1..93: note = Hyper
  source 1..93: mol_type = genomic DNA

SEQ ID NO: 109925 - DNA, 1560 bp, Homo sapiens
  misc_feature 1..1560: note = chr14:77606757-77608317
  misc_feature 1..1560: note = Hyper
  source 1..1560: mol_type = genomic DNA
gtatgtatatatctgcgtgtacagacacgcagcctctgctatctagctttaaaaaaatcaattgaaacaatcgatacactcacactcgctctcgggcaccgggtgaggtgggggcgcaaccagaatacctgtgtcagcgggtcctggccagcacatctctccaacgctggctgcccgggctatttctttgcgaagagcgttttcatttgaggcgaaattaaaatccccccttcgcgcccgcctcccgccctcctgctgagagaaacccaaacaaccctcatggcgccgaaatcctttccatgccgacaagcccgccctgggcgcacgagtggatgcttggccagcctttcctgggatcgaccccgccgccgtgctcagccctcaccacgtccccatcccaccccacgcctcacagccggggttcctggccagcttcggaagccaccgagaaataggattccgtgcgcccgagagaacttttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggag

SEQ ID NO: 109926 - DNA, 30 bp, Homo sapiens; identical to SEQ ID NO: 77140
  misc_feature 1..30: note = chr14:77646077-77646107
  misc_feature 1..30: note = Hypo
  source 1..30: mol_type = genomic DNA

SEQ ID NO: 109927 - DNA, 165 bp, Homo sapiens; identical to SEQ ID NO: 77141
  misc_feature 1..165: note = chr14:77703958-77704123
  misc_feature 1..165: note = Hypo
  source 1..165: mol_type = genomic DNA

SEQ ID NO: 109928 - DNA, 85 bp, Homo sapiens; identical to SEQ ID NO: 77142
  misc_feature 1..85: note = chr14:77736611-77736696
  misc_feature 1..85: note = Hyper
  source 1..85: mol_type = genomic DNA

SEQ ID NO: 109929 - DNA, 629 bp, Homo sapiens
  misc_feature 1..629: note = chr14:77736980-77737609
  misc_feature 1..629: note = Hyper
  source 1..629: mol_type = genomic DNA
ctggttggcaacaggcgcccacggtcgagagagaggcagaggggctgtgccacccgtcgccgcgccccgctcctctggcgcacatctggcaggcgccccagcgccccggcagcggccagttttccctccttcggggccggtcctgccgcgtgacccctttcccgccgaggcagcctccacccgcatccccgggcgctcgtgtagccctcacctggcaaacaggacggtgccgtgctccagcgggctgcggctcactgcccgccagctctgccggatcagctcgggctccgggcgctccatgctgtcccggggacgcggagcgcggggctgggaccctcagggctcgggtgccgtcaccgcacgtgccgcgccatctcctccgcgacgcggtcccctccgcccctcgtacgccccccgtgcctccgcccggcgggggccgcagccgctccttccctggcgcgggagagaaaaggcgcgcggccagtcgtaggtggagacaccccagctgtgcttccggggaccccgcttggccgctgcgccctgcgccccgcagccgccagagccgccccaccccgcgacgcctgggctgggcgctttaaagccgccacggcccccgccccctccaggcc

SEQ ID NO: 109930 - DNA, 675 bp, Homo sapiens; identical to SEQ ID NO: 77145
  misc_feature 1..675: note = chr14:77964462-77965137
  misc_feature 1..675: note = Hyper
  source 1..675: mol_type = genomic DNA

SEQ ID NO: 109931 - DNA, 259 bp, Homo sapiens; identical to SEQ ID NO: 77146
  misc_feature 1..259: note = chr14:77965424-77965683
  misc_feature 1..259: note = Hyper
  source 1..259: mol_type = genomic DNA

SEQ ID NO: 109932 - DNA, 30 bp, Homo sapiens; identical to SEQ ID NO: 77147
  misc_feature 1..30: note = chr14:77968899-77968929
  misc_feature 1..30: note = Hypo
  source 1..30: mol_type = genomic DNA

SEQ ID NO: 109933 - DNA, 30 bp, Homo sapiens; identical to SEQ ID NO: 44058
  misc_feature 1..30: note = chr14:78141401-78141431
  misc_feature 1..30: note = Hypo
  source 1..30: mol_type = genomic DNA

SEQ ID NO: 109934 - DNA, 22 bp, Homo sapiens
  misc_feature 1..22: note = chr14:78165413-78165435
  misc_feature 1..22: note = Hypo
  source 1..22: mol_type = genomic DNA
ccttattcggtctctttagcac

SEQ ID NO: 109935 - DNA, 40 bp, Homo sapiens; identical to SEQ ID NO: 77150
  misc_feature 1..40: note = chr14:78247790-78247830
  misc_feature 1..40: note = Hypo
  source 1..40: mol_type = genomic DNA

SEQ ID NO: 109936 - DNA, 30 bp, Homo sapiens; identical to SEQ ID NO: 11983
  misc_feature 1..30: note = chr14:78624601-78624631
  misc_feature 1..30: note = Hyper
  source 1..30: mol_type = genomic DNA

SEQ ID NO: 109937 - DNA, 36 bp, Homo sapiens; identical to SEQ ID NO: 77152
  misc_feature 1..36: note = chr14:78709766-78709802
  misc_feature 1..36: note = Hypo
  source 1..36: mol_type = genomic DNA

SEQ ID NO: 109938 - DNA, 30 bp, Homo sapiens; identical to SEQ ID NO: 44060
  misc_feature 1..30: note = chr14:79111630-79111660
  misc_feature 1..30: note = Hypo
  source 1..30: mol_type = genomic DNA

SEQ ID NO: 109939 - DNA, 70 bp, Homo sapiens; identical to SEQ ID NO: 77154
  misc_feature 1..70: note = chr14:79745172-79745242
  misc_feature 1..70: note = Hyper
  source 1..70: mol_type = genomic DNA

SEQ ID NO: 109940 - DNA, 82 bp, Homo sapiens; identical to SEQ ID NO: 77155
  misc_feature 1..82: note = chr14:79745475-79745557
  misc_feature 1..82: note = Hyper
  source 1..82: mol_type = genomic DNA

SEQ ID NO: 109941 - DNA, 30 bp, Homo sapiens; identical to SEQ ID NO: 77156
  misc_feature 1..30: note = chr14:79745998-79746028
  misc_feature 1..30: note = Hyper
  source 1..30: mol_type = genomic DNA

SEQ ID NO: 109942 - DNA, 30 bp, Homo sapiens; identical to SEQ ID NO: 44061
  misc_feature 1..30: note = chr14:81489175-81489205
  misc_feature 1..30: note = Hypo
  source 1..30: mol_type = genomic DNA

SEQ ID NO: 109943 - DNA, 204 bp, Homo sapiens; identical to SEQ ID NO: 77158
  misc_feature 1..204: note = chr14:81902032-81902236
  misc_feature 1..204: note = Hyper
  source 1..204: mol_type = genomic DNA

SEQ ID NO: 109944 - DNA, 182 bp, Homo sapiens; identical to SEQ ID NO: 77159
  misc_feature 1..182: note = chr14:81902823-81903005
  misc_feature 1..182: note = Hyper
  source 1..182: mol_type = genomic DNA

SEQ ID NO: 109945 - DNA, 30 bp, Homo sapiens
  misc_feature 1..30: note = chr14:82028395-82028425
  misc_feature 1..30: note = Hypo
  source 1..30: mol_type = genomic DNA
gtaaaccattctgtccgcactggtatccca

SEQ ID NO: 109946 - DNA, 30 bp, Homo sapiens; identical to SEQ ID NO: 77160
  misc_feature 1..30: note = chr14:82090665-82090695
  misc_feature 1..30: note = Hypo
  source 1..30: mol_type = genomic DNA

SEQ ID NO: 109947 - DNA, 808 bp, Homo sapiens
  misc_feature 1..808: note = chr14:85996141-85996949
  misc_feature 1..808: note = Hyper
  source 1..808: mol_type = genomic DNA
caacttcaataaatccggtaactggaggcaaaaaatagactccgagggctgggtctggtccggatgaaacgctagggctccttcccttccttgaatcttgggcgctggaagccagccacgggcgtcttgccacgcgagtgcccctagacagcaacacacccactggaaacgcacgtgaacaaagctctcgcccccgggagccgctgcctgcggtttcctagtcgatcccagcttctctagggagtgtcaggcgcacacagggttaagttagttccctccctggtaggagggagaggaggaggaggggaaaagcagcatactgtctcaggctgggtaccttgtagttagttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccagcgtcttccctttccacctccctgaccctgtcggattcggatgagcccattgcaaggagaagacgcagccgtcaggtaaaaggggctgcgttgccaggtgaagtttccagtaaccggccgagctgctgctacgctggcaccacgct

SEQ ID NO: 109948 - DNA, 606 bp, Homo sapiens
  misc_feature 1..606: note = chr14:85997453-85998059
  misc_feature 1..606: note = Hyper
  source 1..606: mol_type = genomic DNA
cctgcttgtcctcttcgggctggcgggcactgagctggggccatcacgcctttctagagcgcctgcggaggtggcgaaggcttggagagcatacgaggcggaatccggatcgagtgagttccttgagccgcttgcgtgggacgcagggagagggcgaataacgccctcaggcgctgaatgcaggggcaaggagccagcgagggtggctggagcaggccttgccagctgttaccaagtctctccacaggcttgggggcttggggcctcctggaaagatccctccgccgcgctgaccagtacggggctcgctcccgcactttgaaggctgccgcggtctttcgtcatttataatcaagcccaagatcaaggttgcaagctgaggtcggggtactgacaacgggaatgaagccataggggaagaggataactgggacgggctggacccatacttgatacccgggaaactcctagagcgtgtggtgctcctgccagcggcagttactggtggagctgaggccaccgctactgtcgtcgttggcgctttgcttctggaacctcccagcaagatggcactcactgtctgttcccttccgattagcaccccca

SEQ ID NO: 109949 - DNA, 173 bp, Homo sapiens
  misc_feature 1..173: note = chr14:85998560-85998733
  misc_feature 1..173: note = Hyper
  source 1..173: mol_type = genomic DNA
tagttttaaactctccggttgcatctcgcgtggccccaccgacggcgcgtctcggcgtagctcttggcgcgggctcgttctccctcttctgttcagattcagcctcaccggacttgttacaacatgacagcaacttactggaggcaggaagagcagcacgaaataagatgaga

SEQ ID NO: 109950 - DNA, 974 bp, Homo sapiens
  misc_feature 1..974: note = chr14:85999517-86000491
  misc_feature 1..974: note = Hyper
  source 1..974: mol_type = genomic DNA
agagggctccaggagcggagcgcgccagagcgcgagggacggagggagaggaggagcgcgggagctgcggaggcgatcccgcgaattcattactgtaaacatatccgggggtgtcaggaggggtaggggtgggggccgcggcgcctacattagcccggccgcgtcggattgaggcagtagtgtggtctgagcagcctccagacccacgccgggcgggcgcagcacttggagcgagccctgcgcccgcccccgcgcagcgccgcacgcccggctccgagctgtccgcacacacgcgtcggaggagagcccgcctagctctcccgccgagtcccgggatcctccaaatccgaggagctccggcgccgcggggcagctttctgccgccttccccgctcgctgtacttcttttggggttcgttggcttggcgaagcggagagggggaggcggaggaggagagaaggcgggggtcgcggcggccgaagccaagagaaagtggcatgcccgaaccctggaggcggtggtggcggaggacgggggaagacgatgccgcagctccgtaggggacgtaggcgagagcaagcgaggcgagctgggcgccccggccccggcccgctgcggggaggcgcgcgccgctctgaggctccggcctccgcacccccgcgccccgacgctgcgggcgacagggcttggctccagcagccgccgccgtcgccgccgccgccacccggaggacccagcaaaagtttggatctgggggagggcgcggcgctgagcgggattaccaccagggctggaaggagacctcgagaacctttgcaggtaacgcgcgcccccaaccctcttcttccatgccccgccgctgcgctcccgcttcctcccagagcccttcctggccctcgcgggtctggcagaaagtaagagggaggcgaagttcaagatcccggggatgagcaccgagcgctggcagatcact

SEQ ID NO: 109951 - DNA, 213 bp, Homo sapiens; identical to SEQ ID NO: 77169
  misc_feature 1..213: note = chr14:86000988-86001201
  misc_feature 1..213: note = Hyper
  source 1..213: mol_type = genomic DNA

SEQ ID NO: 109952 - DNA, 23 bp, Homo sapiens
  misc_feature 1..23: note = chr14:87889659-87889682
  misc_feature 1..23: note = Hypo
  source 1..23: mol_type = genomic DNA
aggagccaagatggccgaatagg

SEQ ID NO: 109953 - DNA, 40 bp, Homo sapiens; identical to SEQ ID NO: 77171
  misc_feature 1..40: note = chr14:88449385-88449425
  misc_feature 1..40: note = Hypo
  source 1..40: mol_type = genomic DNA

SEQ ID NO: 109954 - DNA, 30 bp, Homo sapiens; identical to SEQ ID NO: 77172
  misc_feature 1..30: note = chr14:88458934-88458964
  misc_feature 1..30: note = Hyper
  source 1..30: mol_type = genomic DNA

SEQ ID NO: 109955 - DNA, 222 bp, Homo sapiens; identical to SEQ ID NO: 77173
  misc_feature 1..222: note = chr14:88459409-88459631
  misc_feature 1..222: note = Hyper
  source 1..222: mol_type = genomic DNA

SEQ ID NO: 109956 - DNA, 30 bp, Homo sapiens; identical to SEQ ID NO: 44062
  misc_feature 1..30: note = chr14:88673478-88673508
  misc_feature 1..30: note = Hypo
  source 1..30: mol_type = genomic DNA

SEQ ID NO: 109957 - DNA, 323 bp, Homo sapiens; identical to SEQ ID NO: 77175
  misc_feature 1..323: note = chr14:88789333-88789656
  misc_feature 1..323: note = Hyper
  source 1..323: mol_type = genomic DNA

SEQ ID NO: 109958 - DNA, 720 bp, Homo sapiens
  misc_feature 1..720: note = chr14:88789962-88790682
  misc_feature 1..720: note = Hyper
  source 1..720: mol_type = genomic DNA
aacgagcggtgggcgcgccgctacttactggctcggccggccggcgggcgggcgtggaggcggcagcggcgcgcttgctggagttgcagccggagacacgcttggttgcctggaaggcgctgcaggaggcggaggaagggccgctgcggctccgccgcagacctcggcctccgggtcacctcttctcaccgctctcaccctgagctctccctccttctcttttctcacttcattttttttcctcccgcgtctggctctctcgcctgagtcccgaacccacgtccccgccgcactccaaggaggcccgtgccagccatgagccttttgttctgggaccgctccgcatctgctgcgctctccccgcccggggaagctcgctcccaaggcacagcttggtcccttccccagctacctgcagccggactggggccgctggtcgttggctggaaaggaggcttgagagaggcacgggggcccccggaggaaagcggagttgccaagacccggcagctcccggaagcggcggccccgggatcctgggaccagcagggcagatgcgaagggacccagacctgttcccggaaaggggctaaacctggagcattcgtctaacgccctctcactgcccctgcttgaagccccacaggggtttgtggtggggcctcagtcttcagaaaagccaggtggtgctgaggtgctcttgaacgggtcactccgagt

SEQ ID NO: 109959 - DNA, 506 bp, Homo sapiens; identical to SEQ ID NO: 77178
  misc_feature 1..506: note = chr14:88792857-88793363
  misc_feature 1..506: note = Hyper
  source 1..506: mol_type = genomic DNA

SEQ ID NO: 109960 - DNA, 30 bp, Homo sapiens; identical to SEQ ID NO: 77179
  misc_feature 1..30: note = chr14:89017832-89017862
  misc_feature 1..30: note = Hyper
  source 1..30: mol_type = genomic DNA

SEQ ID NO: 109961 - DNA, 356 bp, Homo sapiens; identical to SEQ ID NO: 77180
  misc_feature 1..356: note = chr14:89493134-89493490
  misc_feature 1..356: note = Hyper
  source 1..356: mol_type = genomic DNA

SEQ ID NO: 109962 - DNA, 155 bp, Homo sapiens; identical to SEQ ID NO: 77181
  misc_feature 1..155: note = chr14:89493899-89494054
  misc_feature 1..155: note = Hyper
  source 1..155: mol_type = genomic DNA

SEQ ID NO: 109963 - DNA, 54 bp, Homo sapiens; identical to SEQ ID NO: 77182
  misc_feature 1..54: note = chr14:89579245-89579299
  misc_feature 1..54: note = Hypo
  source 1..54: mol_type = genomic DNA

SEQ ID NO: 109964 - DNA, 102 bp, Homo sapiens; identical to SEQ ID NO: 77183
  misc_feature 1..102: note = chr14:89606032-89606134
  misc_feature 1..102: note = Hypo
  source 1..102: mol_type = genomic DNA

SEQ ID NO: 109965 - DNA, 30 bp, Homo sapiens; identical to SEQ ID NO: 77184
  misc_feature 1..30: note = chr14:89606445-89606475
  misc_feature 1..30: note = Hypo
  source 1..30: mol_type = genomic DNA

SEQ ID NO: 109966 - DNA, 140 bp, Homo sapiens; identical to SEQ ID NO: 77185
  misc_feature 1..140: note = chr14:89657653-89657793
  misc_feature 1..140: note = Hypo
  source 1..140: mol_type = genomic DNA

SEQ ID NO: 109967 - DNA, 194 bp, Homo sapiens; identical to SEQ ID NO: 77186
  misc_feature 1..194: note = chr14:89817840-89818034
  misc_feature 1..194: note = Hyper
  source 1..194: mol_type = genomic DNA

SEQ ID NO: 109968 - DNA, 30 bp, Homo sapiens; identical to SEQ ID NO: 44065
  misc_feature 1..30: note = chr14:89895234-89895264
  misc_feature 1..30: note = Hypo
  source 1..30: mol_type = genomic DNA

SEQ ID NO: 109969 - DNA, 30 bp, Homo sapiens; identical to SEQ ID NO: 77188
  misc_feature 1..30: note = chr14:89898427-89898457
  misc_feature 1..30: note = Hypo
  source 1..30: mol_type = genomic DNA

SEQ ID NO: 109970 - DNA, 58 bp, Homo sapiens; identical to SEQ ID NO: 77189
  misc_feature 1..58: note = chr14:89918692-89918750
  misc_feature 1..58: note = Hypo
  source 1..58: mol_type = genomic DNA

SEQ ID NO: 109971 - DNA, 103 bp, Homo sapiens; identical to SEQ ID NO: 77190
  misc_feature 1..103: note = chr14:89938186-89938289
  misc_feature 1..103: note = Hypo
  source 1..103: mol_type = genomic DNA

SEQ ID NO: 109972 - DNA, 19 bp, Homo sapiens
  misc_feature 1..19: note = chr14:89941442-89941461
  misc_feature 1..19: note = Hypo
  source 1..19: mol_type = genomic DNA
ccaccgcgcccggccaggt

SEQ ID NO: 109973 - DNA, 85 bp, Homo sapiens; identical to SEQ ID NO: 77192
  misc_feature 1..85: note = chr14:89954654-89954739
  misc_feature 1..85: note = Hypo
  source 1..85: mol_type = genomic DNA

SEQ ID NO: 109974 - DNA, 41 bp, Homo sapiens; identical to SEQ ID NO: 77193
  misc_feature 1..41: note = chr14:89962244-89962285
  misc_feature 1..41: note = Hypo
  source 1..41: mol_type = genomic DNA

SEQ ID NO: 109975 - DNA, 41 bp, Homo sapiens; identical to SEQ ID NO: 77194
  misc_feature 1..41: note = chr14:89962525-89962566
  misc_feature 1..41: note = Hypo
  source 1..41: mol_type = genomic DNA

SEQ ID NO: 109976 - DNA, 25 bp, Homo sapiens
  misc_feature 1..25: note = chr14:90002828-90002853
  misc_feature 1..25: note = Hypo
  source 1..25: mol_type = genomic DNA
aagattaaataaggtcggcgggcgc

SEQ ID NO: 109977 - DNA, 20 bp, Homo sapiens
  misc_feature 1..20: note = chr14:90006790-90006810
  misc_feature 1..20: note = Hypo
  source 1..20: mol_type = genomic DNA
aaatgaggctgggcacggtg

SEQ ID NO: 109978 - DNA, 41 bp, Homo sapiens; identical to SEQ ID NO: 77197
  misc_feature 1..41: note = chr14:90043896-90043937
  misc_feature 1..41: note = Hypo
  source 1..41: mol_type = genomic DNA

SEQ ID NO: 109979 - DNA, 30 bp, Homo sapiens; identical to SEQ ID NO: 77198
  misc_feature 1..30: note = chr14:90083564-90083594
  misc_feature 1..30: note = Hyper
  source 1..30: mol_type = genomic DNA

SEQ ID NO: 109980 - DNA, 630 bp, Homo sapiens; identical to SEQ ID NO: 77199
  misc_feature 1..630: note = chr14:90084018-90084648
  misc_feature 1..630: note = Hyper
  source 1..630: mol_type = genomic DNA

SEQ ID NO: 109981 - DNA, 153 bp, Homo sapiens; identical to SEQ ID NO: 77200
  misc_feature 1..153: note = chr14:90085797-90085950
  misc_feature 1..153: note = Hyper
  source 1..153: mol_type = genomic DNA

SEQ ID NO: 109982 - DNA, 20 bp, Homo sapiens
  misc_feature 1..20: note = chr14:90201050-90201070
  misc_feature 1..20: note = Hypo
  source 1..20: mol_type = genomic DNA
ttaaccgatagtaaaacata

SEQ ID NO: 109983 - DNA, 62 bp, Homo sapiens; identical to SEQ ID NO: 77202
  misc_feature 1..62: note = chr14:90204670-90204732
  misc_feature 1..62: note = Hypo
  source 1..62: mol_type = genomic DNA

SEQ ID NO: 109984 - DNA, 30 bp, Homo sapiens; identical to SEQ ID NO: 77203
  misc_feature 1..30: note = chr14:90323596-90323626
  misc_feature 1..30: note = Hypo
  source 1..30: mol_type = genomic DNA

SEQ ID NO: 109985 - DNA, 625 bp, Homo sapiens; identical to SEQ ID NO: 35465
  misc_feature 1..625: note = chr14:90526555-90527180
  misc_feature 1..625: note = Hyper
  source 1..625: mol_type = genomic DNA

SEQ ID NO: 109986 - DNA, 419 bp, Homo sapiens; identical to SEQ ID NO: 77205
  misc_feature 1..419: note = chr14:90527512-90527931
  misc_feature 1..419: note = Hyper
  source 1..419: mol_type = genomic DNA

SEQ ID NO: 109987 - DNA, 990 bp, Homo sapiens
  misc_feature 1..990: note = chr14:90528157-90529147
  misc_feature 1..990: note = Hyper
  source 1..990: mol_type = genomic DNA
ctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccataggtaagtgtgctggccggactcgctgacaacctccgggcggcctccacttcctccggggggcaggaccgaccctctcatcctttcattcatccatctgggcgcccagccagactccactgacatgagctgtcgcctgatcaacaggtggtattgcctccccgctgctctaatgtggtccaggcaccggcagcttcagcgtcacctggcagcttgttagaaatgcagtctcagtcccctctgcagacctgccgagtcagaatctgc

SEQ ID NO: 109988 - DNA, 67 bp, Homo sapiens; identical to SEQ ID NO: 77208
  misc_feature 1..67: note = chr14:90632615-90632682
  misc_feature 1..67: note = Hypo
  source 1..67: mol_type = genomic DNA

SEQ ID NO: 109989 - DNA, 30 bp, Homo sapiens; identical to SEQ ID NO: 44069
  misc_feature 1..30: note = chr14:90650692-90650722
  misc_feature 1..30: note = Hypo
  source 1..30: mol_type = genomic DNA

SEQ ID NO: 109990 - DNA, 61 bp, Homo sapiens; identical to SEQ ID NO: 77210
  misc_feature 1..61: note = chr14:90651094-90651155
  misc_feature 1..61: note = Hypo
  source 1..61: mol_type = genomic DNA

SEQ ID NO: 109991 - DNA, 32 bp, Homo sapiens; identical to SEQ ID NO: 44070
  misc_feature 1..32: note = chr14:90724207-90724239
  misc_feature 1..32: note = Hypo
  source 1..32: mol_type = genomic DNA

SEQ ID NO: 109992 - DNA, 526 bp, Homo sapiens; identical to SEQ ID NO: 77212
  misc_feature 1..526: note = chr14:90849950-90850476
  misc_feature 1..526: note = Hyper
  source 1..526: mol_type = genomic DNA

SEQ ID NO: 109993 - DNA, 30 bp, Homo sapiens; identical to SEQ ID NO: 15852
  misc_feature 1..30: note = chr14:90983280-90983310
  misc_feature 1..30: note = Hypo
  source 1..30: mol_type = genomic DNA

SEQ ID NO: 109994 - DNA, 46 bp, Homo sapiens; identical to SEQ ID NO: 77214
  misc_feature 1..46: note = chr14:91059788-91059834
  misc_feature 1..46: note = Hypo
  source 1..46: mol_type = genomic DNA

SEQ ID NO: 109995 - DNA, 30 bp, Homo sapiens; identical to SEQ ID NO: 77215
  misc_feature 1..30: note = chr14:91065728-91065758
  misc_feature 1..30: note = Hypo
  source 1..30: mol_type = genomic DNA

SEQ ID NO: 109996 - DNA, 142 bp, Homo sapiens
  misc_feature 1..142: note = chr14:91580352-91580494
  misc_feature 1..142: note = Hyper
  source 1..142: mol_type = genomic DNA
ctttaagaactggggcgggctagctgccgaggagaccacgctgctgcatgggccacgtgagctcaggctgtgggagcggatggagctgctacagtcagcgcttggggctggcctcagcttgtagacccgagccctgcagaac

SEQ ID NO: 109997 - DNA, 30 bp, Homo sapiens; identical to SEQ ID NO: 35471
  misc_feature 1..30: note = chr14:91581588-91581618
  misc_feature 1..30: note = Hyper
  source 1..30: mol_type = genomic DNA

SEQ ID NO: 109998 - DNA, 40 bp, Homo sapiens; identical to SEQ ID NO: 44073
  misc_feature 1..40: note = chr14:91691266-91691306
  misc_feature 1..40: note = Hypo
  source 1..40: mol_type = genomic DNA

SEQ ID NO: 109999 - DNA, 30 bp, Homo sapiens; identical to SEQ ID NO: 35472
  misc_feature 1..30: note = chr14:91720177-91720207
  misc_feature 1..30: note = Hyper
  source 1..30: mol_type = genomic DNA

SEQ ID NO: 110000 - DNA, 38 bp, Homo sapiens; identical to SEQ ID NO: 77221
  misc_feature 1..38: note = chr14:91730743-91730781
  misc_feature 1..38: note = Hyper
  source 1..38: mol_type = genomic DNA

SEQ ID NO: 110001 - DNA, 30 bp, Homo sapiens; identical to SEQ ID NO: 77222
  misc_feature 1..30: note = chr14:91743801-91743831
  misc_feature 1..30: note = Hypo
  source 1..30: mol_type = genomic DNA

SEQ ID NO: 110002 - DNA, 146 bp, Homo sapiens; identical to SEQ ID NO: 77223
  misc_feature 1..146: note = chr14:91747935-91748081
  misc_feature 1..146: note = Hypo
  source 1..146: mol_type = genomic DNA

SEQ ID NO: 110003 - DNA, 55 bp, Homo sapiens; identical to SEQ ID NO: 77224
  misc_feature 1..55: note = chr14:91754739-91754794
  misc_feature 1..55: note = Hypo
  source 1..55: mol_type = genomic DNA

SEQ ID NO: 110004 - DNA, 30 bp, Homo sapiens; identical to SEQ ID NO: 77225
  misc_feature 1..30: note = chr14:91757392-91757422
  misc_feature 1..30: note = Hypo
  source 1..30: mol_type = genomic DNA

SEQ ID NO: 110005 - DNA, 96 bp, Homo sapiens; identical to SEQ ID NO: 77226
  misc_feature 1..96: note = chr14:91758260-91758356
  misc_feature 1..96: note = Hypo
  source 1..96: mol_type = genomic DNA

SEQ ID NO: 110006 - DNA, 325 bp, Homo sapiens; identical to SEQ ID NO: 77227
  misc_feature 1..325: note = chr14:91766265-91766590
  misc_feature 1..325: note = Hypo
  source 1..325: mol_type = genomic DNA

SEQ ID NO: 110007 - DNA, 30 bp, Homo sapiens; identical to SEQ ID NO: 77228
  misc_feature 1..30: note = chr14:91837088-91837118
  misc_feature 1..30: note = Hypo
  source 1..30: mol_type = genomic DNA

SEQ ID NO: 110008 - DNA, 90 bp, Homo sapiens; identical to SEQ ID NO: 44077
  misc_feature 1..90: note = chr14:91849645-91849735
  misc_feature 1..90: note = Hypo
  source 1..90: mol_type = genomic DNA

SEQ ID NO: 110009 - DNA, 30 bp, Homo sapiens; identical to SEQ ID NO: 44078
  misc_feature 1..30: note = chr14:91850063-91850093
  misc_feature 1..30: note = Hypo
  source 1..30: mol_type = genomic DNA

SEQ ID NO: 110010 - DNA, 30 bp, Homo sapiens; identical to SEQ ID NO: 77231
  misc_feature 1..30: note = chr14:91850338-91850368
  misc_feature 1..30: note = Hypo
  source 1..30: mol_type = genomic DNA

SEQ ID NO: 110011 - DNA, 518 bp, Homo sapiens; identical to SEQ ID NO: 77232
  misc_feature 1..518: note = chr14:92040365-92040883
  misc_feature 1..518: note = Hyper
  source 1..518: mol_type = genomic DNA

SEQ ID NO: 110012 - DNA, 326 bp, Homo sapiens; identical to SEQ ID NO: 77233
  misc_feature 1..326: note = chr14:92414011-92414337
  misc_feature 1..326: note = Hyper
  source 1..326: mol_type = genomic DNA

SEQ ID NO: 110013 - DNA, 30 bp, Homo sapiens; identical to SEQ ID NO: 77234
  misc_feature 1..30: note = chr14:92672989-92673019
  misc_feature 1..30: note = Hypo
  source 1..30: mol_type = genomic DNA

SEQ ID NO: 110014 - DNA, 1820 bp, Homo sapiens
  misc_feature 1..1820: note = chr14:92789076-92790896
  misc_feature 1..1820: note = Hyper
  source 1..1820: mol_type = genomic DNA
tttgttagctctgcacgaccaattaattttctcctgcatcttccccccgtggtgggtggcggggtggggagggggtgtgtggcggggcctcgggtcggctcgggggtcggagagcccggacaggagcgactacactgcagaaaccctttttctaagagtccccagcggtgccataacctgtttctctctgcagcagcctcagagggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagacgctggcgcccgcagccgagaagccagagagaaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagccggccgaagcggagcgggcaggtagcggctctagcgccgggactgcgccagccctgcgagcccgggccgccagcgccaccgtgccggcgtcgcctcctcgccacggagccatggtgcgcgcagcgcgcacgcggcgcgcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgccgctcggccactgattgcactctggccgctgaagctccccatcctctcccagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttgggtgggtgctggtacgggtcccctcttcctggggagttgggggctttggctggggagtctcggggcggctgcgagatgttttcccctccttcctcatcaggttggtcccaagggttcatccagtcccctccccgccgggcaggtagagcgcgcccagaagagctgatggacgctctgggctgtggcgccggttcccctgagctacgagcggcccctgggggggctcaggacgcggctgcaggtgtgtgttactaagacgaaagcaagaaccgcttccgtcccgggagtgcgcccggaatgggcagcgcaactgcggggtgcaggcaggattctcttggtctggggtgggcgaaactgagtggcccgctttcctattctgcagagccgcaggaaccgccactgcgtctcgcccctgccctggttcaaaggggtcccctgggtgccctgaggtgtttgttcttcccaaaccctaaaggcgttggggcagtctgccgcggggggtagctgccatgtttcagcatcgcgtctctcaactccccttaactcccacggagggagaaggcgggtgtgtggagcctcgacccatgccccct

SEQ ID NO: 110015 - DNA, 101 bp, Homo sapiens; identical to SEQ ID NO: 77238
  misc_feature 1..101: note = chr14:92801293-92801394
  misc_feature 1..101: note = Hypo
  source 1..101: mol_type = genomic DNA

SEQ ID NO: 110016 - DNA, 191 bp, Homo sapiens; identical to SEQ ID NO: 44080
  misc_feature 1..191: note = chr14:92829024-92829215
  misc_feature 1..191: note = Hypo
  source 1..191: mol_type = genomic DNA

SEQ ID NO: 110017 - DNA, 131 bp, Homo sapiens; identical to SEQ ID NO: 77240
  misc_feature 1..131: note = chr14:92839920-92840051
  misc_feature 1..131: note = Hypo
  source 1..131: mol_type = genomic DNA

SEQ ID NO: 110018 - DNA, 30 bp, Homo sapiens; identical to SEQ ID NO: 77241
  misc_feature 1..30: note = chr14:92858667-92858697
  misc_feature 1..30: note = Hypo
  source 1..30: mol_type = genomic DNA

SEQ ID NO: 110019 - DNA, 1180 bp, Homo sapiens; identical to SEQ ID NO: 77242
  misc_feature 1..1180: note = chr14:92979590-92980770
  misc_feature 1..1180: note = Hyper
  source 1..1180: mol_type = genomic DNA

SEQ ID NO: 110020 - DNA, 59 bp, Homo sapiens; identical to SEQ ID NO: 77243
  misc_feature 1..59: note = chr14:93065511-93065570
  misc_feature 1..59: note = Hypo
  source 1..59: mol_type = genomic DNA

SEQ ID NO: 110021 - DNA, 21 bp, Homo sapiens
  misc_feature 1..21: note = chr14:93091187-93091208
  misc_feature 1..21: note = Hypo
  source 1..21: mol_type = genomic DNA
agggggcggtgctttcttgac

SEQ ID NO: 110022 - DNA, 30 bp, Homo sapiens; identical to SEQ ID NO: 77245
  misc_feature 1..30: note = chr14:93101791-93101821
  misc_feature 1..30: note = Hypo
  source 1..30: mol_type = genomic DNA

SEQ ID NO: 110023 - DNA, 107 bp, Homo sapiens; identical to SEQ ID NO: 77246
  misc_feature 1..107: note = chr14:93107944-93108051
  misc_feature 1..107: note = Hypo
  source 1..107: mol_type = genomic DNA

SEQ ID NO: 110024 - DNA, 30 bp, Homo sapiens; identical to SEQ ID NO: 77247
  misc_feature 1..30: note = chr14:93109368-93109398
  misc_feature 1..30: note = Hypo
  source 1..30: mol_type = genomic DNA

SEQ ID NO: 110025 - DNA, 79 bp, Homo sapiens; identical to SEQ ID NO: 44082
  misc_feature 1..79: note = chr14:93151456-93151535
  misc_feature 1..79: note = Hypo
  source 1..79: mol_type = genomic DNA

SEQ ID NO: 110026 - DNA, 395 bp, Homo sapiens; identical to SEQ ID NO: 77249
  misc_feature 1..395: note = chr14:93154887-93155282
  misc_feature 1..395: note = Hypo
  source 1..395: mol_type = genomic DNA

SEQ ID NO: 110027 - DNA, 35 bp, Homo sapiens; identical to SEQ ID NO: 77250
  misc_feature 1..35: note = chr14:93379041-93379076
  misc_feature 1..35: note = Hypo
  source 1..35: mol_type = genomic DNA

SEQ ID NO: 110028 - DNA, 873 bp, Homo sapiens
  misc_feature 1..873: note = chr14:93389262-93390135
  misc_feature 1..873: note = Hyper
  source 1..873: mol_type = genomic DNA
tcagccacagccccccgcctcccacgccacctcttggaaaccagatacccgcctcgcggccaagacccaccagctccaagcggcggaggccagaggtagcgaggggtgaggttagaggtgggggcgagcggggactggacacctggggagtggggaaaggggaagggggcggcaccgctgacgtcatttccggggtcggggtatataagcggggcgcgagggcgctgctgctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaaggtgagcgagcgcggggagctcgcgggagagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccacaagacacttgggcctgactcccaaccccccggggcaactcccccttgtgcccaccccttgtctgggcttggcgcctcggttgcatcagggccagtgccggttgcgcggtggccggccaaggtcactgcggggaggtgggagcatggctgctcgcaaccctccacccctcttcccctttcatctcacgctccccgcctttc

SEQ ID NO: 110029 - DNA, 30 bp, Homo sapiens; identical to SEQ ID NO: 77254
  misc_feature 1..30: note = chr14:93425612-93425642
  misc_feature 1..30: note = Hypo
  source 1..30: mol_type = genomic DNA

SEQ ID NO: 110030 - DNA, 30 bp, Homo sapiens; identical to SEQ ID NO: 44084
  misc_feature 1..30: note = chr14:93454054-93454084
  misc_feature 1..30: note = Hypo
  source 1..30: mol_type = genomic DNA

SEQ ID NO: 110031 - DNA, 37 bp, Homo sapiens; identical to SEQ ID NO: 15855
  misc_feature 1..37: note = chr14:93697020-93697057
  misc_feature 1..37: note = Hypo
  source 1..37: mol_type = genomic DNA

SEQ ID NO: 110032 - DNA, 159 bp, Homo sapiens; identical to SEQ ID NO: 77257
  misc_feature 1..159: note = chr14:93706719-93706878
  misc_feature 1..159: note = Hypo
  source 1..159: mol_type = genomic DNA

SEQ ID NO: 110033 - DNA, 506 bp, Homo sapiens; identical to SEQ ID NO: 77258
  misc_feature 1..506: note = chr14:93897125-93897631
  misc_feature 1..506: note = Hyper
  source 1..506: mol_type = genomic DNA

SEQ ID NO: 110034 - DNA, 35 bp, Homo sapiens; identical to SEQ ID NO: 77259
  misc_feature 1..35: note = chr14:94222874-94222909
  misc_feature 1..35: note = Hypo
  source 1..35: mol_type = genomic DNA

SEQ ID NO: 110035 - DNA, 36 bp, Homo sapiens; identical to SEQ ID NO: 77260
  misc_feature 1..36: note = chr14:94226375-94226411
  misc_feature 1..36: note = Hyper
  source 1..36: mol_type = genomic DNA

SEQ ID NO: 110036 - DNA, 1421 bp, Homo sapiens
  misc_feature 1..1421: note = chr14:94254294-94255715
  misc_feature 1..1421: note = Hyper
  source 1..1421: mol_type = genomic DNA
acatccccagagccccgcgtgtacactttagctccgcgcacagctccagaatactgcgtgcataccttggccccatggacacctccagaaacagccaagcacacttactgcgccccattaacccccatacaactcactctcactgtgagcacacttcaaacccggcgggcactactcacctgcgcgcacaaccacagaaacagccgtgcacacacactgatccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagtttgcgcgccggttgggcctcccgggccgctgagcagaggaccaggagcggcgtcctcgcacggggcgcagggcgcggtggctccggactgcgcctagccgcgcgcggggcgggaggggcggcaccccgctcccagggccagggctggccgccgaggcggaggcagagggcggggaaagtctcctccacgccgcctggagccggccgcgcgagccctccccgggcccgcgttggctccccgcctttcctggtggcgccgcgcggctgcccggggcactggggtgcccgagctctctactaccctcacgctggcccgcgagaggcagcggcgggaggcgccggcagggagctcccgctggggcagcaaagccgtgggtggaggcgaaataaataatccacgaaaaaggaaaacagacgtgagccgagccagagcctctcccgcctcccgcccggggttgcgctccccccgccgccgccgccagcgccgctgcagtgattcctcgtctccatctagcgaggctattgtgtattgggcgcttaattatttattcaccctggaggccgaggattcccacttccatggggttttggcccttgcctgcgcttcccccaagcctctcccgaggctgcggaaaggtggcgaggactgacttgagacccttttttgcgctccatccttgaggactctccccgccgcactccccgcaggctctcccgggcgccggggctgaaaggtg

SEQ ID NO: 110037 - DNA, 39 bp, Homo sapiens; identical to SEQ ID NO: 77265
  misc_feature 1..39: note = chr14:94393706-94393745
  misc_feature 1..39: note = Hypo
  source 1..39: mol_type = genomic DNA

SEQ ID NO: 110038 - DNA, 106 bp, Homo sapiens; identical to SEQ ID NO: 77266
  misc_feature 1..106: note = chr14:94394699-94394805
  misc_feature 1..106: note = Hypo
  source 1..106: mol_type = genomic DNA

SEQ ID NO: 110039 - DNA, 30 bp, Homo sapiens; identical to SEQ ID NO: 77267
  misc_feature 1..30: note = chr14:94404198-94404228
  misc_feature 1..30: note = Hypo
  source 1..30: mol_type = genomic DNA

SEQ ID NO: 110040 - DNA, 396 bp, Homo sapiens; identical to SEQ ID NO: 77268
  misc_feature 1..396: note = chr14:94405641-94406037
  misc_feature 1..396: note = Hyper
  source 1..396: mol_type = genomic DNA

SEQ ID NO: 110041 - DNA, 284 bp, Homo sapiens; identical to SEQ ID NO: 77269
  misc_feature 1..284: note = chr14:94641377-94641661
  misc_feature 1..284: note = Hyper
  source 1..284: mol_type = genomic DNA

SEQ ID NO: 110042 - DNA, 30 bp, Homo sapiens; identical to SEQ ID NO: 77270
  misc_feature 1..30: note = chr14:94890121-94890151
  misc_feature 1..30: note = Hyper
  source 1..30: mol_type = genomic DNA

SEQ ID NO: 110043 - DNA, 40 bp, Homo sapiens; identical to SEQ ID NO: 77271
  misc_feature 1..40: note = chr14:94953764-94953804
  misc_feature 1..40: note = Hypo
  source 1..40: mol_type = genomic DNA

SEQ ID NO: 110044 - DNA, 30 bp, Homo sapiens; identical to SEQ ID NO: 44087
  misc_feature 1..30: note = chr14:95200361-95200391
  misc_feature 1..30: note = Hypo
  source 1..30: mol_type = genomic DNA

SEQ ID NO: 110045 - DNA, 70 bp, Homo sapiens; identical to SEQ ID NO: 77273
  misc_feature 1..70: note = chr14:95233491-95233561
  misc_feature 1..70: note = Hyper
  source 1..70: mol_type = genomic DNA

SEQ ID NO: 110046 - DNA, 30 bp, Homo sapiens; identical to SEQ ID NO: 35492
  misc_feature 1..30: note = chr14:95234025-95234055
  misc_feature 1..30: note = Hyper
  source 1..30: mol_type = genomic DNA

SEQ ID NO: 110047 - DNA, 1155 bp, Homo sapiens
  misc_feature 1..1155: note = chr14:95234540-95235695
  misc_feature 1..1155: note = Hyper
  source 1..1155: mol_type = genomic DNA
atacagaatgtggcccgtctacatcgccatcactttattgtactgtcacccttaatttaactataaatactacggtgggggctagtcgcgggcggcctcgggctgctgggctgtgcgcgccctgaccccagacgccgaccctcccggctctgtacactatttacagctcctcgttcctctttctcgaccccctcccgcaaggcagcgcgtgtgcaagaaagtagcatcgtctgtctgtgcaagtccttcgagttaggtaagtaatacgggcaagtgtcccgcggccgtcagctgtccgagtccaaatcgcttttaccttcctcttccctcttctccggtgacgccttcgacgacgacgtcttgttccacttctccgcgttctccgactcctctgatgaggaccgcttctgccgcctccatttggcgcggcggttcttaaaccagacctgttgcgcaacggaggacaaaacagttcagatcaaaggcgcgcttcccccagtcccggggcacccggggagcttggtgtggcggcgggacaccccgcgcaggccaacaaaaggaggggagccgctcgctcccgcttccgcgttttcattcaacttcctgggcctaaagcgccctccagcagcctgcgggccgccatcgggatgtttttaaagtgcggggagagccaagcagggctgggcaaacccgactggggccccacctcgcggggaaggaccgctaggcgcccacggcaggccccggcgcctacctccactttctcctcgcggaggtgcactttccgggccagctgctcgcgcgtgcccacgtccgggtacttggtctcctggaagaggttctcgagagcttcgagctgctcgtcagtgaagatggtgcggtgccgccgcttccgccgacagtgcagctggttgagaagctgcagctcggtgcgcgacagcgtgcccacgttcatgtagggcagcatctggtgcggtaccggggacaccagcaccgaaccggggccctcgtagcctgcgacagagtggggcgcacggtcagccgcccgccctcgccaccgcacgcatgcacgcccgccagcccccgaccctcttccacttagaagtcgtctgcaaggggatgctgagaattgggggtgcacgggaatcaggggtg

SEQ ID NO: 110048 - DNA, 476 bp, Homo sapiens; identical to SEQ ID NO: 77278
  misc_feature 1..476: note = chr14:95236030-95236506
  misc_feature 1..476: note = Hyper
  source 1..476: mol_type = genomic DNA

SEQ ID NO: 110049 - DNA, 125 bp, Homo sapiens; identical to SEQ ID NO: 35497
  misc_feature 1..125: note = chr14:95237011-95237136
  misc_feature 1..125: note = Hyper
  source 1..125: mol_type = genomic DNA

SEQ ID NO: 110050 - DNA, 55 bp, Homo sapiens; identical to SEQ ID NO: 35498
  misc_feature 1..55: note = chr14:95237867-95237922
  misc_feature 1..55: note = Hyper
  source 1..55: mol_type = genomic DNA

SEQ ID NO: 110051 - DNA, 30 bp, Homo sapiens; identical to SEQ ID NO: 77281
  misc_feature 1..30: note = chr14:95238321-95238351
  misc_feature 1..30: note = Hyper
  source 1..30: mol_type = genomic DNA

SEQ ID NO: 110052 - DNA, 847 bp, Homo sapiens
  misc_feature 1..847: note = chr14:95239334-95240181
  misc_feature 1..847: note = Hyper
  source 1..847: mol_type = genomic DNA
ctccagacactctgccggagctctaggggagctcacccctgcgcggcgggacctcccccatcgggttgccccttcaatctgcagccgcgcggaggcaggccccgggaaaggcagtcggcgctcggtgctcgcactgcgcctcggcgggcggaaactcacaagtgtcctcaacgtgctaaacaaaccatcagggccccgcatcgcctggcgcaattggaataacaaatgcgacgcacgcaaattgtccacctcgtgttgctaagcgattgtttgtcggccccgcacgcacagctcagcatgggaggaccgcgagcgtccagaggcagccggcgagcgcttaggtcggaaatgcagtaaacatgccgctgattttccctattatcacccaaacacgatttcacacaaagcaatcaccacgcagaagtctatgaaaatgtgtttgttgaggagtcactcgccccagtaatagtcctcatttttaagatattaaagaatagctcagcggattccacatgcataaggtctatttgccgttcggcatctgtcacggcgcttttgcactgcggtcatcactaaattgattcatagagtgtagattaaattgcttctctgatttaaaacagtgtccaactttggagtatgcgtgtgagtatcttctcccgccccaaggtatttttgtcagggagaaaactgtcgccccactatccttacaccccattccgcataactgtaaaaaaataatgcatcttcgaccccaacttcttacggttcgtttcaggaactttcttaattctctccgtctcctgcccggccacagagcagagttcacaatcggatgcgtttaagt

SEQ ID NO: 110053 - DNA, 30 bp, Homo sapiens; identical to SEQ ID NO: 12023
  misc_feature 1..30: note = chr14:95240484-95240514
  misc_feature 1..30: note = Hyper
  source 1..30: mol_type = genomic DNA

SEQ ID NO: 110054 - DNA, 30 bp, Homo sapiens; identical to SEQ ID NO: 77285
  misc_feature 1..30: note = chr14:95313261-95313291
  misc_feature 1..30: note = Hypo
  source 1..30: mol_type = genomic DNA

SEQ ID NO: 110055 - DNA, 30 bp, Homo sapiens; identical to SEQ ID NO: 77286
  misc_feature 1..30: note = chr14:95461950-95461980
  misc_feature 1..30: note = Hypo
  source 1..30: mol_type = genomic DNA

SEQ ID NO: 110056 - DNA, 55 bp, Homo sapiens; identical to SEQ ID NO: 44088
  misc_feature 1..55: note = chr14:95522889-95522944
  misc_feature 1..55: note = Hypo
  source 1..55: mol_type = genomic DNA

SEQ ID NO: 110057 - DNA, 30 bp, Homo sapiens; identical to SEQ ID NO: 77288
  misc_feature 1..30: note = chr14:95897683-95897713
  misc_feature 1..30: note = Hypo
  source 1..30: mol_type = genomic DNA

SEQ ID NO: 110058 - DNA, 30 bp, Homo sapiens; identical to SEQ ID NO: 77289
  misc_feature 1..30: note = chr14:95899653-95899683
  misc_feature 1..30: note = Hypo
  source 1..30: mol_type = genomic DNA

SEQ ID NO: 110059 - DNA, 72 bp, Homo sapiens; identical to SEQ ID NO: 77290
  misc_feature 1..72: note = chr14:95906284-95906356
  misc_feature 1..72: note = Hypo
  source 1..72: mol_type = genomic DNA

SEQ ID NO: 110060 - DNA, 130 bp, Homo sapiens; identical to SEQ ID NO: 77291
  misc_feature 1..130: note = chr14:95922717-95922847
  misc_feature 1..130: note = Hypo
  source 1..130: mol_type = genomic DNA

SEQ ID NO: 110061 - DNA, 143 bp, Homo sapiens; identical to SEQ ID NO: 77292
  misc_feature 1..143: note = chr14:95927934-95928077
  misc_feature 1..143: note = Hypo
  source 1..143: mol_type = genomic DNA

SEQ ID NO: 110062 - DNA, 98 bp, Homo sapiens
  misc_feature 1..98: note = chr14:96342281-96342379
  misc_feature 1..98: note = Hyper
  source 1..98: mol_type = genomic DNA
gcccaaagccacattcgccacgctcccgccggggcgggctcaccgcgcgcctctgggtgccgagcctccacaggccacatagccgccacctgctgctg

SEQ ID NO: 110063 - DNA, 1195 bp, Homo sapiens
  misc_feature 1..1195: note = chr14:96342590-96343785
  misc_feature 1..1195: note = Hyper
  source 1..1195: mol_type = genomic DNA
tgccgcagcccggctcgcagcgcgcgtcagcgggggctccccggagcgagtcgctaggtaacggggctggctccgcagacgcggggccggggaagcccgcgcgcgtcatcagcagcggcgccgcggggcggggggcgcagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggtgcgcactgctgtgcttgcggccgggtgggcgccccgccgctgcggtcgcggtcgccgctggtaagctgcgctctggggcttggggcaggaagcagtggggggcgctcgaagagcagggcagctacggccaccgtggccgccggaccggccatgtgctaaagtttctggggctcggcgccccgctgggcgcgcagcgcggggagcagacgcgccgtgggtggggcagcgcggtgctgctggcgcccggcccccgcggggtgcagctctgcgcgttctcatgctgtctctctctctttccctccgcgctgcctctccgaggtcctcccgccgagccccggcgcggggcatgaggagcccccgggtgccgcccagagaccagcaggctgcgcgcacacctagccagcggcagacggggacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggtaagccaggccctccgcctcgcgaacaaagctcccttcgcagggcccggaggccgcctcagggcccctgtcctaccctccttccccacttacagcctggaaacattcggggcttccgattgaatcgttcaatttcccctgccccgaagccccgcctggaggctgaactgcccgggcagacctggtgctttcttctgccttctggagaaagatgtgggtttgacatgcaggcgggagacctgtctggtctagataacggcatgtgtatgca

SEQ ID NO: 110064 - DNA, 353 bp, Homo sapiens; identical to SEQ ID NO: 77298
  misc_feature 1..353: note = chr14:96505338-96505691
  misc_feature 1..353: note = Hyper
  source 1..353: mol_type = genomic DNA

SEQ ID NO: 110065 - DNA, 153 bp, Homo sapiens; identical to SEQ ID NO: 35507
  misc_feature 1..153: note = chr14:96505900-96506053
  misc_feature 1..153: note = Hyper
  source 1..153: mol_type = genomic DNA

SEQ ID NO: 110066 - DNA, 177 bp, Homo sapiens; identical to SEQ ID NO: 77300
  misc_feature 1..177: note = chr14:96506343-96506520
  misc_feature 1..177: note = Hyper
  source 1..177: mol_type = genomic DNA

SEQ ID NO: 110067 - DNA, 30 bp, Homo sapiens; identical to SEQ ID NO: 77301
  misc_feature 1..30: note = chr14:96671088-96671118
  misc_feature 1..30: note = Hyper
  source 1..30: mol_type = genomic DNA

SEQ ID NO: 110068 - DNA, 39 bp, Homo sapiens; identical to SEQ ID NO: 44091
  misc_feature 1..39: note = chr14:96967321-96967360
  misc_feature 1..39: note = Hypo
  source 1..39: mol_type = genomic DNA

SEQ ID NO: 110069 - DNA, 30 bp, Homo sapiens; identical to SEQ ID NO: 44092
  misc_feature 1..30: note = chr14:97045401-97045431
  misc_feature 1..30: note = Hypo
  source 1..30: mol_type = genomic DNA

SEQ ID NO: 110070 - DNA, 307 bp, Homo sapiens
  misc_feature 1..307: note = chr14:97058822-97059129
  misc_feature 1..307: note = Hyper
  source 1..307: mol_type = genomic DNA
gacttatgagatgggcgactctaggaccctcattttccagacgagaaaacggaggcacctgcaggttcagtgacttgcccaaggtcacgcacctggtcagcggcagagacaggactccccccgcccgggcccgcggattgccgggtcggttctcagtcaccgcacaggtgccctggagagtgcgaccaccccctgccctccgccccgcgccggccctcggctcagtgccccgcccttcctggagcacggcctgcgcatgcgcgcgccccagggcccagccctgttcctgctccggctcctgcgggga

SEQ ID NO: 110071 - DNA, 30 bp, Homo sapiens; identical to SEQ ID NO: 77305
  misc_feature 1..30: note = chr14:97081601-97081631
  misc_feature 1..30: note = Hypo
  source 1..30: mol_type = genomic DNA

SEQ ID NO: 110072 - DNA, 184 bp, Homo sapiens; identical to SEQ ID NO: 77306
  misc_feature 1..184: note = chr14:97129784-97129968
  misc_feature 1..184: note = Hypo
  source 1..184: mol_type = genomic DNA

SEQ ID NO: 110073 - DNA, 109 bp, Homo sapiens; identical to SEQ ID NO: 44093
  misc_feature 1..109: note = chr14:97188235-97188344
  misc_feature 1..109: note = Hypo
  source 1..109: mol_type = genomic DNA

SEQ ID NO: 110074 - DNA, 224 bp, Homo sapiens; identical to SEQ ID NO: 77308
  misc_feature 1..224: note = chr14:97262648-97262872
  misc_feature 1..224: note = Hypo
  source 1..224: mol_type = genomic DNA

SEQ ID NO: 110075 - DNA, 140 bp, Homo sapiens; identical to SEQ ID NO: 77309
  misc_feature 1..140: note = chr14:97411536-97411676
  misc_feature 1..140: note = Hypo
  source 1..140: mol_type = genomic DNA

SEQ ID NO: 110076 - DNA, 42 bp, Homo sapiens; identical to SEQ ID NO: 77310
  misc_feature 1..42: note = chr14:97431047-97431089
  misc_feature 1..42: note = Hypo
  source 1..42: mol_type = genomic DNA

SEQ ID NO: 110077 - DNA, 677 bp, Homo sapiens
  misc_feature 1..677: note = chr14:97499277-97499954
  misc_feature 1..677: note = Hyper
  source 1..677: mol_type = genomic DNA
atgggtctgggagtccgaaggctcgcggaggagagtgtgatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggttgggggtgacccctgcagcccctcatgtgcgaatccaggttctcctcccctccaggctgcttcctgcacagcagcaccgagcagcagccacctcagggccagggagcccgagctgcgggatccgccgccccggggccgcagcagcttcagctccttggcgtctgcgccggggtcctcgcggccgccgcgaaccgctccttcagtttcgctatgcggagcgggcgcgggaccccagcaggtgagggcccagggcaggtgccttccctcgccccggctcccgccccagctcctggccggcccagcgcgtcctgctcccgctctcgccgtgctctcggcgctgcatgtccccggggcgcggcgcagcagctggtgccgcggtgggcatctgttcggcctcctctgtccccacgcgtgacctgatcgctgcgacagcggaatcccacggtgcaggcccaga

SEQ ID NO: 110078 - DNA, 170 bp, Homo sapiens; identical to SEQ ID NO: 77313
  misc_feature 1..170: note = chr14:97524036-97524206
  misc_feature 1..170: note = Hypo
  source 1..170: mol_type = genomic DNA

SEQ ID NO: 110079 - DNA, 30 bp, Homo sapiens; identical to SEQ ID NO: 77314
  misc_feature 1..30: note = chr14:97673679-97673709
  misc_feature 1..30: note = Hypo
  source 1..30: mol_type = genomic DNA

SEQ ID NO: 110080 - DNA, 1043 bp, Homo sapiens
  misc_feature 1..1043: note = chr14:97684916-97685959
  misc_feature 1..1043: note = Hyper
  source 1..1043: mol_type = genomic DNA
tgggggaggagggtccgaaaggaaaggctggtgggggggtggggggaagggccccagtgacgactggattcggaattttcctctcacttcgtggtagtgaagaatttaactacaacagtaacaacactaataattctaaaagccgtgggaggtcagagcgggcgctgcccggcgtcacccctgcagcgtccggatcgctccgcataggcaggggtggtgccccctccccggggcacagaaacgccacatcccgggggcgccgcccagaggctgtctctgtttctgtgtcccttcatgaggctctgtcccacaaaggcagcctgagccaggaccctaaagaggcctggtcatcgggaccggagggagttccgcttcccaggccggctctgcaaacgcgagcctgcgccaaggcgccctgcgggtttgctggtggcatcgaggggcagcgcggggccagcgctgggagctccgaacccacacgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggtatttttttcatctgccgtgtgtttagctgaattcagtatatttttctcgcacttctcgcttttttttttttctttctgaatctgctcttctgctttgcgggcccctaatctctcccgaatctcgggcgcccggcccggcccaggcgagcgctcgcggttggggacgcgggtggggacgcggcggtctgggcgctgcaggatgcgcctggccgcggaggagacgaccagggagcgggtcgccagatcaagatc

SEQ ID NO: 110081 - DNA, 75 bp, Homo sapiens; identical to SEQ ID NO: 77317
  misc_feature 1..75: note = chr14:97708952-97709027
  misc_feature 1..75: note = Hypo
  source 1..75: mol_type = genomic DNA

SEQ ID NO: 110082 - DNA, 199 bp, Homo sapiens; identical to SEQ ID NO: 77318
  misc_feature 1..199: note = chr14:97791325-97791524
  misc_feature 1..199: note = Hypo
  source 1..199: mol_type = genomic DNA

SEQ ID NO: 110083 - DNA, 35 bp, Homo sapiens; identical to SEQ ID NO: 77319
  misc_feature 1..35: note = chr14:97900295-97900330
  misc_feature 1..35: note = Hypo
  source 1..35: mol_type = genomic DNA

SEQ ID NO: 110084 - DNA, 123 bp, Homo sapiens; identical to SEQ ID NO: 77320
  misc_feature 1..123: note = chr14:98967846-98967969
  misc_feature 1..123: note = Hypo
  source 1..123: mol_type = genomic DNA

SEQ ID NO: 110085 - DNA, 30 bp, Homo sapiens; identical to SEQ ID NO: 77321
  misc_feature 1..30: note = chr14:99529159-99529189
  misc_feature 1..30: note = Hypo
  source 1..30: mol_type = genomic DNA

SEQ ID NO: 110086 - DNA, 96 bp, Homo sapiens; identical to SEQ ID NO: 77322
  misc_feature 1..96: note = chr14:99532931-99533027
  misc_feature 1..96: note = Hypo
  source 1..96: mol_type = genomic DNA

SEQ ID NO: 110087 - DNA, 170 bp, Homo sapiens; identical to SEQ ID NO: 35514
  misc_feature 1..170: note = chr14:99584575-99584745
  misc_feature 1..170: note = Hyper
  source 1..170: mol_type = genomic DNA

SEQ ID NO: 110088 - DNA, 30 bp, Homo sapiens; identical to SEQ ID NO: 77324
  misc_feature 1..30: note = chr14:99594536-99594566
  misc_feature 1..30: note = Hypo
  source 1..30: mol_type = genomic DNA

SEQ ID NO: 110089 - DNA, 30 bp, Homo sapiens; identical to SEQ ID NO: 44096
  misc_feature 1..30: note = chr14:99615561-99615591
  misc_feature 1..30: note = Hypo
  source 1..30: mol_type = genomic DNA

SEQ ID NO: 110090 - DNA, 42 bp, Homo sapiens; identical to SEQ ID NO: 77326
  misc_feature 1..42: note = chr14:99626459-99626501
  misc_feature 1..42: note = Hypo
  source 1..42: mol_type = genomic DNA

SEQ ID NO: 110091 - DNA, 40 bp, Homo sapiens; identical to SEQ ID NO: 77327
  misc_feature 1..40: note = chr14:99640421-99640461
  misc_feature 1..40: note = Hypo
  source 1..40: mol_type = genomic DNA

SEQ ID NO: 110092 - DNA, 30 bp, Homo sapiens; identical to SEQ ID NO: 77328
  misc_feature 1..30: note = chr14:99698209-99698239
  misc_feature 1..30: note = Hyper
  source 1..30: mol_type = genomic DNA

SEQ ID NO: 110093 - DNA, 58 bp, Homo sapiens; identical to SEQ ID NO: 77329
  misc_feature 1..58: note = chr14:99713206-99713264
  misc_feature 1..58: note = Hyper
  source 1..58: mol_type = genomic DNA

SEQ ID NO: 110094 - DNA, 98 bp, Homo sapiens; identical to SEQ ID NO: 77330
  misc_feature 1..98: note = chr14:99736115-99736213
  misc_feature 1..98: note = Hyper
  source 1..98: mol_type = genomic DNA

SEQ ID NO: 110095 - DNA, 158 bp, Homo sapiens; identical to SEQ ID NO: 77331
  misc_feature 1..158: note = chr14:99736273-99736431
  misc_feature 1..158: note = Hyper
  source 1..158: mol_type = genomic DNA

SEQ ID NO: 110096 - DNA, 82 bp, Homo sapiens; identical to SEQ ID NO: 77332
  misc_feature 1..82: note = chr14:99736980-99737062
  misc_feature 1..82: note = Hyper
  source 1..82: mol_type = genomic DNA

SEQ ID NO: 110097 - DNA, 385 bp, Homo sapiens; identical to SEQ ID NO: 77333
  misc_feature 1..385: note = chr14:99738148-99738533
  misc_feature 1..385: note = Hyper
  source 1..385: mol_type = genomic DNA

SEQ ID NO: 110098 - DNA, 70 bp, Homo sapiens; identical to SEQ ID NO: 35520
  misc_feature 1..70: note = chr14:99739091-99739161
  misc_feature 1..70: note = Hyper
  source 1..70: mol_type = genomic DNA

SEQ ID NO: 110099 - DNA, 414 bp, Homo sapiens; identical to SEQ ID NO: 77335
  misc_feature 1..414: note = chr14:99739618-99740032
  misc_feature 1..414: note = Hyper
  source 1..414: mol_type = genomic DNA

SEQ ID NO: 110100 - DNA, 222 bp, Homo sapiens; identical to SEQ ID NO: 77336
  misc_feature 1..222: note = chr14:99740491-99740713
  misc_feature 1..222: note = Hyper
  source 1..222: mol_type = genomic DNA

SEQ ID NO: 110101 - DNA, 30 bp, Homo sapiens; identical to SEQ ID NO: 44098
  misc_feature 1..30: note = chr14:99804005-99804035
  misc_feature 1..30: note = Hypo
  source 1..30: mol_type = genomic DNA

SEQ ID NO: 110102 - DNA, 79 bp, Homo sapiens; identical to SEQ ID NO: 77338
  misc_feature 1..79: note = chr14:99847959-99848038
  misc_feature 1..79: note = Hypo
  source 1..79: mol_type = genomic DNA

SEQ ID NO: 110103 - DNA, 176 bp, Homo sapiens; identical to SEQ ID NO: 77339
  misc_feature 1..176: note = chr14:99849887-99850063
  misc_feature 1..176: note = Hypo
  source 1..176: mol_type = genomic DNA

SEQ ID NO: 110104 - DNA, 30 bp, Homo sapiens; identical to SEQ ID NO: 77340
  misc_feature 1..30: note = chr14:99889404-99889434
  misc_feature 1..30: note = Hypo
  source 1..30: mol_type = genomic DNA

SEQ ID NO: 110105 - DNA, 30 bp, Homo sapiens; identical to SEQ ID NO: 77341
  misc_feature 1..30: note = chr14:99891695-99891725
  misc_feature 1..30: note = Hypo
  source 1..30: mol_type = genomic DNA

SEQ ID NO: 110106 - DNA, 30 bp, Homo sapiens; identical to SEQ ID NO: 77342
  misc_feature 1..30: note = chr14:99891938-99891968
  misc_feature 1..30: note = Hypo
  source 1..30: mol_type = genomic DNA

SEQ ID NO: 110107 - DNA, 85 bp, Homo sapiens; identical to SEQ ID NO: 76240
  misc_feature 1..85: note = chr14:100111198-100111283
  misc_feature 1..85: note = Hyper
  source 1..85: mol_type = genomic DNA

SEQ ID NO: 110108 - DNA, 54 bp, Homo sapiens; identical to SEQ ID NO: 35524
  misc_feature 1..54: note = chr14:100111503-100111557
  misc_feature 1..54: note = Hyper
  source 1..54: mol_type = genomic DNA

SEQ ID NO: 110109 - DNA, 265 bp, Homo sapiens; identical to SEQ ID NO: 76242
  misc_feature 1..265: note = chr14:100111764-100112029
  misc_feature 1..265: note = Hyper
  source 1..265: mol_type = genomic DNA

SEQ ID NO: 110110 - DNA, 483 bp, Homo sapiens; identical to SEQ ID NO: 76243
  misc_feature 1..483: note = chr14:100125656-100126139
  misc_feature 1..483: note = Hyper
  source 1..483: mol_type = genomic DNA

SEQ ID NO: 110111 - DNA, 120 bp, Homo sapiens; identical to SEQ ID NO: 76244
  misc_feature 1..120: note = chr14:100148288-100148408
  misc_feature 1..120: note = Hypo
  source 1..120: mol_type = genomic DNA

SEQ ID NO: 110112 - DNA, 36 bp, Homo sapiens; identical to SEQ ID NO: 44101
  misc_feature 1..36: note = chr14:100209839-100209875
  misc_feature 1..36: note = Hypo
  source 1..36: mol_type = genomic DNA

SEQ ID NO: 110113 - DNA, 30 bp, Homo sapiens; identical to SEQ ID NO: 76246
  misc_feature 1..30: note = chr14:100223391-100223421
  misc_feature 1..30: note = Hypo
  source 1..30: mol_type = genomic DNA

SEQ ID NO: 110114 - DNA, 32 bp, Homo sapiens; identical to SEQ ID NO: 76247
  misc_feature 1..32: note = chr14:100259369-100259401
  misc_feature 1..32: note = Hyper
  source 1..32: mol_type = genomic DNA

SEQ ID NO: 110115 - DNA, 582 bp, Homo sapiens; identical to SEQ ID NO: 76248
  misc_feature 1..582: note = chr14:100259680-100260262
  misc_feature 1..582: note = Hyper
  source 1..582: mol_type = genomic DNA

SEQ ID NO: 110116 - DNA, 30 bp, Homo sapiens; identical to SEQ ID NO: 76249
  misc_feature 1..30: note = chr14:100406078-100406108
  misc_feature 1..30: note = Hypo
  source 1..30: mol_type = genomic DNA

SEQ ID NO: 110117 - DNA, 1528 bp, Homo sapiens
  misc_feature 1..1528: note = chr14:100437443-100438971
  misc_feature 1..1528: note = Hyper
  source 1..1528: mol_type = genomic DNA
agagagggaatcagtcgccggtgacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggccccgcgccttttgtgtcgggctttgaccgccgcgcgcgctcattcacctcagcggccgcgggcggaggggcgcacgcgcgcgcagtcccctcggagggcggtggggcgaacagcaacgcgcgtaccctagctcttggctgctgtgctgagactagcccgcgcgcccgcgcgcctctccctcgaggactcggagccgcccgcgcactcgccaggggccgccgccccgagtctcaggcggacgcgcacgcgttcccgccgcccggaccccagccggctcgccccccgcccccccatcccccggcggcggcccccaggcacgcgcccgcgcacacgccggcccgggcacgcgcccgccaagatggcaggggccggggcccagctgtcagtcgccgccgccgcggcccttccccgcagctagcggccccgacgcccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcctgggaggcagacccccgcgggcaggtgtggccgtgtcccgaccgcgcgaggaccgaagttggcggaagcccctgtgcggtgccttccagcccggaggaggctggcctgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgca

SEQ ID NO: 110118 - DNA, 290 bp, Homo sapiens; identical to SEQ ID NO: 76253
  misc_feature 1..290: note = chr14:100591008-100591298
  misc_feature 1..290: note = Hypo
  source 1..290: mol_type = genomic DNA

SEQ ID NO: 110119 - DNA, 30 bp, Homo sapiens; identical to SEQ ID NO: 76254
  misc_feature 1..30: note = chr14:100597146-100597176
  misc_feature 1..30: note = Hypo
  source 1..30: mol_type = genomic DNA

SEQ ID NO: 110120 - DNA, 30 bp, Homo sapiens; identical to SEQ ID NO: 15860
  misc_feature 1..30: note = chr14:100611919-100611949
  misc_feature 1..30: note = Hypo
  source 1..30: mol_type = genomic DNA

SEQ ID NO: 110121 - DNA, 115 bp, Homo sapiens; identical to SEQ ID NO: 76256
  misc_feature 1..115: note = chr14:100613268-100613383
  misc_feature 1..115: note = Hypo
  source 1..115: mol_type = genomic DNA

SEQ ID NO: 110122 - DNA, 458 bp, Homo sapiens; identical to SEQ ID NO: 76257
  misc_feature 1..458: note = chr14:100625468-100625926
  misc_feature 1..458: note = Hyper
  source 1..458: mol_type = genomic DNA

SEQ ID NO: 110123 - DNA, 99 bp, Homo sapiens
  misc_feature 1..99: note = chr14:100626178-100626277
  misc_feature 1..99: note = Hyper
  source 1..99: mol_type = genomic DNA
ggaccgaggtggccgcgtgccatctgcgcgagtccctgggtccctcgatgcgcgggggcgactgctgccaccgcggcctcccaccggctctgcgcgccc

SEQ ID NO: 110124 - DNA, 92 bp, Homo sapiens; identical to SEQ ID NO: 76258
  misc_feature 1..92: note = chr14:100637026-100637118
  misc_feature 1..92: note = Hypo
  source 1..92: mol_type = genomic DNA

SEQ ID NO: 110125 - DNA, 368 bp, Homo sapiens; identical to SEQ ID NO: 76259
  misc_feature 1..368: note = chr14:100643113-100643481
  misc_feature 1..368: note = Hypo
  source 1..368: mol_type = genomic DNA

SEQ ID NO: 110126 - DNA, 30 bp, Homo sapiens; identical to SEQ ID NO: 76260
  misc_feature 1..30: note = chr14:100644084-100644114
  misc_feature 1..30: note = Hypo
  source 1..30: mol_type = genomic DNA

SEQ ID NO: 110127 - DNA, 297 bp, Homo sapiens; identical to SEQ ID NO: 76261
  misc_feature 1..297: note = chr14:100644399-100644696
  misc_feature 1..297: note = Hypo
  source 1..297: mol_type = genomic DNA

SEQ ID NO: 110128 - DNA, 36 bp, Homo sapiens; identical to SEQ ID NO: 76262
  misc_feature 1..36: note = chr14:100747273-100747309
  misc_feature 1..36: note = Hypo
  source 1..36: mol_type = genomic DNA

SEQ ID NO: 110129 - DNA, 30 bp, Homo sapiens; identical to SEQ ID NO: 76263
  misc_feature 1..30: note = chr14:100749445-100749475
  misc_feature 1..30: note = Hypo
  source 1..30: mol_type = genomic DNA

SEQ ID NO: 110130 - DNA, 35 bp, Homo sapiens; identical to SEQ ID NO: 44108
  misc_feature 1..35: note = chr14:100780162-100780197
  misc_feature 1..35: note = Hypo
  source 1..35: mol_type = genomic DNA

SEQ ID NO: 110131 - DNA, 30 bp, Homo sapiens; identical to SEQ ID NO: 76265
  misc_feature 1..30: note = chr14:100801423-100801453
  misc_feature 1..30: note = Hypo
  source 1..30: mol_type = genomic DNA

SEQ ID NO: 110132 - DNA, 163 bp, Homo sapiens; identical to SEQ ID NO: 76267
  misc_feature 1..163: note = chr14:100843941-100844104
  misc_feature 1..163: note = Hypo
  source 1..163: mol_type = genomic DNA

SEQ ID NO: 110133 - DNA, 104 bp, Homo sapiens; identical to SEQ ID NO: 76266
  misc_feature 1..104: note = chr14:100843537-100843641
  misc_feature 1..104: note = Hypo
  source 1..104: mol_type = genomic DNA

SEQ ID NO: 110134 - DNA, 204 bp, Homo sapiens; identical to SEQ ID NO: 76268
  misc_feature 1..204: note = chr14:100938536-100938740
  misc_feature 1..204: note = Hypo
  source 1..204: mol_type = genomic DNA

SEQ ID NO: 110135 - DNA, 716 bp, Homo sapiens
  misc_feature 1..716: note = chr14:101033457-101034173
  misc_feature 1..716: note = Hyper
  source 1..716: mol_type = genomic DNA
cagagctgggcctgccgcccacacaacgcctcggctcaggctccggaaggaaaacacgggaggggtgttcccaaagtaggggtcagggtgccaggggaagtcgtggaggaagtggcaaatattcaaactggctgatcccaggcctgccgcgcaggtggtcccgtgaagtctaccaaggcttaaagtttggcaccgggagggaggccgcgggggacactccccagaagctgtcgcgggattcccccaaaatggctccaagacgcggctgcctggtccagccgcgaggactccatcccccacccccgccccccagaggcggacacttaaaagctcagagccaggcaactggcagcccgggggctggggcgggtggtggttgggggtggggtggggtcgggggagagagcgccggggcagtgcggaacggcacgaacggaacccggagggtccccggggaccagcgagagtccagggcagggagccagaggggcgctgaggaccgcacaggaccaggcggccccgggtagggggcagcccggccctcagtggcgctagccccagcccccgccgcagcggcccgggccggcggaggagccccgcgcgaggctccccagcgcctcgcggcgcgcacacacgcaccacacacacgcacctggcccgcagccccgccgaggccgcccgcgggccctgggggatgcgctcgggtggagccccct

SEQ ID NO: 110136 - DNA, 59 bp, Homo sapiens; identical to SEQ ID NO: 76270
  misc_feature 1..59: note = chr14:101034412-101034471
  misc_feature 1..59: note = Hyper
  source 1..59: mol_type = genomic DNA

SEQ ID NO: 110137 - DNA, 676 bp, Homo sapiens; identical to SEQ ID NO: 76271
  misc_feature 1..676: note = chr14:101034860-101035536
  misc_feature 1..676: note = Hyper
  source 1..676: mol_type = genomic DNA

SEQ ID NO: 110138 - DNA, 30 bp, Homo sapiens; identical to SEQ ID NO: 76272
  misc_feature 1..30: note = chr14:101038620-101038650
  misc_feature 1..30: note = Hypo
  source 1..30: mol_type = genomic DNA

SEQ ID NO: 110139 - DNA, 30 bp, Homo sapiens; identical to SEQ ID NO: 76273
  misc_feature 1..30: note = chr14:101052393-101052423
  misc_feature 1..30: note = Hypo
  source 1..30: mol_type = genomic DNA

SEQ ID NO: 110140 - DNA, 42 bp, Homo sapiens; identical to SEQ ID NO: 76274
  misc_feature 1..42: note = chr14:101052723-101052765
  misc_feature 1..42: note = Hyper
  source 1..42: mol_type = genomic DNA

SEQ ID NO: 110141 - DNA, 56 bp, Homo sapiens; identical to SEQ ID NO: 76275
  misc_feature 1..56: note = chr14:101121187-101121243
  misc_feature 1..56: note = Hyper
  source 1..56: mol_type = genomic DNA

SEQ ID NO: 110142 - DNA, 30 bp, Homo sapiens; identical to SEQ ID NO: 76276
  misc_feature 1..30: note = chr14:101155496-101155526
  misc_feature 1..30: note = Hypo
  source 1..30: mol_type = genomic DNA

SEQ ID NO: 110143 - DNA, 40 bp, Homo sapiens; identical to SEQ ID NO: 76277
  misc_feature 1..40: note = chr14:101192480-101192520
  misc_feature 1..40: note = Hypo
  source 1..40: mol_type = genomic DNA

SEQ ID NO: 110144 - DNA, 39 bp, Homo sapiens; identical to SEQ ID NO: 76278
  misc_feature 1..39: note = chr14:101192920-101192959
  misc_feature 1..39: note = Hyper
  source 1..39: mol_type = genomic DNA

SEQ ID NO: 110145 - DNA, 404 bp, Homo sapiens
  misc_feature 1..404: note = chr14:101193194-101193598
  misc_feature 1..404: note = Hyper
  source 1..404: mol_type = genomic DNA
gcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggtgagttccccggcggcccggctcgcgccccctctggggaagcctgcgactccccgccggccgcccggtgccccgcacgccccgtctcgtgagccccaactccgcccgtcccgcctagccctaagc

SEQ ID NO: 110146 - DNA, 32 bp, Homo sapiens; identical to SEQ ID NO: 44110
  misc_feature 1..32: note = chr14:101198835-101198867
  misc_feature 1..32: note = Hypo
  source 1..32: mol_type = genomic DNA

SEQ ID NO: 110147 - DNA, 60 bp, Homo sapiens; identical to SEQ ID NO: 76281
  misc_feature 1..60: note = chr14:101199827-101199887
  misc_feature 1..60: note = Hypo
  source 1..60: mol_type = genomic DNA

SEQ ID NO: 110148 - DNA, 186 bp, Homo sapiens; identical to SEQ ID NO: 76282
  misc_feature 1..186: note = chr14:101200566-101200752
  misc_feature 1..186: note = Hypo
  source 1..186: mol_type = genomic DNA

SEQ ID NO: 110149 - DNA, 44 bp, Homo sapiens; identical to SEQ ID NO: 44112
  misc_feature 1..44: note = chr14:101201633-101201677
  misc_feature 1..44: note = Hypo
  source 1..44: mol_type = genomic DNA

SEQ ID NO: 110150 - DNA, 30 bp, Homo sapiens; identical to SEQ ID NO: 76284
  misc_feature 1..30: note = chr14:101244707-101244737
  misc_feature 1..30: note = Hypo
  source 1..30: mol_type = genomic DNA

SEQ ID NO: 110151 - DNA, 248 bp, Homo sapiens; identical to SEQ ID NO: 76285
  misc_feature 1..248: note = chr14:101250082-101250330
  misc_feature 1..248: note = Hypo
  source 1..248: mol_type = genomic DNA

SEQ ID NO: 110152 - DNA, 30 bp, Homo sapiens; identical to SEQ ID NO: 76286
  misc_feature 1..30: note = chr14:101280064-101280094
  misc_feature 1..30: note = Hypo
  source 1..30: mol_type = genomic DNA

SEQ ID NO: 110153 - DNA, 30 bp, Homo sapiens; identical to SEQ ID NO: 76287
  misc_feature 1..30: note = chr14:101301191-101301221
  misc_feature 1..30: note = Hypo
  source 1..30: mol_type = genomic DNA

SEQ ID NO: 110154 - DNA, 70 bp, Homo sapiens; identical to SEQ ID NO: 76288
  misc_feature 1..70: note = chr14:101347653-101347723
  misc_feature 1..70: note = Hypo
  source 1..70: mol_type = genomic DNA

SEQ ID NO: 110155 - DNA, 48 bp, Homo sapiens; identical to SEQ ID NO: 76289
  misc_feature 1..48: note = chr14:101349702-101349750
  misc_feature 1..48: note = Hypo
  source 1..48: mol_type = genomic DNA

SEQ ID NO: 110156 - DNA, 30 bp, Homo sapiens; identical to SEQ ID NO: 76290
  misc_feature 1..30: note = chr14:101531739-101531769
  misc_feature 1..30: note = Hypo
  source 1..30: mol_type = genomic DNA

SEQ ID NO: 110157 - DNA, 45 bp, Homo sapiens; identical to SEQ ID NO: 76291
  misc_feature 1..45: note = chr14:101532265-101532310
  misc_feature 1..45: note = Hypo
  source 1..45: mol_type = genomic DNA

SEQ ID NO: 110158 - DNA, 34 bp, Homo sapiens; identical to SEQ ID NO: 76292
  misc_feature 1..34: note = chr14:101532812-101532846
  misc_feature 1..34: note = Hypo
  source 1..34: mol_type = genomic DNA

SEQ ID NO: 110159 - DNA, 344 bp, Homo sapiens; identical to SEQ ID NO: 76293
  misc_feature 1..344: note = chr14:101543828-101544172
  misc_feature 1..344: note = Hyper
  source 1..344: mol_type = genomic DNA

SEQ ID NO: 110160 - DNA, 34 bp, Homo sapiens; identical to SEQ ID NO: 76294
  misc_feature 1..34: note = chr14:101576586-101576620
  misc_feature 1..34: note = Hypo
  source 1..34: mol_type = genomic DNA

SEQ ID NO: 110161 - DNA, 105 bp, Homo sapiens; identical to SEQ ID NO: 76295
  misc_feature 1..105: note = chr14:101591942-101592047
  misc_feature 1..105: note = Hypo
  source 1..105: mol_type = genomic DNA

SEQ ID NO: 110162 - DNA, 30 bp, Homo sapiens; identical to SEQ ID NO: 76296
  misc_feature 1..30: note = chr14:101665450-101665480
  misc_feature 1..30: note = Hypo
  source 1..30: mol_type = genomic DNA

SEQ ID NO: 110163 - DNA, 62 bp, Homo sapiens; identical to SEQ ID NO: 76297
  misc_feature 1..62: note = chr14:101694557-101694619
  misc_feature 1..62: note = Hypo
  source 1..62: mol_type = genomic DNA

SEQ ID NO: 110164 - DNA, 173 bp, Homo sapiens; identical to SEQ ID NO: 76298
  misc_feature 1..173: note = chr14:101713576-101713749
  misc_feature 1..173: note = Hypo
  source 1..173: mol_type = genomic DNA

SEQ ID NO: 110165 - DNA, 30 bp, Homo sapiens; identical to SEQ ID NO: 76299
  misc_feature 1..30: note = chr14:101797233-101797263
  misc_feature 1..30: note = Hypo
  source 1..30: mol_type = genomic DNA

SEQ ID NO: 110166 - DNA, 30 bp, Homo sapiens; identical to SEQ ID NO: 76300
  misc_feature 1..30: note = chr14:101864688-101864718
  misc_feature 1..30: note = Hypo
  source 1..30: mol_type = genomic DNA

SEQ ID NO: 110167 - DNA, 30 bp, Homo sapiens; identical to SEQ ID NO: 76301
  misc_feature 1..30: note = chr14:101908354-101908384
  misc_feature 1..30: note = Hypo
  source 1..30: mol_type = genomic DNA

SEQ ID NO: 110168 - DNA, 103 bp, Homo sapiens; identical to SEQ ID NO: 76302
  misc_feature 1..103: note = chr14:101915704-101915807
  misc_feature 1..103: note = Hypo
  source 1..103: mol_type = genomic DNA

SEQ ID NO: 110169 - DNA, 190 bp, Homo sapiens; identical to SEQ ID NO: 76303
  misc_feature 1..190: note = chr14:101923096-101923286
  misc_feature 1..190: note = Hyper
  source 1..190: mol_type = genomic DNA

SEQ ID NO: 110170 - DNA, 1058 bp, Homo sapiens
  misc_feature 1..1058: note = chr14:101923521-101924579
  misc_feature 1..1058: note = Hyper
  source 1..1058: mol_type = genomic DNA
aagaggagagaaaggcgaggcacagtgggtgcgcaaagaaaaagaggttctcagcggagcgtgtgtgaggcggggggttacgggggaggggagacggggcgggtgtgaagtctgtgccgggaaaagaaaaatatgagtgttctcttttgtgtgcgcacaaacagccgagcgcggggaggtcgggcccggggtcacgcggctccgggctgcagctgccgccgtggggcggggggtcccaggcggccaccgggcgtcgcggccgcctgcggcatcagcattccggcggcgcgggcggccgctgtcctcgcgcgaccccagcccgtccagagcgcgccccggcaccgaccctcggggcgaggcgagcgcagcccccgctggccaacaaggtaagcgcggcgcggggagcggtggccgggagcctgggcgccaggcgacccctcgacagggcgcacggaccggttctccgccgcgcgggtcgatgaccgacggggaggcccgagtctggccccgacgccctggcccggtgtccccgacgcgcctggagcccgggagggaggcgcgggcctggcctgggcccaggaggatggagcccgactcagggccgtctctccccgcttgggggtgctcaggagggcccagggtacctgcgcgggcaccttggcggcgggtcaccctccctccgagccactccgtccgtgggcagcggccttaccaggtccgagccggacgctcagcgttgccctccgcgagcccccagcctcccctcgagcgccgcgggagccccaggtgcacacacgcaggcctgggccgggcctccaggcctctgtccttcgggcgggctgggaggtggcctggcgatgcccgccgaggggtggagagggcgaagccagggcggcgtcggcgaggccatcaaaggccgggggtggcggcccgccgcgttgcccatgaccaggccgagggcatgaaaggatctttatcctccagtgacattgccaggccggcgcttttctgcggcctccccctcccgcggccctaattggggccggctgctaatgtga

SEQ ID NO: 110171 - DNA, 1150 bp, Homo sapiens
  misc_feature 1..1150: note = chr14:101924858-101926008
  misc_feature 1..1150: note = Hyper
  source 1..1150: mol_type = genomic DNA
ggggccctccccctccggtgcccggcgctggcggggcccagccacgggggcgggctgggggtgccaggctttgggggtctggagggcctgaagcaggtcgcgttgggggtctcactacctaagacagtgactcaggacagtgggacctgggtgctgtgctgcggccaggcagagcctgcgacccgcggcgccccccgcggcctcggcgacagcccggttcccacgtcggcgacggcgtgggtggtcccgcccgcccgggagggctccgagtcttggccgcccggggcgcggggcctgagagcgagtgtctgcgccgcgctgcccgccgcgccagtttccgaggtcgcccgcgggctcatgccctgcgccctggggccccggggaccttctccaagccggcctgacctggtggaggctgtgcgctgcgctcggggaaggccgggctggtgccgggggcagcgggtcccagctctgaagtgccagcgccggcgccccactccccgcctgctacggtgctctcgcccggaaaggcccgaggccctggaaggagccccgcgggggggcgccgtctggagcagccctcaggggcgccgggctgccgcgacgcagtggctgtaattgcttcggggtacctggggatcgatggcgtggcccagccgggtgtctgcgcctctgaggttgcaaatctggaaccagttaggatgcgggaggcagataataaaaagccaaatgggcgccaggtggaggagtgagctccgcacgttccatcaggtggcccgggccgcgcgctcgggcggcggcagagtctctggggcactcggggcgggcggcagcaggtgggacccgcggcccgacccgcgctagggccgcccaccccctcggaccccggccgggtctctccacagcctccgtgcgcgtcccagaaggaaaatgctagcaaaccggaaggccgcacggggccgagccggcctcagcccggccaggagaggccgtcggtgccccgaggaggaaggggacccggcccgggacggccgccccgcggtacccaggaaggacgcccgccgttcccagcaccccagcgtctgaaaaatgaatgtgaactccgcaagcgtgctcccgcggacattttacatgtcggttgttcacattt

SEQ ID NO: 110172 - DNA, 863 bp, Homo sapiens; identical to SEQ ID NO: 76311
  misc_feature 1..863: note = chr14:102026178-102027041
  misc_feature 1..863: note = Hyper
  source 1..863: mol_type = genomic DNA

SEQ ID NO: 110173 - DNA, 63 bp, Homo sapiens
  misc_feature 1..63: note = chr14:102027383-102027446
  misc_feature 1..63: note = Hyper
  source 1..63: mol_type = genomic DNA
gcggcgcgcgggaagcgaaccggagctccggcgcggctcggcggccgccggggagctcggctc

SEQ ID NO: 110174 - DNA, 30 bp, Homo sapiens; identical to SEQ ID NO: 76312
  misc_feature 1..30: note = chr14:102029131-102029161
  misc_feature 1..30: note = Hyper
  source 1..30: mol_type = genomic DNA

SEQ ID NO: 110175 - DNA, 507 bp, Homo sapiens; identical to SEQ ID NO: 76313
  misc_feature 1..507: note = chr14:102029818-102030325
  misc_feature 1..507: note = Hyper
  source 1..507: mol_type = genomic DNA

SEQ ID NO: 110176 - DNA, 354 bp, Homo sapiens; identical to SEQ ID NO: 76314
  misc_feature 1..354: note = chr14:102030555-102030909
  misc_feature 1..354: note = Hyper
  source 1..354: mol_type = genomic DNA

SEQ ID NO: 110177 - DNA, 98 bp, Homo sapiens
  misc_feature 1..98: note = chr14:102031173-102031271
  misc_feature 1..98: note = Hyper
  source 1..98: mol_type = genomic DNA
acccctacctacctccgcgaacgctccttctcatcccgaaaccgccaggaagcaaaggagatcgcggcagggacgcggcccggcgcctgggagagtcc

SEQ ID NO: 110178 - DNA, 54 bp, Homo sapiens; identical to SEQ ID NO: 76317
  misc_feature 1..54: note = chr14:102031526-102031580
  misc_feature 1..54: note = Hyper
  source 1..54: mol_type = genomic DNA

SEQ ID NO: 110179 - DNA, 30 bp, Homo sapiens
  misc_feature 1..30: note = chr14:102057206-102057236
  misc_feature 1..30: note = Hypo
  source 1..30: mol_type = genomic DNA
gcctggaggcacaggcggtgtgtggacggc

SEQ ID NO: 110180 - DNA, 76 bp, Homo sapiens; identical to SEQ ID NO: 76318
  misc_feature 1..76: note = chr14:102094052-102094128
  misc_feature 1..76: note = Hypo
  source 1..76: mol_type = genomic DNA

SEQ ID NO: 110181 - DNA, 118 bp, Homo sapiens
  misc_feature 1..118: note = chr14:102172320-102172438
  misc_feature 1..118: note = Hyper
  source 1..118: mol_type = genomic DNA
cgcccccagttcccccggtccgccgcggccgggcatggggaggtgaaggcctccgtggggtgacagggggcgcggggccgcttgtccccagcgcaggaggagccgggacccgacgcgc

SEQ ID NO: 110182 - DNA, 542 bp, Homo sapiens; identical to SEQ ID NO: 76319
  misc_feature 1..542: note = chr14:102247672-102248214
  misc_feature 1..542: note = Hyper
  source 1..542: mol_type = genomic DNA

SEQ ID NO: 110183 - DNA, 30 bp, Homo sapiens; identical to SEQ ID NO: 44120
  misc_feature 1..30: note = chr14:102325042-102325072
  misc_feature 1..30: note = Hypo
  source 1..30: mol_type = genomic DNA

SEQ ID NO: 110184 - DNA, 51 bp, Homo sapiens; identical to SEQ ID NO: 15865
  misc_feature 1..51: note = chr14:102335848-102335899
  misc_feature 1..51: note = Hypo
  source 1..51: mol_type = genomic DNA

SEQ ID NO: 110185 - DNA, 30 bp, Homo sapiens; identical to SEQ ID NO: 76322
  misc_feature 1..30: note = chr14:102356167-102356197
  misc_feature 1..30: note = Hypo
  source 1..30: mol_type = genomic DNA

SEQ ID NO: 110186 - DNA, 78 bp, Homo sapiens; identical to SEQ ID NO: 76323
  misc_feature 1..78: note = chr14:102397345-102397423
  misc_feature 1..78: note = Hypo
  source 1..78: mol_type = genomic DNA

SEQ ID NO: 110187 - DNA, 54 bp, Homo sapiens; identical to SEQ ID NO: 76324
  misc_feature 1..54: note = chr14:102399668-102399722
  misc_feature 1..54: note = Hypo
  source 1..54: mol_type = genomic DNA

SEQ ID NO: 110188 - DNA, 141 bp, Homo sapiens; identical to SEQ ID NO: 76325
  misc_feature 1..141: note = chr14:102418526-102418667
  misc_feature 1..141: note = Hypo
  source 1..141: mol_type = genomic DNA

SEQ ID NO: 110189 - DNA, 46 bp, Homo sapiens; identical to SEQ ID NO: 76326
  misc_feature 1..46: note = chr14:102422726-102422772
  misc_feature 1..46: note = Hypo
  source 1..46: mol_type = genomic DNA

SEQ ID NO: 110190 - DNA, 93 bp, Homo sapiens; identical to SEQ ID NO: 76327
  misc_feature 1..93: note = chr14:102467269-102467362
  misc_feature 1..93: note = Hypo
  source 1..93: mol_type = genomic DNA

SEQ ID NO: 110191 - DNA, 30 bp, Homo sapiens; identical to SEQ ID NO: 44123
  misc_feature 1..30: note = chr14:102474565-102474595
  misc_feature 1..30: note = Hypo
  source 1..30: mol_type = genomic DNA

SEQ ID NO: 110192 - DNA, 38 bp, Homo sapiens; identical to SEQ ID NO: 44124
  misc_feature 1..38: note = chr14:102493613-102493651
  misc_feature 1..38: note = Hypo
  source 1..38: mol_type = genomic DNA

SEQ ID NO: 110193 - DNA, 117 bp, Homo sapiens; identical to SEQ ID NO: 76330
  misc_feature 1..117: note = chr14:102500433-102500550
  misc_feature 1..117: note = Hypo
  source 1..117: mol_type = genomic DNA

SEQ ID NO: 110194 - DNA, 156 bp, Homo sapiens; identical to SEQ ID NO: 76331
  misc_feature 1..156: note = chr14:102521602-102521758
  misc_feature 1..156: note = Hypo
  source 1..156: mol_type = genomic DNA

SEQ ID NO: 110195 - DNA, 97 bp, Homo sapiens; identical to SEQ ID NO: 76332
  misc_feature 1..97: note = chr14:102529446-102529543
  misc_feature 1..97: note = Hypo
  source 1..97: mol_type = genomic DNA

SEQ ID NO: 110196 - DNA, 94 bp, Homo sapiens; identical to SEQ ID NO: 76333
  misc_feature 1..94: note = chr14:102529981-102530075
  misc_feature 1..94: note = Hypo
  source 1..94: mol_type = genomic DNA

SEQ ID NO: 110197 - DNA, 81 bp, Homo sapiens; identical to SEQ ID NO: 76334
  misc_feature 1..81: note = chr14:102530479-102530560
  misc_feature 1..81: note = Hypo
  source 1..81: mol_type = genomic DNA

SEQ ID NO: 110198 - DNA, 136 bp, Homo sapiens; identical to SEQ ID NO: 76335
  misc_feature 1..136: note = chr14:102564366-102564502
  misc_feature 1..136: note = Hypo
  source 1..136: mol_type = genomic DNA

SEQ ID NO: 110199 - DNA, 34 bp, Homo sapiens; identical to SEQ ID NO: 76336
  misc_feature 1..34: note = chr14:102593144-102593178
  misc_feature 1..34: note = Hypo
  source 1..34: mol_type = genomic DNA

SEQ ID NO: 110200 - DNA, 30 bp, Homo sapiens; identical to SEQ ID NO: 76337
  misc_feature 1..30: note = chr14:102654008-102654038
  misc_feature 1..30: note = Hypo
  source 1..30: mol_type = genomic DNA

SEQ ID NO: 110201 - DNA, 35 bp, Homo sapiens; identical to SEQ ID NO: 76338
  misc_feature 1..35: note = chr14:102659542-102659577
  misc_feature 1..35: note = Hypo
  source 1..35: mol_type = genomic DNA

SEQ ID NO: 110202 - DNA, 61 bp, Homo sapiens; identical to SEQ ID NO: 44129
  misc_feature 1..61: note = chr14:102673269-102673330
  misc_feature 1..61: note = Hypo
  source 1..61: mol_type = genomic DNA

SEQ ID NO: 110203 - DNA, 180 bp, Homo sapiens; identical to SEQ ID NO: 76340
  misc_feature 1..180: note = chr14:102682077-102682257
  misc_feature 1..180: note = Hypo
  source 1..180: mol_type = genomic DNA

SEQ ID NO: 110204 - DNA, 30 bp, Homo sapiens; identical to SEQ ID NO: 44131
  misc_feature 1..30: note = chr14:102909162-102909192
  misc_feature 1..30: note = Hypo
  source 1..30: mol_type = genomic DNA

SEQ ID NO: 110205 - DNA, 30 bp, Homo sapiens; identical to SEQ ID NO: 76342
  misc_feature 1..30: note = chr14:102948168-102948198
  misc_feature 1..30: note = Hypo
  source 1..30: mol_type = genomic DNA

SEQ ID NO: 110206 - DNA, 30 bp, Homo sapiens; identical to SEQ ID NO: 76343
  misc_feature 1..30: note = chr14:102959193-102959223
  misc_feature 1..30: note = Hypo
  source 1..30: mol_type = genomic DNA

SEQ ID NO: 110207 - DNA, 30 bp, Homo sapiens; identical to SEQ ID NO: 76344
  misc_feature 1..30: note = chr14:102977854-102977884
  misc_feature 1..30: note = Hypo
  source 1..30: mol_type = genomic DNA

SEQ ID NO: 110208 - DNA, 30 bp, Homo sapiens; identical to SEQ ID NO: 76345
  misc_feature 1..30: note = chr14:102983823-102983853
  misc_feature 1..30: note = Hyper
  source 1..30: mol_type = genomic DNA

SEQ ID NO: 110209 - DNA, 161 bp, Homo sapiens; identical to SEQ ID NO: 76346
  misc_feature 1..161: note = chr14:103007079-103007240
  misc_feature 1..161: note = Hypo
  source 1..161: mol_type = genomic DNA

SEQ ID NO: 110210 - DNA, 32 bp, Homo sapiens; identical to SEQ ID NO: 76347
  misc_feature 1..32: note = chr14:103018826-103018858
  misc_feature 1..32: note = Hypo
  source 1..32: mol_type = genomic DNA

SEQ ID NO: 110211 - DNA, 803 bp, Homo sapiens; identical to SEQ ID NO: 76348
  misc_feature 1..803: note = chr14:103021316-103022119
  misc_feature 1..803: note = Hyper
  source 1..803: mol_type = genomic DNA

SEQ ID NO: 110212 - DNA, 133 bp, Homo sapiens; identical to SEQ ID NO: 76349
  misc_feature 1..133: note = chr14:103216392-103216525
  misc_feature 1..133: note = Hypo
  source 1..133: mol_type = genomic DNA

SEQ ID NO: 110213 - DNA, 30 bp, Homo sapiens; identical to SEQ ID NO: 76350
  misc_feature 1..30: note = chr14:103229680-103229710
  misc_feature 1..30: note = Hypo
  source 1..30: mol_type = genomic DNA

SEQ ID NO: 110214 - DNA, 177 bp, Homo sapiens; identical to SEQ ID NO: 44136
  misc_feature 1..177: note = chr14:103277520-103277697
  misc_feature 1..177: note = Hypo
  source 1..177: mol_type = genomic DNA

SEQ ID NO: 110215 - DNA, 171 bp, Homo sapiens; identical to SEQ ID NO: 76352
  misc_feature 1..171: note = chr14:103389118-103389289
  misc_feature 1..171: note = Hyper
  source 1..171: mol_type = genomic DNA

SEQ ID NO: 110216 - DNA, 401 bp, Homo sapiens; identical to SEQ ID NO: 76353
  misc_feature 1..401: note = chr14:103389502-103389903
  misc_feature 1..401: note = Hyper
  source 1..401: mol_type = genomic DNA

SEQ ID NO: 110217 - DNA, 85 bp, Homo sapiens; identical to SEQ ID NO: 76354
  misc_feature 1..85: note = chr14:103390113-103390198
  misc_feature 1..85: note = Hyper
  source 1..85: mol_type = genomic DNA

SEQ ID NO: 110218 - DNA, 776 bp, Homo sapiens
  misc_feature 1..776: note = chr14:103394683-103395459
  misc_feature 1..776: note = Hyper
  source 1..776: mol_type = genomic DNA
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagac

SEQ ID NO: 110219 - DNA, 56 bp, Homo sapiens; identical to SEQ ID NO: 76356
  misc_feature 1..56: note = chr14:103406559-103406615
  misc_feature 1..56: note = Hypo
  source 1..56: mol_type = genomic DNA

SEQ ID NO: 110220 - DNA, 30 bp, Homo sapiens; identical to SEQ ID NO: 76357
  misc_feature 1..30: note = chr14:103416858-103416888
  misc_feature 1..30: note = Hypo
  source 1..30: mol_type = genomic DNA

SEQ ID NO: 110221 - DNA, 42 bp, Homo sapiens; identical to SEQ ID NO: 76358
  misc_feature 1..42: note = chr14:103456666-103456708
  misc_feature 1..42: note = Hypo
  source 1..42: mol_type = genomic DNA

SEQ ID NO: 110222 - DNA, 216 bp, Homo sapiens; identical to SEQ ID NO: 76359
  misc_feature 1..216: note = chr14:103459583-103459799
  misc_feature 1..216: note = Hypo
  source 1..216: mol_type = genomic DNA

SEQ ID NO: 110223 - DNA, 49 bp, Homo sapiens; identical to SEQ ID NO: 76360
  misc_feature 1..49: note = chr14:103477626-103477675
  misc_feature 1..49: note = Hypo
  source 1..49: mol_type = genomic DNA

SEQ ID NO: 110224 - DNA, 22 bp, Homo sapiens
  misc_feature 1..22: note = chr14:103533487-103533509
  misc_feature 1..22: note = Hypo
  source 1..22: mol_type = genomic DNA
gccaccgcgcccagccaatatt

SEQ ID NO: 110225 - DNA, 212 bp, Homo sapiens; identical to SEQ ID NO: 76362
  misc_feature 1..212: note = chr14:103550430-103550642
  misc_feature 1..212: note = Hyper
  source 1..212: mol_type = genomic DNA

SEQ ID NO: 110226 - DNA, 131 bp, Homo sapiens; identical to SEQ ID NO: 76363
  misc_feature 1..131: note = chr14:103584461-103584592
  misc_feature 1..131: note = Hyper
  source 1..131: mol_type = genomic DNA

SEQ ID NO: 110227 - DNA, 93 bp, Homo sapiens; identical to SEQ ID NO: 76364
  misc_feature 1..93: note = chr14:103589787-103589880
  misc_feature 1..93: note = Hyper
  source 1..93: mol_type = genomic DNA

SEQ ID NO: 110228 - DNA, 30 bp, Homo sapiens; identical to SEQ ID NO: 76365
  misc_feature 1..30: note = chr14:103593974-103594004
  misc_feature 1..30: note = Hypo
  source 1..30: mol_type = genomic DNA

SEQ ID NO: 110229 - DNA, 425 bp, Homo sapiens
  misc_feature 1..425: note = chr14:103655240-103655665
  misc_feature 1..425: note = Hyper
  source 1..425: mol_type = genomic DNA
ccgatttaaaactcgcgccaacgcggctgcgcgccttgtcctccgcccaggaaccctggaggccacggcctcgcccggctcctgcgctggcactggacgtcccgccggctgtacctggcgccccgtggcctcgctcccgaccgctgccccgcagaggcctcccgaccgccgaggccctcgccacgcccgggtgcccccagggggcgccggcttccacccacagagctccccaggcctgggcgggcgcagggagggcgcgaccggggcgcacccgcgcgggaacttggcagagactcgcgggacgtggcgggggcgcctcaggaaacgcgccgcggggctgcggggtcgaggggaggggactagtgtgcaggggccaccctctccccagccccgccccccgagtccagctccgcccctgatgcgta

SEQ ID NO: 110230 - DNA, 43 bp, Homo sapiens; identical to SEQ ID NO: 76368
  misc_feature 1..43: note = chr14:103673852-103673895
  misc_feature 1..43: note = Hyper
  source 1..43: mol_type = genomic DNA

SEQ ID NO: 110231 - DNA, 125 bp, Homo sapiens
  misc_feature 1..125: note = chr14:103674155-103674280
  misc_feature 1..125: note = Hyper
  source 1..125: mol_type = genomic DNA
ggccgaccgggactccgagcgccaggtgctgatggcgcgggcccgcgaggggccctgcccgttcccgggggtcacggccaagatccagcggaggatggaccaggtgttcacgctggcggtgcgcg

SEQ ID NO: 110232 - DNA, 717 bp, Homo sapiens; identical to SEQ ID NO: 76370
  misc_feature 1..717: note = chr14:103686706-103687423
  misc_feature 1..717: note = Hyper
  source 1..717: mol_type = genomic DNA

SEQ ID NO: 110233 - DNA, 47 bp, Homo sapiens; identical to SEQ ID NO: 76371
  misc_feature 1..47: note = chr14:103698810-103698857
  misc_feature 1..47: note = Hypo
  source 1..47: mol_type = genomic DNA

SEQ ID NO: 110234 - DNA, 71 bp, Homo sapiens; identical to SEQ ID NO: 76372
  misc_feature 1..71: note = chr14:103699549-103699620
  misc_feature 1..71: note = Hypo
  source 1..71: mol_type = genomic DNA

SEQ ID NO: 110235 - DNA, 693 bp, Homo sapiens
  misc_feature 1..693: note = chr14:103739918-103740611
  misc_feature 1..693: note = Hyper
  source 1..693: mol_type = genomic DNA
ccagcctgggttgagcggggcggatctgggactccgaggcttcctacgtggggcgggttcccagcggacgcctctgccgcacccctggcggggacccagctgcgccccttcccgcggccctcctagggcctgggtgcttggaggctcgaggccccaagatccatgtcgcccggaatcccggtgcctaggccttgtcgcgggccctgggaccaactcgcgggggtcaggagctgggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccctagccctgggtccaaacgggcaggagaggtcgctggtgcctccgcggtccccgccgcgcgcagaactcggccgagtgcaccggggtctcctggcctctgcgcgcagctggtcctgcagcgtcaggacccgaacgaccccgaggccccaggggctgggccctccagcagccccgcagcagccccgcagcagccccggcaggcaccctccagcggccgtgggcgcctggtagctatggaggcggtagaggtggaaa

SEQ ID NO: 110236 - DNA, 520 bp, Homo sapiens; identical to SEQ ID NO: 76375
  misc_feature 1..520: note = chr14:103745299-103745819
  misc_feature 1..520: note = Hyper
  source 1..520: mol_type = genomic DNA

SEQ ID NO: 110237 - DNA, 30 bp, Homo sapiens; identical to SEQ ID NO: 76376
  misc_feature 1..30: note = chr14:103778195-103778225
  misc_feature 1..30: note = Hypo
  source 1..30: mol_type = genomic DNA

SEQ ID NO: 110238 - DNA, 30 bp, Homo sapiens; identical to SEQ ID NO: 76377
  misc_feature 1..30: note = chr14:103793396-103793426
  misc_feature 1..30: note = Hypo
  source 1..30: mol_type = genomic DNA

SEQ ID NO: 110239 - DNA, 30 bp, Homo sapiens; identical to SEQ ID NO: 76378
  misc_feature 1..30: note = chr14:103814512-103814542
  misc_feature 1..30: note = Hypo
  source 1..30: mol_type = genomic DNA

SEQ ID NO: 110240 - DNA, 89 bp, Homo sapiens; identical to SEQ ID NO: 15869
  misc_feature 1..89: note = chr14:103820833-103820922
  misc_feature 1..89: note = Hypo
  source 1..89: mol_type = genomic DNA

SEQ ID NO: 110241 - DNA, 30 bp, Homo sapiens; identical to SEQ ID NO: 76380
  misc_feature 1..30: note = chr14:103977805-103977835
  misc_feature 1..30: note = Hypo
  source 1..30: mol_type = genomic DNA

SEQ ID NO: 110242 - DNA, 41 bp, Homo sapiens; identical to SEQ ID NO: 76381
  misc_feature 1..41: note = chr14:103988695-103988736
  misc_feature 1..41: note = Hyper
  source 1..41: mol_type = genomic DNA

SEQ ID NO: 110243 - DNA, 443 bp, Homo sapiens
  misc_feature 1..443: note = chr14:103989154-103989597
  misc_feature 1..443: note = Hyper
  source 1..443: mol_type = genomic DNA
gacgcaggcgaacagcggccgctccgcgctcccgcggctcttaaggggcacaacgcgggccgcccattggcggctatttatagcccattcattccattggcccgcgccgcggggtggtgccgccgctttgtccgccgcccgcagcccccaacaccctggccgcccacccgagctgtcccctcgctgggaccccgcgcagcctgcccagtcccccgcccaagacctcgaggccgaaacctcaggtccttggatatctggatcccctcgcacgcccttgcctctgggcgggaaactgaggcggagagcctccgggcactcgaggacgcttgggttcatccgcatcctcgagcctgcccgcctagtccagccagcccccgcggcggcggcgaggggccgggcgaaagctttcggggcttccgcagcaggtacggcccccgccccac

SEQ ID NO: 110244 - DNA, 80 bp, Homo sapiens; identical to SEQ ID NO: 76384
  misc_feature 1..80: note = chr14:103996379-103996459
  misc_feature 1..80: note = Hypo
  source 1..80: mol_type = genomic DNA

SEQ ID NO: 110245 - DNA, 17 bp, Homo sapiens
  misc_feature 1..17: note = chr14:104006077-104006094
  misc_feature 1..17: note = Hypo
  source 1..17: mol_type = genomic DNA
cttttttttggagaccg

SEQ ID NO: 110246 - DNA, 89 bp, Homo sapiens; identical to SEQ ID NO: 76386
  misc_feature 1..89: note = chr14:104014163-104014252
  misc_feature 1..89: note = Hypo
  source 1..89: mol_type = genomic DNA

SEQ ID NO: 110247 - DNA, 70 bp, Homo sapiens; identical to SEQ ID NO: 76387
  misc_feature 1..70: note = chr14:104048912-104048982
  misc_feature 1..70: note = Hypo
  source 1..70: mol_type = genomic DNA

SEQ ID NO: 110248 - DNA, 57 bp, Homo sapiens; identical to SEQ ID NO: 76388
  misc_feature 1..57: note = chr14:104061854-104061911
  misc_feature 1..57: note = Hypo
  source 1..57: mol_type = genomic DNA

SEQ ID NO: 110249 - DNA, 27 bp, Homo sapiens
  misc_feature 1..27: note = chr14:104062202-104062229
  misc_feature 1..27: note = Hypo
  source 1..27: mol_type = genomic DNA
ttttttttttgagaccgagtctcgctc

SEQ ID NO: 110250 - DNA, 26 bp, Homo sapiens
  misc_feature 1..26: note = chr14:104062469-104062495
  misc_feature 1..26: note = Hypo
  source 1..26: mol_type = genomic DNA
gcttgagccaccgtgcccagcctatt

SEQ ID NO: 110251 - DNA, 30 bp, Homo sapiens; identical to SEQ ID NO: 76391
  misc_feature 1..30: note = chr14:104083385-104083415
  misc_feature 1..30: note = Hypo
  source 1..30: mol_type = genomic DNA

SEQ ID NO: 110252 - DNA, 30 bp, Homo sapiens; identical to SEQ ID NO: 44144
  misc_feature 1..30: note = chr14:104121128-104121158
  misc_feature 1..30: note = Hypo
  source 1..30: mol_type = genomic DNA

SEQ ID NO: 110253 - DNA, 120 bp, Homo sapiens; identical to SEQ ID NO: 76393
  misc_feature 1..120: note = chr14:104159317-104159437
  misc_feature 1..120: note = Hypo
  source 1..120: mol_type = genomic DNA

SEQ ID NO: 110254 - DNA, 37 bp, Homo sapiens; identical to SEQ ID NO: 76394
  misc_feature 1..37: note = chr14:104160021-104160058
  misc_feature 1..37: note = Hypo
  source 1..37: mol_type = genomic DNA

SEQ ID NO: 110255 - DNA, 39 bp, Homo sapiens; identical to SEQ ID NO: 76395
  misc_feature 1..39: note = chr14:104194452-104194491
  misc_feature 1..39: note = Hypo
  source 1..39: mol_type = genomic DNA

SEQ ID NO: 110256 - DNA, 55 bp, Homo sapiens; identical to SEQ ID NO: 44145
  misc_feature 1..55: note = chr14:104194695-104194750
  misc_feature 1..55: note = Hypo
  source 1..55: mol_type = genomic DNA

SEQ ID NO: 110257 - DNA, 68 bp, Homo sapiens; identical to SEQ ID NO: 76397
  misc_feature 1..68: note = chr14:104195247-104195315
  misc_feature 1..68: note = Hypo
  source 1..68: mol_type = genomic DNA

SEQ ID NO: 110258 - DNA, 42 bp, Homo sapiens; identical to SEQ ID NO: 76398
  misc_feature 1..42: note = chr14:104199986-104200028
  misc_feature 1..42: note = Hypo
  source 1..42: mol_type = genomic DNA

SEQ ID NO: 110259 - DNA, 136 bp, Homo sapiens; identical to SEQ ID NO: 44147
  misc_feature 1..136: note = chr14:104202705-104202841
  misc_feature 1..136: note = Hypo
  source 1..136: mol_type = genomic DNA

SEQ ID NO: 110260 - DNA, 36 bp, Homo sapiens; identical to SEQ ID NO: 76400
  misc_feature 1..36: note = chr14:104335400-104335436
  misc_feature 1..36: note = Hypo
  source 1..36: mol_type = genomic DNA

SEQ ID NO: 110261 - DNA, 30 bp, Homo sapiens; identical to SEQ ID NO: 76401
  misc_feature 1..30: note = chr14:104346851-104346881
  misc_feature 1..30: note = Hyper
  source 1..30: mol_type = genomic DNA

SEQ ID NO: 110262 - DNA, 26 bp, Homo sapiens
  misc_feature 1..26: note = chr14:104355130-104355156
  misc_feature 1..26: note = Hypo
  source 1..26: mol_type = genomic DNA
gtgtttgatttgacacgccctccccg

SEQ ID NO: 110263 - DNA, 30 bp, Homo sapiens; identical to SEQ ID NO: 76403
  misc_feature 1..30: note = chr14:104367439-104367469
  misc_feature 1..30: note = Hyper
  source 1..30: mol_type = genomic DNA

SEQ ID NO: 110264 - DNA, 98 bp, Homo sapiens; identical to SEQ ID NO: 76404
  misc_feature 1..98: note = chr14:104386144-104386242
  misc_feature 1..98: note = Hypo
  source 1..98: mol_type = genomic DNA

SEQ ID NO: 110265 - DNA, 38 bp, Homo sapiens; identical to SEQ ID NO: 76405
  misc_feature 1..38: note = chr14:104387082-104387120
  misc_feature 1..38: note = Hypo
  source 1..38: mol_type = genomic DNA

SEQ ID NO: 110266 - DNA, 30 bp, Homo sapiens; identical to SEQ ID NO: 76406
  misc_feature 1..30: note = chr14:104486789-104486819
  misc_feature 1..30: note = Hypo
  source 1..30: mol_type = genomic DNA

SEQ ID NO: 110267 - DNA, 30 bp, Homo sapiens; identical to SEQ ID NO: 76407
  misc_feature 1..30: note = chr14:104503586-104503616
  misc_feature 1..30: note = Hypo
  source 1..30: mol_type = genomic DNA

SEQ ID NO: 110268 - DNA, 30 bp, Homo sapiens; identical to SEQ ID NO: 76408
  misc_feature 1..30: note = chr14:104547888-104547918
  misc_feature 1..30: note = Hypo
  source 1..30: mol_type = genomic DNA

SEQ ID NO: 110269 - DNA, 36 bp, Homo sapiens; identical to SEQ ID NO: 76409
  misc_feature 1..36: note = chr14:104560644-104560680
  misc_feature 1..36: note = Hypo
  source 1..36: mol_type = genomic DNA

SEQ ID NO: 110270 - DNA, 30 bp, Homo sapiens; identical to SEQ ID NO: 76410
  misc_feature 1..30: note = chr14:104561546-104561576
  misc_feature 1..30: note = Hypo
  source 1..30: mol_type = genomic DNA

SEQ ID NO: 110271 - DNA, 34 bp, Homo sapiens; identical to SEQ ID NO: 76411
  misc_feature 1..34: note = chr14:104567474-104567508
  misc_feature 1..34: note = Hypo
  source 1..34: mol_type = genomic DNA

SEQ ID NO: 110272 - DNA, 44 bp, Homo sapiens; identical to SEQ ID NO: 76412
  misc_feature 1..44: note = chr14:104568268-104568312
  misc_feature 1..44: note = Hypo
  source 1..44: mol_type = genomic DNA

SEQ ID NO: 110273 - DNA, 131 bp, Homo sapiens; identical to SEQ ID NO: 76413
  misc_feature 1..131: note = chr14:104571985-104572116
  misc_feature 1..131: note = Hypo
  source 1..131: mol_type = genomic DNA

SEQ ID NO: 110274 - DNA, 33 bp, Homo sapiens; identical to SEQ ID NO: 76414
  misc_feature 1..33: note = chr14:104572793-104572826
  misc_feature 1..33: note = Hypo
  source 1..33: mol_type = genomic DNA

SEQ ID NO: 110275 - DNA, 161 bp, Homo sapiens; identical to SEQ ID NO: 76415
  misc_feature 1..161: note = chr14:104573825-104573986
  misc_feature 1..161: note = Hypo
  source 1..161: mol_type = genomic DNA

SEQ ID NO: 110276 - DNA, 30 bp, Homo sapiens; identical to SEQ ID NO: 76416
  misc_feature 1..30: note = chr14:104576414-104576444
  misc_feature 1..30: note = Hypo
  source 1..30: mol_type = genomic DNA

SEQ ID NO: 110277 - DNA, 30 bp, Homo sapiens
  misc_feature 1..30: note = chr14:104583032-104583062
  misc_feature 1..30: note = Hyper
  source 1..30: mol_type = genomic DNA
ccaccggagagctagcgcggccctgggctc

SEQ ID NO: 110278 - DNA, 30 bp, Homo sapiens; identical to SEQ ID NO: 44151
  misc_feature 1..30: note = chr14:104600477-104600507
  misc_feature 1..30: note = Hypo
  source 1..30: mol_type = genomic DNA

SEQ ID NO: 110279 - DNA, 1638 bp, Homo sapiens
  misc_feature 1..1638: note = chr14:104601737-104603375
  misc_feature 1..1638: note = Hyper
  source 1..1638: mol_type = genomic DNA
gccaggccataggtgcgcgctggcgccgctgaaaacgttctccttccctcgcctgtccaccttccaggtcctgctcaaggcgcctaatatcccctgggcagggtccctgacacttccttaactcccaaagaccttccgcgtgggcctagcgcatttaggcgaacctctctgcctgcttgatcctctcccttcctccctcaagccaggcatctcacccacttgcgcgcgaggctggggcagcccacaggaggagcgcgggacccgggcttgagtttgcacccaggcagagcgcccacccccgcccctagcttcggaccctgaaagtaaagtcgtcgtgcccggcagccagcccgaatcttccagccctcagggagtcggggtcggggcagggaaggccacgggtggcggcacaatcgggatcctggagtggaggcgcagactgcgggtcccgctgcgcacgctccgtggtccggttggggtgggccttggaggtccataggccaaggttgaacgggggctctggagcgtgggcggggtggagtgcacaggtcactgggctctgagcgtttccatgggccaggaccccaacgcgccgtgtcctcaggacagattggagggggaaggggctgcgattatgccccagtcggaagggttttacagcagccgcgctgccctctccctgccggatacccggcagtagacaccgacgtctgggggctagcgaggcaggtgggcgcggaccgcgacccgattctggcttccaacctccgcccagtggcgcgcggggccgtcgccccacacctccagtccgcgtggctggtgtctggctcgccgccggggcggaaggggcgctgtcggcgcaggcgggcggggccggagcgcgggggcgcgcggcgcggagcgagcgcagggctcgggggcgcggggcgcggaggaccgggggcttgacgggcggccctgcgcggtgcggggcgcggcggcggcgggcgcgcggccagtgaacgcgcgggcggggcggcggtggcgggaggcactaggggccgctccccgcgcttccctcttccatggcgctgccccagccgcccgagccgccccgcggcgcgccccgcaaggctcccagcctgctggagatgggggcgctctgcctggactcggagatcatcctgggcttcaccagccacctcctgcggcgacgaggcaaggtgagggctgtcgggaggggggcgggcggcgtaggcgccgtcccgttactttgccgcgcggctcgcgcggccgggggtgctgcgccgggaaggagacggcaggtccggagccgcgtcccgcagcccgggctgggactcgctgccgcactttcccccattagcgttgtccaagtctccctctgccttcaaggctgtgtcccaaccggacccacccggaggctgtggctagggcggagagcgcagcgcagggattctcgggctcaccttgcgccttgctaggatgggcgaagtagggggtcggggcccctgactgatcgtgagcccccgaggtgactccagccttgtgcaccccgtgttctgcggatatgggatgtgagcttgtgcttcccgaagcgccgcggcggtagaagcgctgaagttgcgggtgtggctggcc

SEQ ID NO: 110280 - DNA, 38 bp, Homo sapiens; identical to SEQ ID NO: 76421
  misc_feature 1..38: note = chr14:104603715-104603753
  misc_feature 1..38: note = Hyper
  source 1..38: mol_type = genomic DNA

SEQ ID NO: 110281 - DNA, 1513 bp, Homo sapiens; identical to SEQ ID NO: 76422
  misc_feature 1..1513: note = chr14:104604105-104605618
  misc_feature 1..1513: note = Hyper
  source 1..1513: mol_type = genomic DNA

SEQ ID NO: 110282 - DNA, 30 bp, Homo sapiens; identical to SEQ ID NO: 76423
  misc_feature 1..30: note = chr14:104608088-104608118
  misc_feature 1..30: note = Hypo
  source 1..30: mol_type = genomic DNA

SEQ ID NO: 110283 - DNA, 30 bp, Homo sapiens; identical to SEQ ID NO: 44152
  misc_feature 1..30: note = chr14:104609469-104609499
  misc_feature 1..30: note = Hypo
  source 1..30: mol_type = genomic DNA

SEQ ID NO: 110284 - DNA, 858 bp, Homo sapiens; identical to SEQ ID NO: 76425
  misc_feature 1..858: note = chr14:104617582-104618440
  misc_feature 1..858: note = Hypo
  source 1..858: mol_type = genomic DNA

SEQ ID NO: 110285 - DNA, 154 bp, Homo sapiens; identical to SEQ ID NO: 76426
  misc_feature 1..154: note = chr14:104618676-104618830
  misc_feature 1..154: note = Hypo
  source 1..154: mol_type = genomic DNA

SEQ ID NO: 110286 - DNA, 295 bp, Homo sapiens; identical to SEQ ID NO: 76427
  misc_feature 1..295: note = chr14:104619085-104619380
  misc_feature 1..295: note = Hypo
  source 1..295: mol_type = genomic DNA

SEQ ID NO: 110287 - DNA, 193 bp, Homo sapiens; identical to SEQ ID NO: 44156
  misc_feature 1..193: note = chr14:104620411-104620604
  misc_feature 1..193: note = Hypo
  source 1..193: mol_type = genomic DNA

SEQ ID NO: 110288 - DNA, 847 bp, Homo sapiens; identical to SEQ ID NO: 76429
  misc_feature 1..847: note = chr14:104622914-104623761
  misc_feature 1..847: note = Hypo
  source 1..847: mol_type = genomic DNA

SEQ ID NO: 110289 - DNA, 291 bp, Homo sapiens; identical to SEQ ID NO: 76430
  misc_feature 1..291: note = chr14:104626758-104627049
  misc_feature 1..291: note = Hypo
  source 1..291: mol_type = genomic DNA

SEQ ID NO: 110290 - DNA, 184 bp, Homo sapiens; identical to SEQ ID NO: 76431
  misc_feature 1..184: note = chr14:104627651-104627835
  misc_feature 1..184: note = Hypo
  source 1..184: mol_type = genomic DNA

SEQ ID NO: 110291 - DNA, 159 bp, Homo sapiens; identical to SEQ ID NO: 76432
  misc_feature 1..159: note = chr14:104628609-104628768
  misc_feature 1..159: note = Hypo
  source 1..159: mol_type = genomic DNA

SEQ ID NO: 110292 - DNA, 150 bp, Homo sapiens; identical to SEQ ID NO: 76433
  misc_feature 1..150: note = chr14:104630025-104630175
  misc_feature 1..150: note = Hypo
  source 1..150: mol_type = genomic DNA

SEQ ID NO: 110293 - DNA, 64 bp, Homo sapiens; identical to SEQ ID NO: 76434
  misc_feature 1..64: note = chr14:104630660-104630724
  misc_feature 1..64: note = Hypo
  source 1..64: mol_type = genomic DNA

SEQ ID NO: 110294 - DNA, 45 bp, Homo sapiens; identical to SEQ ID NO: 44163
  misc_feature 1..45: note = chr14:104630962-104631007
  misc_feature 1..45: note = Hypo
  source 1..45: mol_type = genomic DNA

SEQ ID NO: 110295 - DNA, 282 bp, Homo sapiens; identical to SEQ ID NO: 76436
  misc_feature 1..282: note = chr14:104636842-104637124
  misc_feature 1..282: note = Hypo
  source 1..282: mol_type = genomic DNA

SEQ ID NO: 110296 - DNA, 33 bp, Homo sapiens; identical to SEQ ID NO: 44165
  misc_feature 1..33: note = chr14:104638185-104638218
  misc_feature 1..33: note = Hypo
  source 1..33: mol_type = genomic DNA

SEQ ID NO: 110297 - DNA, 837 bp, Homo sapiens; identical to SEQ ID NO: 76438
  misc_feature 1..837: note = chr14:104639050-104639887
  misc_feature 1..837: note = Hypo
  source 1..837: mol_type = genomic DNA

SEQ ID NO: 110298 - DNA, 399 bp, Homo sapiens; identical to SEQ ID NO: 76439
  misc_feature 1..399: note = chr14:104640183-104640582
  misc_feature 1..399: note = Hypo
  source 1..399: mol_type = genomic DNA

SEQ ID NO: 110299 - DNA, 532 bp, Homo sapiens; identical to SEQ ID NO: 76440
  misc_feature 1..532: note = chr14:104641305-104641837
  misc_feature 1..532: note = Hypo
  source 1..532: mol_type = genomic DNA

SEQ ID NO: 110300 - DNA, 202 bp, Homo sapiens; identical to SEQ ID NO: 76441
  misc_feature 1..202: note = chr14:104642041-104642243
  misc_feature 1..202: note = Hypo
  source 1..202: mol_type = genomic DNA

SEQ ID NO: 110301 - DNA, 288 bp, Homo sapiens; identical to SEQ ID NO: 76442
  misc_feature 1..288: note = chr14:104642454-104642742
  misc_feature 1..288: note = Hypo
  source 1..288: mol_type = genomic DNA

SEQ ID NO: 110302 - DNA, 1271 bp, Homo sapiens; identical to SEQ ID NO: 76443
  misc_feature 1..1271: note = chr14:104643013-104644284
  misc_feature 1..1271: note = Hypo
  source 1..1271: mol_type = genomic DNA

SEQ ID NO: 110303 - DNA, 382 bp, Homo sapiens; identical to SEQ ID NO: 44172
  misc_feature 1..382: note = chr14:104645126-104645508
  misc_feature 1..382: note = Hypo
  source 1..382: mol_type = genomic DNA

SEQ ID NO: 110304 - DNA, 990 bp, Homo sapiens; identical to SEQ ID NO: 76445
  misc_feature 1..990: note = chr14:104645716-104646706
  misc_feature 1..990: note = Hypo
  source 1..990: mol_type = genomic DNA

SEQ ID NO: 110305 - DNA, 207 bp, Homo sapiens; identical to SEQ ID NO: 44175
  misc_feature 1..207: note = chr14:104647208-104647415
  misc_feature 1..207: note = Hypo
  source 1..207: mol_type = genomic DNA

SEQ ID NO: 110306 - DNA, 30 bp, Homo sapiens; identical to SEQ ID NO: 44176
  misc_feature 1..30: note = chr14:104647924-104647954
  misc_feature 1..30: note = Hypo
  source 1..30: mol_type = genomic DNA

SEQ ID NO: 110307 - DNA, 283 bp, Homo sapiens; identical to SEQ ID NO: 76448
  misc_feature 1..283: note = chr14:104648592-104648875
  misc_feature 1..283: note = Hypo
  source 1..283: mol_type = genomic DNA

SEQ ID NO: 110308 - DNA, 30 bp, Homo sapiens; identical to SEQ ID NO: 76449
  misc_feature 1..30: note = chr14:104674208-104674238
  misc_feature 1..30: note = Hypo
  source 1..30: mol_type = genomic DNA

SEQ ID NO: 110309 - DNA, 172 bp, Homo sapiens; identical to SEQ ID NO: 76450
  misc_feature 1..172: note = chr14:104676826-104676998
  misc_feature 1..172: note = Hypo
  source 1..172: mol_type = genomic DNA

SEQ ID NO: 110310 - DNA, 30 bp, Homo sapiens; identical to SEQ ID NO: 76451
  misc_feature 1..30: note = chr14:104679828-104679858
  misc_feature 1..30: note = Hypo
  source 1..30: mol_type = genomic DNA

SEQ ID NO: 110311 - DNA, 189 bp, Homo sapiens; identical to SEQ ID NO: 76452
  misc_feature 1..189: note = chr14:104682484-104682673
  misc_feature 1..189: note = Hypo
  source 1..189: mol_type = genomic DNA

SEQ ID NO: 110312 - DNA, 30 bp, Homo sapiens; identical to SEQ ID NO: 76453
  misc_feature 1..30: note = chr14:104682881-104682911
  misc_feature 1..30: note = Hypo
  source 1..30: mol_type = genomic DNA

SEQ ID NO: 110313 - DNA, 87 bp, Homo sapiens; identical to SEQ ID NO: 76454
  misc_feature 1..87: note = chr14:104696332-104696419
  misc_feature 1..87: note = Hypo
  source 1..87: mol_type = genomic DNA

SEQ ID NO: 110314 - DNA, 186 bp, Homo sapiens; identical to SEQ ID NO: 76455
  misc_feature 1..186: note = chr14:104705204-104705390
  misc_feature 1..186: note = Hypo
  source 1..186: mol_type = genomic DNA

SEQ ID NO: 110315 - DNA, 58 bp, Homo sapiens; identical to SEQ ID NO: 76456
  misc_feature 1..58: note = chr14:104719866-104719924
  misc_feature 1..58: note = Hypo
  source 1..58: mol_type = genomic DNA

SEQ ID NO: 110316 - DNA, 32 bp, Homo sapiens; identical to SEQ ID NO: 76457
  misc_feature 1..32: note = chr14:104735865-104735897
  misc_feature 1..32: note = Hypo
  source 1..32: mol_type = genomic DNA

SEQ ID NO: 110317 - DNA, 32 bp, Homo sapiens; identical to SEQ ID NO: 76458
  misc_feature 1..32: note = chr14:104759084-104759116
  misc_feature 1..32: note = Hypo
  source 1..32: mol_type = genomic DNA

SEQ ID NO: 110318 - DNA, 30 bp, Homo sapiens; identical to SEQ ID NO: 76459
  misc_feature 1..30: note = chr14:104760897-104760927
  misc_feature 1..30: note = Hypo
  source 1..30: mol_type = genomic DNA

SEQ ID NO: 110319 - DNA, 310 bp, Homo sapiens; identical to SEQ ID NO: 76460
  misc_feature 1..310: note = chr14:104768148-104768458
  misc_feature 1..310: note = Hypo
  source 1..310: mol_type = genomic DNA

SEQ ID NO: 110320 - DNA, 103 bp, Homo sapiens; identical to SEQ ID NO: 76461
  misc_feature 1..103: note = chr14:104770277-104770380
  misc_feature 1..103: note = Hypo
  source 1..103: mol_type = genomic DNA

SEQ ID NO: 110321 - DNA, 30 bp, Homo sapiens; identical to SEQ ID NO: 76462
  misc_feature 1..30: note = chr14:104773160-104773190
  misc_feature 1..30: note = Hypo
  source 1..30: mol_type = genomic DNA

SEQ ID NO: 110322 - DNA, 30 bp, Homo sapiens; identical to SEQ ID NO: 44181
  misc_feature 1..30: note = chr14:104798505-104798535
  misc_feature 1..30: note = Hypo
  source 1..30: mol_type = genomic DNA

SEQ ID NO: 110323 - DNA, 38 bp, Homo sapiens; identical to SEQ ID NO: 44182
  misc_feature 1..38: note = chr14:104800605-104800643
  misc_feature 1..38: note = Hypo
  source 1..38: mol_type = genomic DNA

SEQ ID NO: 110324 - DNA, 37 bp, Homo sapiens; identical to SEQ ID NO: 44183
  misc_feature 1..37: note = chr14:104801369-104801406
  misc_feature 1..37: note = Hypo
  source 1..37: mol_type = genomic DNA

SEQ ID NO: 110325 - DNA, 30 bp, Homo sapiens; identical to SEQ ID NO: 76466
  misc_feature 1..30: note = chr14:104812509-104812539
  misc_feature 1..30: note = Hypo
  source 1..30: mol_type = genomic DNA

SEQ ID NO: 110326 - DNA, 62 bp, Homo sapiens; identical to SEQ ID NO: 76467
  misc_feature 1..62: note = chr14:104820337-104820399
  misc_feature 1..62: note = Hypo
  source 1..62: mol_type = genomic DNA

SEQ ID NO: 110327 - DNA, 121 bp, Homo sapiens; identical to SEQ ID NO: 76468
  misc_feature 1..121: note = chr14:104821569-104821690
  misc_feature 1..121: note = Hypo
  source 1..121: mol_type = genomic DNA

SEQ ID NO: 110328 - DNA, 30 bp, Homo sapiens; identical to SEQ ID NO: 76469
  misc_feature 1..30: note = chr14:104841778-104841808
  misc_feature 1..30: note = Hypo
  source 1..30: mol_type = genomic DNA

SEQ ID NO: 110329 - DNA, 201 bp, Homo sapiens; identical to SEQ ID NO: 76470
  misc_feature 1..201: note = chr14:104842214-104842415
  misc_feature 1..201: note = Hypo
  source 1..201: mol_type = genomic DNA

SEQ ID NO: 110330 - DNA, 36 bp, Homo sapiens; identical to SEQ ID NO: 76471
  misc_feature 1..36: note = chr14:104854637-104854673
  misc_feature 1..36: note = Hypo
  source 1..36: mol_type = genomic DNA

SEQ ID NO: 110331 - DNA, 30 bp, Homo sapiens; identical to SEQ ID NO: 76472
  misc_feature 1..30: note = chr14:104858976-104859006
  misc_feature 1..30: note = Hypo
  source 1..30: mol_type = genomic DNA

SEQ ID NO: 110332 - DNA, 166 bp, Homo sapiens; identical to SEQ ID NO: 76473
  misc_feature 1..166: note = chr14:104862860-104863026
  misc_feature 1..166: note = Hypo
  source 1..166: mol_type = genomic DNA

SEQ ID NO: 110333 - DNA, 30 bp, Homo sapiens; identical to SEQ ID NO: 76474
  misc_feature 1..30: note = chr14:104889841-104889871
  misc_feature 1..30: note = Hypo
  source 1..30: mol_type = genomic DNA

SEQ ID NO: 110334 - DNA, 263 bp, Homo sapiens; identical to SEQ ID NO: 76475
  misc_feature 1..263: note = chr14:104897587-104897850
  misc_feature 1..263: note = Hypo
  source 1..263: mol_type = genomic DNA

SEQ ID NO: 110335 - DNA, 257 bp, Homo sapiens; identical to SEQ ID NO: 76476
  misc_feature 1..257: note = chr14:104899274-104899531
  misc_feature 1..257: note = Hypo
  source 1..257: mol_type = genomic DNA

SEQ ID NO: 110336 - DNA, 37 bp, Homo sapiens; identical to SEQ ID NO: 76477
  misc_feature 1..37: note = chr14:104917379-104917416
  misc_feature 1..37: note = Hypo
  source 1..37: mol_type = genomic DNA

SEQ ID NO: 110337 - DNA, 30 bp, Homo sapiens; identical to SEQ ID NO: 76478
  misc_feature 1..30: note = chr14:104937788-104937818
  misc_feature 1..30: note = Hypo
  source 1..30: mol_type = genomic DNA

SEQ ID NO: 110338 - DNA, 38 bp, Homo sapiens; identical to SEQ ID NO: 44188
  misc_feature 1..38: note = chr14:105026775-105026813
  misc_feature 1..38: note = Hypo
  source 1..38: mol_type = genomic DNA

SEQ ID NO: 110339 - DNA, 30 bp, Homo sapiens; identical to SEQ ID NO: 76480
  misc_feature 1..30: note = chr14:105052447-105052477
  misc_feature 1..30: note = Hypo
  source 1..30: mol_type = genomic DNA

SEQ ID NO: 110340 - DNA, 68 bp, Homo sapiens; identical to SEQ ID NO: 76481
  misc_feature 1..68: note = chr14:105055027-105055095
  misc_feature 1..68: note = Hypo
  source 1..68: mol_type = genomic DNA

SEQ ID NO: 110341 - DNA, 30 bp, Homo sapiens; identical to SEQ ID NO: 76482
  misc_feature 1..30: note = chr14:105059531-105059561
  misc_feature 1..30: note = Hypo
  source 1..30: mol_type = genomic DNA

SEQ ID NO: 110342 - DNA, 114 bp, Homo sapiens; identical to SEQ ID NO: 76483
  misc_feature 1..114: note = chr14:105063222-105063336
  misc_feature 1..114: note = Hypo
  source 1..114: mol_type = genomic DNA

SEQ ID NO: 110343 - DNA, 332 bp, Homo sapiens; identical to SEQ ID NO: 76484
  misc_feature 1..332: note = chr14:105070904-105071236
  misc_feature 1..332: note = Hyper
  source 1..332: mol_type = genomic DNA

SEQ ID NO: 110344 - DNA, 30 bp, Homo sapiens; identical to SEQ ID NO: 76485
  misc_feature 1..30: note = chr14:105084500-105084530
  misc_feature 1..30: note = Hypo
  source 1..30: mol_type = genomic DNA

SEQ ID NO: 110345 - DNA, 48 bp, Homo sapiens; identical to SEQ ID NO: 76486
  misc_feature 1..48: note = chr14:105101539-105101587
  misc_feature 1..48: note = Hypo
  source 1..48: mol_type = genomic DNA

SEQ ID NO: 110346 - DNA, 30 bp, Homo sapiens; identical to SEQ ID NO: 76487
  misc_feature 1..30: note = chr14:105103478-105103508
  misc_feature 1..30: note = Hypo
  source 1..30: mol_type = genomic DNA

SEQ ID NO: 110347 - DNA, 33 bp, Homo sapiens; identical to SEQ ID NO: 76488
  misc_feature 1..33: note = chr14:105103792-105103825
  misc_feature 1..33: note = Hypo
  source 1..33: mol_type = genomic DNA

SEQ ID NO: 110348 - DNA, 159 bp, Homo sapiens; identical to SEQ ID NO: 76489
  misc_feature 1..159: note = chr14:105132631-105132790
  misc_feature 1..159: note = Hypo
  source 1..159: mol_type = genomic DNA

SEQ ID NO: 110349 - DNA, 99 bp, Homo sapiens; identical to SEQ ID NO: 76490
  misc_feature 1..99: note = chr14:105157485-105157584
  misc_feature 1..99: note = Hypo
  source 1..99: mol_type = genomic DNA

SEQ ID NO: 110350 - DNA, 30 bp, Homo sapiens; identical to SEQ ID NO: 76491
  misc_feature 1..30: note = chr14:105173303-105173333
  misc_feature 1..30: note = Hypo
  source 1..30: mol_type = genomic DNA

SEQ ID NO: 110351 - DNA, 143 bp, Homo sapiens; identical to SEQ ID NO: 76492
  misc_feature 1..143: note = chr14:105174251-105174394
  misc_feature 1..143: note = Hypo
  source 1..143: mol_type = genomic DNA

SEQ ID NO: 110352 - DNA, 43 bp, Homo sapiens; identical to SEQ ID NO: 76493
  misc_feature 1..43: note = chr14:105194951-105194994
  misc_feature 1..43: note = Hypo
  source 1..43: mol_type = genomic DNA

SEQ ID NO: 110353 - DNA, 80 bp, Homo sapiens; identical to SEQ ID NO: 76494
  misc_feature 1..80: note = chr14:105195803-105195883
  misc_feature 1..80: note = Hypo
  source 1..80: mol_type = genomic DNA

SEQ ID NO: 110354 - DNA, 273 bp, Homo sapiens; identical to SEQ ID NO: 76495
  misc_feature 1..273: note = chr14:105196272-105196545
  misc_feature 1..273: note = Hypo
  source 1..273: mol_type = genomic DNA

SEQ ID NO: 110355 - DNA, 38 bp, Homo sapiens; identical to SEQ ID NO: 76496
  misc_feature 1..38: note = chr14:105218308-105218346
  misc_feature 1..38: note = Hypo
  source 1..38: mol_type = genomic DNA

SEQ ID NO: 110356 - DNA, 43 bp, Homo sapiens; identical to SEQ ID NO: 76497
  misc_feature 1..43: note = chr14:105235762-105235805
  misc_feature 1..43: note = Hypo
  source 1..43: mol_type = genomic DNA

SEQ ID NO: 110357 - DNA, 240 bp, Homo sapiens; identical to SEQ ID NO: 76498
  misc_feature 1..240: note = chr14:105240937-105241177
  misc_feature 1..240: note = Hypo
  source 1..240: mol_type = genomic DNA

SEQ ID NO: 110358 - DNA, 30 bp, Homo sapiens; identical to SEQ ID NO: 44194
  misc_feature 1..30: note = chr14:105254641-105254671
  misc_feature 1..30: note = Hypo
  source 1..30: mol_type = genomic DNA

SEQ ID NO: 110359 - DNA, 143 bp, Homo sapiens; identical to SEQ ID NO: 76500
  misc_feature 1..143: note = chr14:105268653-105268796
  misc_feature 1..143: note = Hypo
  source 1..143: mol_type = genomic DNA

SEQ ID NO: 110360 - DNA, 108 bp, Homo sapiens; identical to SEQ ID NO: 76501
  misc_feature 1..108: note = chr14:105292310-105292418
  misc_feature 1..108: note = Hyper
  source 1..108: mol_type = genomic DNA

SEQ ID NO: 110361 - DNA, 1137 bp, Homo sapiens
  misc_feature 1..1137: note = chr14:105309697-105310834
  misc_feature 1..1137: note = Hyper
  source 1..1137: mol_type = genomic DNA
tcaccccgggatgcccgcccagcgcgccaagccccccacgctcacctgtaagtgcaggtggtgctggaggccaggccggggccctgcaggggcaggcacacagtggggctccgtcgccgcagcgccccggcggcctcctcctggccgctggccctcccctaaggcttcctcatcctaaacagcaagtgaagccaaacgaaaaccctgtctctcccgccgttccctccctcctggcctccgtcccccgggctcgcctgccccgccgcccggcggaccggtcccttcctgctttccctggcgggtgctttccgctgctctgttacccggagccaggacgcgcatatattcccagaatccgcgctcagtgcgttcggtcccccgggacacctgttctctgcacaggcgcgtctgggcgcagcgggggcagacacgcgttcccgggcagcgactccggaaggcccgagggagtaaatctggccctcccggttcagcacaaagctcccctggccgcctttcaaaaccgaccgcctcccaactctccgcggacacgagtggcggctgcctcccctcccctcccctagggccgcgcacgcctcccgcagggtctcagtgcctcctgggcgggggataattcctgtccccaccggtgtcctgtactcgcggggtcccgggtgtaagttctgggtcccgggctggctccctggtgagcaaagccgcatcgctcgaattccagaaacccttctcgccgagcgcctgcctggctgctgaaagcctggagactgcgctctcggaggtggatttcggaactcaggagagaagaatgagacgctccctagtacccctagtcccccaggggtgggaggggactgtatctcaaaataagattctgcaactcgacttttataggggaaaccaggcacgcatttcaaaatcttctcatccgtccccacctccttgcgccgcttttccgcgcctcctgtgccacggaagctgccctctgctcctgctgtttccagcccggcagcccccagacaggatctagcttggcccagccgggccctgcttcctctgcctggggtcctcaggccatgcaagtgaggaaacccaggctcagaggggccacgtaactcttcccaa

SEQ ID NO: 110362 - DNA, 376 bp, Homo sapiens
  misc_feature 1..376: note = chr14:105433929-105434305
  misc_feature 1..376: note = Hyper
  source 1..376: mol_type = genomic DNA
cccaccctcagccaccgcactgggagcggctgttcctacactgcctgtagtggggatggagtgcagaggctcagcgagcggcagacctgcctctggccacagagctgcgcagtggggacccctccagtcactgggctggcaggagcctggcccaggaacacaaacaggaagggggaaatcctgcccgcctcgggataaggctgcgcagccaggctaccggcctcggacccgcgccagtcgggagagagaggaaggcccccagtatcccagtcccccgccaagagcaccgcctcccaggcccgagctcctgaggaagccccgcctcggccgcagagcgcaggggaggccgcctttgcccgcccggcctccggttctc

SEQ ID NO: 110363 - DNA, 356 bp, Homo sapiens
  misc_feature 1..356: note = chr14:105444452-105444808
  misc_feature 1..356: note = Hyper
  source 1..356: mol_type = genomic DNA
cggcgcgcgccctcgcgcgtagcccacccgccccaggggagcgggctgcaggcggggaggggcgcaccgctgccgggggttccgggccaggtgggcagcaccatgtggaagcagtcgcacatcgcggcggccaggcggtgcgggcctggcggcccgtcgcgtccagtcgctggtcccggctccggcgcacggggcgggcgggcgggagccgcgctctgccccgctgccctgcgctgccgcgggcggccgacctcggactgcggacaccgcgcgccaggctacccagccgctcagctaggaccccgcccggctccgcccagccctgccgggccactgcggagcgcgctcgcgggcgg

SEQ ID NO: 110364 - DNA, 81 bp, Homo sapiens; identical to SEQ ID NO: 76508
  misc_feature 1..81: note = chr14:105457696-105457777
  misc_feature 1..81: note = Hypo
  source 1..81: mol_type = genomic DNA

SEQ ID NO: 110365 - DNA, 99 bp, Homo sapiens; identical to SEQ ID NO: 76509
  misc_feature 1..99: note = chr14:105479261-105479360
  misc_feature 1..99: note = Hypo
  source 1..99: mol_type = genomic DNA

SEQ ID NO: 110366 - DNA, 393 bp, Homo sapiens; identical to SEQ ID NO: 76510
  misc_feature 1..393: note = chr14:105511966-105512359
  misc_feature 1..393: note = Hyper
  source 1..393: mol_type = genomic DNA

SEQ ID NO: 110367 - DNA, 30 bp, Homo sapiens; identical to SEQ ID NO: 76512
  misc_feature 1..30: note = chr14:105523817-105523847
  misc_feature 1..30: note = Hypo
  source 1..30: mol_type = genomic DNA

SEQ ID NO: 110368 - DNA, 30 bp, Homo sapiens; identical to SEQ ID NO: 44196
  misc_feature 1..30: note = chr14:105538919-105538949
  misc_feature 1..30: note = Hypo
  source 1..30: mol_type = genomic DNA

SEQ ID NO: 110369 - DNA, 34 bp, Homo sapiens; identical to SEQ ID NO: 76514
  misc_feature 1..34: note = chr14:105590655-105590689
  misc_feature 1..34: note = Hypo
  source 1..34: mol_type = genomic DNA

SEQ ID NO: 110370 - DNA, 76 bp, Homo sapiens; identical to SEQ ID NO: 76515
  misc_feature 1..76: note = chr14:105658349-105658425
  misc_feature 1..76: note = Hypo
  source 1..76: mol_type = genomic DNA

SEQ ID NO: 110371 - DNA, 111 bp, Homo sapiens; identical to SEQ ID NO: 76516
  misc_feature 1..111: note = chr14:105662505-105662616
  misc_feature 1..111: note = Hyper
  source 1..111: mol_type = genomic DNA

SEQ ID NO: 110372 - DNA, 183 bp, Homo sapiens; identical to SEQ ID NO: 76517
  misc_feature 1..183: note = chr14:105662937-105663120
  misc_feature 1..183: note = Hyper
  source 1..183: mol_type = genomic DNA

SEQ ID NO: 110373 - DNA, 186 bp, Homo sapiens; identical to SEQ ID NO: 35579
  misc_feature 1..186: note = chr14:105714232-105714418
  misc_feature 1..186: note = Hypo
  source 1..186: mol_type = genomic DNA

SEQ ID NO: 110374 - DNA, 127 bp, Homo sapiens
  misc_feature 1..127: note = chr14:105714476-105714603
  misc_feature 1..127: note = Hyper
  source 1..127: mol_type = genomic DNA
cagagcagagtggaccgcgctctctgcaagcgctggctgctggcgtccgtagcaagctaaatcgcgaagcatctgaacgaacgaggaagcccaacgaccatcccacaggccgcggccagaggcagac

SEQ ID NO: 110375 - DNA, 455 bp, Homo sapiens
  misc_feature 1..455: note = chr14:105715007-105715462
  misc_feature 1..455: note = Hyper
  source 1..455: mol_type = genomic DNA
agcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgccc

SEQ ID NO: 110376 - DNA, 47 bp, Homo sapiens; identical to SEQ ID NO: 76521
  misc_feature 1..47: note = chr14:105715982-105716029
  misc_feature 1..47: note = Hypo
  source 1..47: mol_type = genomic DNA

SEQ ID NO: 110377 - DNA, 129 bp, Homo sapiens; identical to SEQ ID NO: 76522
  misc_feature 1..129: note = chr14:105723744-105723873
  misc_feature 1..129: note = Hypo
  source 1..129: mol_type = genomic DNA

SEQ ID NO: 110378 - DNA, 30 bp, Homo sapiens; identical to SEQ ID NO: 44200
  misc_feature 1..30: note = chr14:105739229-105739259
  misc_feature 1..30: note = Hypo
  source 1..30: mol_type = genomic DNA

SEQ ID NO: 110379 - DNA, 202 bp, Homo sapiens; identical to SEQ ID NO: 76524
  misc_feature 1..202: note = chr14:105739460-105739662
  misc_feature 1..202: note = Hypo
  source 1..202: mol_type = genomic DNA

SEQ ID NO: 110380 - DNA, 30 bp, Homo sapiens; identical to SEQ ID NO: 44202
  misc_feature 1..30: note = chr14:106334145-106334175
  misc_feature 1..30: note = Hypo
  source 1..30: mol_type = genomic DNA

SEQ ID NO: 110381 - DNA, 39 bp, Homo sapiens; identical to SEQ ID NO: 77376
  misc_feature 1..39: note = chr15:20499470-20499509
  misc_feature 1..39: note = Hypo
  source 1..39: mol_type = genomic DNA

SEQ ID NO: 110382 - DNA, 35 bp, Homo sapiens; identical to SEQ ID NO: 44204
  misc_feature 1..35: note = chr15:22515501-22515536
  misc_feature 1..35: note = Hypo
  source 1..35: mol_type = genomic DNA

SEQ ID NO: 110383 - DNA, 36 bp, Homo sapiens; identical to SEQ ID NO: 77378
  misc_feature 1..36: note = chr15:22587476-22587512
  misc_feature 1..36: note = Hypo
  source 1..36: mol_type = genomic DNA

SEQ ID NO: 110384 - DNA, 20 bp, Homo sapiens
  misc_feature 1..20: note = chr15:22792239-22792259
  misc_feature 1..20: note = Hypo
  source 1..20: mol_type = genomic DNA
gccaccgctcctggccagga

SEQ ID NO: 110385 - DNA, 36 bp, Homo sapiens; identical to SEQ ID NO: 77380
  misc_feature 1..36: note = chr15:22822348-22822384
  misc_feature 1..36: note = Hypo
  source 1..36: mol_type = genomic DNA

SEQ ID NO: 110386 - DNA, 93 bp, Homo sapiens; identical to SEQ ID NO: 77381
  misc_feature 1..93: note = chr15:22876959-22877052
  misc_feature 1..93: note = Hypo
  source 1..93: mol_type = genomic DNA

SEQ ID NO: 110387 - DNA, 197 bp, Homo sapiens; identical to SEQ ID NO: 77382
  misc_feature 1..197: note = chr15:22977051-22977248
  misc_feature 1..197: note = Hypo
  source 1..197: mol_type = genomic DNA

SEQ ID NO: 110388 - DNA, 25 bp, Homo sapiens
  misc_feature 1..25: note = chr15:23035596-23035621
  misc_feature 1..25: note = Hypo
  source 1..25: mol_type = genomic DNA
tttgagacagagtctcgctctgtcg

SEQ ID NO: 110389 - DNA, 20 bp, Homo sapiens
  misc_feature 1..20: note = chr15:23084842-23084862
  misc_feature 1..20: note = Hypo
  source 1..20: mol_type = genomic DNA
ccggccgcaagatgttcttc

SEQ ID NO: 110390 - DNA, 19 bp, Homo sapiens
  misc_feature 1..19: note = chr15:23087577-23087596
  misc_feature 1..19: note = Hypo
  source 1..19: mol_type = genomic DNA
tttgagacagagtctcgct

SEQ ID NO: 110391 - DNA, 264 bp, Homo sapiens; identical to SEQ ID NO: 77386
  misc_feature 1..264: note = chr15:23158318-23158582
  misc_feature 1..264: note = Hyper
  source 1..264: mol_type = genomic DNA

SEQ ID NO: 110392 - DNA, 145 bp, Homo sapiens; identical to SEQ ID NO: 77387
  misc_feature 1..145: note = chr15:23182506-23182651
  misc_feature 1..145: note = Hypo
  source 1..145: mol_type = genomic DNA

SEQ ID NO: 110393 - DNA, 39 bp, Homo sapiens; identical to SEQ ID NO: 77388
  misc_feature 1..39: note = chr15:23217780-23217819
  misc_feature 1..39: note = Hypo
  source 1..39: mol_type = genomic DNA

SEQ ID NO: 110394 - DNA, 127 bp, Homo sapiens; identical to SEQ ID NO: 77389
  misc_feature 1..127: note = chr15:23662038-23662165
  misc_feature 1..127: note = Hypo
  source 1..127: mol_type = genomic DNA

SEQ ID NO: 110395 - DNA, 174 bp, Homo sapiens; identical to SEQ ID NO: 77390
  misc_feature 1..174: note = chr15:24515033-24515207
  misc_feature 1..174: note = Hypo
  source 1..174: mol_type = genomic DNA

SEQ ID NO: 110396 - DNA, 113 bp, Homo sapiens; identical to SEQ ID NO: 77391
  misc_feature 1..113: note = chr15:25334863-25334976
  misc_feature 1..113: note = Hypo
  source 1..113: mol_type = genomic DNA

SEQ ID NO: 110397 - DNA, 150 bp, Homo sapiens; identical to SEQ ID NO: 77392
  misc_feature 1..150: note = chr15:25449793-25449943
  misc_feature 1..150: note = Hypo
  source 1..150: mol_type = genomic DNA

SEQ ID NO: 110398 - DNA, 182 bp, Homo sapiens; identical to SEQ ID NO: 77393
  misc_feature 1..182: note = chr15:25477788-25477970
  misc_feature 1..182: note = Hypo
  source 1..182: mol_type = genomic DNA

SEQ ID NO: 110399 - DNA, 32 bp, Homo sapiens; identical to SEQ ID NO: 35581
  misc_feature 1..32: note = chr15:25915272-25915304
  misc_feature 1..32: note = Hyper
  source 1..32: mol_type = genomic DNA

SEQ ID NO: 110400 - DNA, 1437 bp, Homo sapiens
  misc_feature 1..1437: note = chr15:26107394-26108831
  misc_feature 1..1437: note = Hyper
  source 1..1437: mol_type = genomic DNA
accactgtgcctggccgaagactgaggcagggacttcaggccagggggccaggctggcttttcctgcctttcacttcaggtgggagcggctgtggatgaggatgtccagcggccgtcggtttctagccttgggatcattctggccccgacacggagtgacaggggatccccacgcgtccccgcatccagggcgcccctttagctgcggcggaggcacagagaggccttggcggcgctgtggcttcggtcggcaccgggtcccgcgcagccgggccctccaccctgagtggagctgccttctaagcacccagcccctgccaatcactgtgcccaacaccaagttcccggggcgccctgccctgcgccaccgcgcgctcgctcgcccgcccgcccaactcacctgctgaagaccaggcagcccaggtggttgatcttgtggtcggagcggtggcggctgtagtcctcccacaggtccctgaaggccgtgatggccaggatgaagagcaccggcgccagtgccaggccgggctggaaggcgttcaccgccggcacgaagttgagcagcgcgatgaagacaaagtacacgttggccgggcggtggaactgctcgaacaggttcttgggcaggaaggacagcagcgtgtacttggtagtcttgagccggttgtcggccaggtgctgggcacacccgcgccgccgtcgccgctcgcccttggccgcgccagccgcagggtcctcggcgcccgggggcggcagcaggttggagcgcaccgtgcgcgtcctgccctctcggcgcctccgccgtcccggaggcccgggctcctcggtccccgccggctcccgctccatggccgcgtgtcgccgcgcccggctcctccgccgctcacgcccgcccgcgccggcctcttaggttatcatcactcgcggcccgggcgcggcggtgcgagctccccgcctgcgggacgcacggagaccgcggtcagcgcgccgcctggccggcccagcgcgcccagcccgcgcccagccccgtccactcccgtccagccccgccgcccggccgcagtccccagggcgcaagctgggcgggtgccgcacagagcccccttgtcctcgccgcccgcccccggcccgggtcgtttccgccgcggtggccacggccccgccctcgttccgcgcccggactgggccacgccggatagcgggaaacaaaaaaagcccgagctggaaacttcagagaggtttagtttcgtttcccagaagcatcagttcggtcccaaaacgctgcaaacgcgcgctgcctgcagtaggagagaggaaaccgcgaagcgcgagaaaaggcgcccccgtccccaagcagcccgcgcgcccttccaggggccagacctgctccatcctggacggcgaaacgacctcgggagaccccggttaggaccttac

SEQ ID NO: 110401 - DNA, 30 bp, Homo sapiens; identical to SEQ ID NO: 77398
  misc_feature 1..30: note = chr15:26147501-26147531
  misc_feature 1..30: note = Hypo
  source 1..30: mol_type = genomic DNA

SEQ ID NO: 110402 - DNA, 30 bp, Homo sapiens; identical to SEQ ID NO: 77399
  misc_feature 1..30: note = chr15:26234528-26234558
  misc_feature 1..30: note = Hypo
  source 1..30: mol_type = genomic DNA

SEQ ID NO: 110403 - DNA, 580 bp, Homo sapiens
  misc_feature 1..580: note = chr15:26327329-26327909
  misc_feature 1..580: note = Hyper
  source 1..580: mol_type = genomic DNA
aggcttataaatttacgagtttcactgtgttccaaaagaaaggtccagtcattcccacaccgggagtcgaacccgggccgcctgggtgaaaaccaggaatcctaaccgctagaccatgtgggagatgacaagtaaccgttgaattctaaaccaattgaatcatttccgcctgcccttgctttccgccttctgccacgcctccgacaacaaatccctgtctgcgcctgcgcctgcgcgggctttcggtgctgaccgcttgttgatagaggtgtgctccttctcgaaaggcggaggcagggctgggcgctgtggctgctggcactacccagttcttcagcagcgctgtgcctggaggcccccagcccctcgccccccggctcgcgggaggcggcaccagacctcctcaggccctggtccctaggaaactgcagcccggcctcagtttccagaaagctcctccgtgcgatttgggaagagcacggtttgaatggttgaaaatagaggggctgaagaaccgagccgcgcgggcctggctccggggctgagttccctagcgggcgccgagcggagcctgccatta

SEQ ID NO: 110404 - DNA, 35 bp, Homo sapiens; identical to SEQ ID NO: 77402
  misc_feature 1..35: note = chr15:26869355-26869390
  misc_feature 1..35: note = Hypo
  source 1..35: mol_type = genomic DNA

SEQ ID NO: 110405 - DNA, 30 bp, Homo sapiens; identical to SEQ ID NO: 12083
  misc_feature 1..30: note = chr15:27016662-27016692
  misc_feature 1..30: note = Hyper
  source 1..30: mol_type = genomic DNA

SEQ ID NO: 110406 - DNA, 36 bp, Homo sapiens; identical to SEQ ID NO: 77404
  misc_feature 1..36: note = chr15:27016983-27017019
  misc_feature 1..36: note = Hyper
  source 1..36: mol_type = genomic DNA

SEQ ID NO: 110407 - DNA, 161 bp, Homo sapiens
  misc_feature 1..161: note = chr15:27017228-27017389
  misc_feature 1..161: note = Hyper
  source 1..161: mol_type = genomic DNA
aacctcgggaccaggcgacagagcgctggaggagctgggagcccacgggcagcggcagatgggagcactaggccggccaggactcccccgcaggaagggtgcgccctcgcggctccgacgccagccaggcccccgagcgcccggggcgggtgcagggagcc

SEQ ID NO: 110408 - DNA, 178 bp, Homo sapiens
  misc_feature 1..178: note = chr15:27017650-27017828
  misc_feature 1..178: note = Hyper
  source 1..178: mol_type = genomic DNA
ctccggcgcggggcgcgggcggctctgaggactgggggctatcccaggaggggcgcgggcgaagggcccccactcccacccgccgctgctccgcggatgcggcccccgcctccctccgcccaggccgccgccgccgtgggtcgcgcttcccgcaacggccgcgcgcagcccacttacc

SEQ ID NO: 110409 - DNA, 592 bp, Homo sapiens
  misc_feature 1..592: note = chr15:27018284-27018876
  misc_feature 1..592: note = Hyper
  source 1..592: mol_type = genomic DNA
gcggggagggaggagcgcgcgcgggcgcggggcgggggaggaggccggagagtcggaggcggagccgccgcgccgcgcaccctgccctcccccacgctcgcctcggcccgaggccggggccctgggcgctcccctcccgcctcggcggccgccgcacgggactcggacctctgggaccgcggagtgcgggggcgacctgggccggacgctgcgagcggagccgcggctgcgcggagtcgggaggggcggggggtcgtcccctgagccggctcctctgggctctcggcggccgggcgagtgcggggactgtcggcagcctcggcgccggcataagcggcggcggaaacgctgcccgcctaccccggccgccgaagttggccccgcacgacgaccaccgcccgctgcagcgcagcccgagagcccccgggtgccgcgcctctgcccgccggactgcgggccgccgcctcccgacggtgcctgcagaacgccgggaagcccccgcctcacctgcggggctcagagcctcgggtccccagggtccaggagagccagatgggcagcaggagctccaggagcccggagcacatggcgc

SEQ ID NO: 110410 - DNA, 17 bp, Homo sapiens
  misc_feature 1..17: note = chr15:27079519-27079536
  misc_feature 1..17: note = Hypo
  source 1..17: mol_type = genomic DNA
ggagtcttgctctgtcg

SEQ ID NO: 110411 - DNA, 687 bp, Homo sapiens
  misc_feature 1..687: note = chr15:27111977-27112664
  misc_feature 1..687: note = Hyper
  source 1..687: mol_type = genomic DNA
caggcctctatcacccgactgctgacactgccctcccatccctgctctacaagcgggcggtggtgactacacgaggcgccgaagatgctgttgagggccctggagaaacttcagcagaacagggcctctccccttgcaggccgagccgggggccctgcgccctccccctccgcccagctcggccaagggcgcatttgctgagcgtctggcggcctctaccggagcacctctgcagagggccgatcctccagcccagagacgacatgtggcgctcgggcgaggtgagagcgggcgcgagtgcgccgggggcgctggggggctctgcggcgggcggcgcgcggcccggggcgcggcgcggagcggagctgcagggcggcggcgggagcgcggggcgcaagagccgctccgccgggagtgccggggaagttcgcgctggcagcatggggcggtgacgccgcaccggccttccgcgcctgccagccgggcgagagcaggcggaggagaaggaggatgcatcctcaccgacggctcgcctcccggggccggcgcgcagggtgagccctgggcgcgctgggccggggcagtggggtaagaggacgcgagcggggaagaggaccggccgccccggctcggtccgcacccttctcctcggggcgcctgagcggcaggctgcgtggccggggagga

SEQ ID NO: 110412 - DNA, 703 bp, Homo sapiens
  misc_feature 1..703: note = chr15:27112921-27113624
  misc_feature 1..703: note = Hyper
  source 1..703: mol_type = genomic DNA
ctcgcggggtggactcggaccccgcgggggtgtcgcgcgcgtgtcgcgcgggctgctcgaggccaggggacttggagtcgctgctgcaccgcgcgctcccagcccaggaggaaggcgctgcctggcggagcgcttggctcgtacccggggcaggagcaggggaagtctgcgaaagccgggagcgagccggggagggccggggagctggagaccctcggcgtgccgctgcggaccgcgcgggtggcgaccgcgggtgccagggcgacccaggctgcggctccgcagtgcagcccccgcgcccacctgccctggcgcgccggccctggtgagcctctgtgggggtccggagggtcgtgggagcgcagcctctcctgggggtccctggctcggggctgaggggcggcgggaggcgccgcccgggtttcccgcatgcagcgccgcgtgctcgccgcctggctctggcccgggccccgcgacgagccccccggacgcgcccaggcgaccaccgcatggcaccctgcccttcttggcaggagtcgcagaaggccttcgcttccgaggtggaagtacctgttgtgtctcccaattccggagtttgcgggggatgggggttgggggggcttcttgggaaaatgcttcttttcgaagcatactgttcggatgcctgtgagcacctatttgcgttatgcgcatactgagaaat

SEQ ID NO: 110413 - DNA, 610 bp, Homo sapiens; identical to SEQ ID NO: 77414
  misc_feature 1..610: note = chr15:27212788-27213398
  misc_feature 1..610: note = Hyper
  source 1..610: mol_type = genomic DNA

SEQ ID NO: 110414 - DNA, 450 bp, Homo sapiens
  misc_feature 1..450: note = chr15:27216067-27216517
  misc_feature 1..450: note = Hyper
  source 1..450: mol_type = genomic DNA
atggctggaggaaggcggaccgcgggctcgctctcatggtgccaaccccggggacctttcttcaggctccctgcgggatccccagcctcccctccccctcggagctccgcccccttcctggcctcaaactccgagtccattcaaacctcgccttcctcgccctgcgcgttgtcaggcgtgtaattggggaaactcctccccgccgggaccgcctcggaggcgctgccaggggacagccgcccagctgcccccacctcccagcacagcgcacacagccccggcctgggcacccgcgcccgctcgcggctccaggcggggtgggcggcgccgcgccagggggtccccggcgcccattgctcccgccgcccggttgcgcggaccggcgctagtgcgcgggtgggggcggcgcgccgcggtggcccggcgtcccgtgtgcgtccagtgtgcgcc

SEQ ID NO: 110415 - DNA, 119 bp, Homo sapiens
  misc_feature 1..119: note = chr15:27216805-27216924
  misc_feature 1..119: note = Hyper
  source 1..119: mol_type = genomic DNA
ctggagtccctggcgcgccagccgtcggctgggctgcggcacggcgggccgggaggggactgggaagtcggtctgcacctcacctgtcccagctcccttggacacggtcatctgctttt

SEQ ID NO: 110416 - DNA, 30 bp, Homo sapiens; identical to SEQ ID NO: 35597
  misc_feature 1..30: note = chr15:27603952-27603982
  misc_feature 1..30: note = Hyper
  source 1..30: mol_type = genomic DNA

SEQ ID NO: 110417 - DNA, 30 bp, Homo sapiens; identical to SEQ ID NO: 77418
  misc_feature 1..30: note = chr15:27884112-27884142
  misc_feature 1..30: note = Hypo
  source 1..30: mol_type = genomic DNA

SEQ ID NO: 110418 - DNA, 30 bp, Homo sapiens; identical to SEQ ID NO: 77419
  misc_feature 1..30: note = chr15:28016476-28016506
  misc_feature 1..30: note = Hypo
  source 1..30: mol_type = genomic DNA

SEQ ID NO: 110419 - DNA, 34 bp, Homo sapiens; identical to SEQ ID NO: 77420
  misc_feature 1..34: note = chr15:28051056-28051090
  misc_feature 1..34: note = Hypo
  source 1..34: mol_type = genomic DNA

SEQ ID NO: 110420 - DNA, 30 bp, Homo sapiens; identical to SEQ ID NO: 77421
  misc_feature 1..30: note = chr15:28076464-28076494
  misc_feature 1..30: note = Hypo
  source 1..30: mol_type = genomic DNA

SEQ ID NO: 110421 - DNA, 32 bp, Homo sapiens; identical to SEQ ID NO: 77422
  misc_feature 1..32: note = chr15:28114883-28114915
  misc_feature 1..32: note = Hypo
  source 1..32: mol_type = genomic DNA

SEQ ID NO: 110422 - DNA, 271 bp, Homo sapiens
  misc_feature 1..271: note = chr15:28339763-28340034
  misc_feature 1..271: note = Hyper
  source 1..271: mol_type = genomic DNA
caaccccaaatcgttcgtgtgggctactgccggccctctctccggctctgcgctctttctgcctgcaaccgtgcccccgaactcgggccctgcgaggtgggggtgggcccgggcccctcctgccgcccctgctgccagcaccgttctctccgaggccctcaacgccccgccgtgccgtggccttcagagcgcgccagacgctcaccaagcctgcccgagccccgcctcccgcagccgtgcccagggcggagtggggcgacggcaccggtgc

SEQ ID NO: 110423 - DNA, 268 bp, Homo sapiens; identical to SEQ ID NO: 77425
  misc_feature 1..268: note = chr15:28340309-28340577
  misc_feature 1..268: note = Hyper
  source 1..268: mol_type = genomic DNA

SEQ ID NO: 110424 - DNA, 28 bp, Homo sapiens
  misc_feature 1..28: note = chr15:28340877-28340905
  misc_feature 1..28: note = Hyper
  source 1..28: mol_type = genomic DNA
gaacattgttcttcgagttctttaaata

SEQ ID NO: 110425 - DNA, 941 bp, Homo sapiens
  misc_feature 1..941: note = chr15:28341620-28342561
  misc_feature 1..941: note = Hyper
  source 1..941: mol_type = genomic DNA
gcaggagaagccctgcggccaagaaggcctgaagaagcccgtccaggggtcagcctcctcctcagccggtcctgggctgagacaggggtgtcccgctgagggcagtgtagggtgcggtgcccccaccccacttcgggcctggaccgagaccgcgagtgtgaccgtatatcccttcaggtggatttttcaacatgtgaacttggttaaaagcttctagaacgttaagccaaacatcgtggctttccatccgttttctgttcttgtttgaaagagtacgcctccttccagcctgggaggaggggcggggcccgggagagggcctcgggaggccgcgggtgggctctgccgagggccgcgttcgcagggccccccgggactggcggccccgcggcaggccaggcgcacctctcggggagaaacgagcagcgccagcaaacgcgcagccgggcacgcggccgcccagccccgctcccagcccggggccaggacccctccccgcggcgccgctgccgcaagcctcctctgctaccccagctgcgggcagtttggcccggcgctgtgccgctgtagttcggtgtcccttcgcccatcctgcaggccagcttggaaactgtgtcccatgctcctcgaaacaccggacctgctccccgccgccctgcggaatgcgcctcctggcgcctcagtgggtggccgggccgagagcacaggcgcgccagccacacctccccacgggtcggacccacacggaccccgccgcgctccgccgaaactgcgcgggtcccgcgggtggccggcgcaagagccacagcccgcgacaagccggctgcctgcaggtcagtgacagaaccccaaatggaaactgcggaaacccaacaaccagcgagtgagctggtagagccagcggccccaaggagctgagggagctccggcttgtggagtct

SEQ ID NO: 110426 - DNA, 589 bp, Homo sapiens
  misc_feature 1..589: note = chr15:28344103-28344692
  misc_feature 1..589: note = Hyper
  source 1..589: mol_type = genomic DNA
tggcccaccagggggcgactttttcctgggtcgcctggcagagagccggagggggtgctcagggggcagctgctgcaggcccaggcggactcagccgcgctaggtcggctccgtcgcacccgtctgtgcacactaacctttaggggaacttgccttgcttcctaagccgcgactcagccggggctgtgtaaaccctccctgcctgttcccaggctagtctggctcctcgcctccttcctcccgaccgcggagcacgtgcactttacctgcgcacttgcagatctttctccaggagtgagtttaaggtccgcacctccgctctggatggtgagcggagcacagccttcgaagtaagaactcagagggagctcggcgctcccgcagcgggtcccccacccaggcacgcccccggcccggccccgcccacagcactccccactcggccccgcccacagtgcggccacgcccgtagcacgcccctcccggccacgcccacaaagctgcccacatggccccgcccacagctcgcccgctccgcacccccggcccctcagctccccagcccccggcggcgcgggctgagagcagc

SEQ ID NO: 110427 - DNA, 115 bp, Homo sapiens; identical to SEQ ID NO: 77433
  misc_feature 1..115: note = chr15:28346156-28346271
  misc_feature 1..115: note = Hypo
  source 1..115: mol_type = genomic DNA

SEQ ID NO: 110428 - DNA, 1301 bp, Homo sapiens
  misc_feature 1..1301: note = chr15:28351758-28353059
  misc_feature 1..1301: note = Hyper
  source 1..1301: mol_type = genomic DNA
gcagggtgggggcaccgggcgcacgcggggaatttccccacgaccacggccacgccaaatgcctgaacctccacggctgccggcaacagcgagcgcagggagggggctgtgcgcgcgggggccctggtggcggagcaggcatcaccccgagagcgccgaggtttgtggtcgcaaccccgggagcaccgctgcgggaggagcggcgtggccgggcagaggcgacttcctcgcaggcagtaccgggccccgcggccgcctccgggcctgtcctggtgccccgggcttccacccggcgggctggcgtgcgggggctggtcttcgccgagatcctgctgggagcgggctctggccccacggtgagcccggccccagcctcggtgatgcgcttcgctgccgcgcggggagggagagtccggcagggtcacgaggcgccggccccggggccgcttgaaacccgaagagaccccgctcgctcgcgcgcccgccggacgaatcctcgcggaggtcccggggcgcagccggcgtgagggtggggtctcatcgcaggggcgccgggagcctccccgctccgctagctcaaccaaggaccgctcagaggggctctcaccctgaacctcggcttttctaaaggaagggcagaccccagatttcccccttctcttctcgaacgtgctttgggtgtttttctgctttcttttttggcaagtcaggacagcgcacagtgcacggagctccgaagctctctcagctactcccggatttctggttaaacctgagggtgagcccgaaagaccgctgccgccggcggccaccccagcgcgggtccgctgagaatggaaacagcaagtgcgcgccggccaggccgccacctctccctcctccaacagcccgggcagccgcaggggccagccccgggccagccagggcccagcacaaaatgccttccagcgacagcagcgccggaagccccttctgaggtcgtggataagcctccgcgcaggggccccgcgctcagcccaccccgcatgcctccgcgccagggcctgctggtgggtggccgcctgccccgggctatcccgggctgggcactggcgccgatcccgcctcgcttgtggagctgcatttggggggaaagatggaccggcagcgtgggacgcagagccaggccaggccgcacgggctgtgcacaaagatatgcccgacaggcggggagaaggcatggcccaccggctcaggagaaagtcctggaggggaggcagtccgcccctggggacaacgcggggggccgtattcggacacca

SEQ ID NO: 110429 - DNA, 206 bp, Homo sapiens; identical to SEQ ID NO: 77438
  misc_feature 1..206: note = chr15:28389827-28390033
  misc_feature 1..206: note = Hypo
  source 1..206: mol_type = genomic DNA

SEQ ID NO: 110430 - DNA, 122 bp, Homo sapiens; identical to SEQ ID NO: 44213
  misc_feature 1..122: note = chr15:28517076-28517198
  misc_feature 1..122: note = Hypo
  source 1..122: mol_type = genomic DNA

SEQ ID NO: 110431 - DNA, 23 bp, Homo sapiens
  misc_feature 1..23: note = chr15:29008573-29008596
  misc_feature 1..23: note = Hypo
  source 1..23: mol_type = genomic DNA
accgcgcccggcttccagaatat

SEQ ID NO: 110432 - DNA, 21 bp, Homo sapiens
  misc_feature 1..21: note = chr15:29029711-29029732
  misc_feature 1..21: note = Hypo
  source 1..21: mol_type = genomic DNA
ctgagcgcggtgaatcgcttg

SEQ ID NO: 110433 - DNA, 37 bp, Homo sapiens; identical to SEQ ID NO: 77442
  misc_feature 1..37: note = chr15:29034132-29034169
  misc_feature 1..37: note = Hyper
  source 1..37: mol_type = genomic DNA

SEQ ID NO: 110434 - DNA, 550 bp, Homo sapiens
  misc_feature 1..550: note = chr15:29077236-29077786
  misc_feature 1..550: note = Hyper
  source 1..550: mol_type = genomic DNA
tgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgct

SEQ ID NO: 110435 - DNA, 88 bp, Homo sapiens; identical to SEQ ID NO: 77446
  misc_feature 1..88: note = chr15:29087614-29087702
  misc_feature 1..88: note = Hypo
  source 1..88: mol_type = genomic DNA

SEQ ID NO: 110436 - DNA, 48 bp, Homo sapiens; identical to SEQ ID NO: 44215
  misc_feature 1..48: note = chr15:29112193-29112241
  misc_feature 1..48: note = Hypo
  source 1..48: mol_type = genomic DNA

SEQ ID NO: 110437 - DNA, 21 bp, Homo sapiens
  misc_feature 1..21: note = chr15:29119934-29119955
  misc_feature 1..21: note = Hypo
  source 1..21: mol_type = genomic DNA
ccactgcgcctggcctgcatg

SEQ ID NO: 110438 - DNA, 30 bp, Homo sapiens; identical to SEQ ID NO: 77449
  misc_feature 1..30: note = chr15:29123489-29123519
  misc_feature 1..30: note = Hypo
  source 1..30: mol_type = genomic DNA

SEQ ID NO: 110439 - DNA, 1200 bp, Homo sapiens
  misc_feature 1..1200: note = chr15:29130707-29131907
  misc_feature 1..1200: note = Hyper
  source 1..1200: mol_type = genomic DNA
cccccattacagctgcgcggggccgagcaagcagggcgcggcggccggggcaaggtgcggagcctcgcgttcaccggctctacctgcggagcctcgcgttcactggctctacctgcgggaccagacccctgcagctccccagccagcacggccggggcacgcccgggaatctgtgtgctccccagggcccggggcgttcggggcgccgcgccttccagcgcctgggtcccagccccgatcccggagaccggcccggggggacccggggtcccgagtgcaccctcctgccctgcagactgtcccagcgccggggccagggggcgcaggacctcgcgcacgcccggcacggacgcatctttgtcttccctctcttcacggcgcgcgatctagccgggaatcgttttccggccccagtgtgcccggcgcgggtgaggcggaagcggccggggcgggggcgcaggcccggcagccgcaggccggtgcgggatgcgccccgcagccgcgccgcgtgcgcccggcagaggcggccctgcgtgccgtacgctgcgtccggggcgcgcccgccgctattcgggaagctattcagcttcccgggctcattagcagtcgcggtgtgcggctcggcgcgggctcacaaagagctcggcctcgcggactgagccggcggcagcggggcggggacggcggcgtacccgggcagcccagcgccctggccaggtaagctggggaacctgggctgcctgacttgccggcggcggcagcctggggccgcccggggcgccgcgaggacccggacgcgtggggggcggcgcggaggttgcggcccgagcgctccagagcgctgccctcccgactcagcgtggctgcggggcggccgccgctgggatatgggggtacagcccggcggccccactcctctctgaccggccgcttccccctcccacgacgggtgggcgggcggggcggggaccaggcggcggctctcgcatcccgcgcggggggcaccgcggcaaggggccacccggcgcggacaagaggcgctgtgtggcggggctgtccgctcgactcctgccgggctggccgggctgcttggcaccggcatcaagtccccgtgccgggcggcaactactgagtttggggtcgcctctgggttcgctgcccccagagaacccaagcccagatcttcgcccccttcccttt

SEQ ID NO: 110440 - DNA, 297 bp, Homo sapiens; identical to SEQ ID NO: 44216
  misc_feature 1..297: note = chr15:29133536-29133833
  misc_feature 1..297: note = Hypo
  source 1..297: mol_type = genomic DNA

SEQ ID NO: 110441 - DNA, 166 bp, Homo sapiens; identical to SEQ ID NO: 77454
  misc_feature 1..166: note = chr15:29145324-29145490
  misc_feature 1..166: note = Hypo
  source 1..166: mol_type = genomic DNA

SEQ ID NO: 110442 - DNA, 129 bp, Homo sapiens; identical to SEQ ID NO: 77455
  misc_feature 1..129: note = chr15:29158096-29158225
  misc_feature 1..129: note = Hypo
  source 1..129: mol_type = genomic DNA

SEQ ID NO: 110443 - DNA, 30 bp, Homo sapiens; identical to SEQ ID NO: 44218
  misc_feature 1..30: note = chr15:29221674-29221704
  misc_feature 1..30: note = Hypo
  source 1..30: mol_type = genomic DNA

SEQ ID NO: 110444 - DNA, 68 bp, Homo sapiens; identical to SEQ ID NO: 77457
  misc_feature 1..68: note = chr15:29223705-29223773
  misc_feature 1..68: note = Hypo
  source 1..68: mol_type = genomic DNA

SEQ ID NO: 110445 - DNA, 52 bp, Homo sapiens; identical to SEQ ID NO: 77458
  misc_feature 1..52: note = chr15:29263052-29263104
  misc_feature 1..52: note = Hypo
  source 1..52: mol_type = genomic DNA

SEQ ID NO: 110446 - DNA, 44 bp, Homo sapiens; identical to SEQ ID NO: 77459
  misc_feature 1..44: note = chr15:29283583-29283627
  misc_feature 1..44: note = Hypo
  source 1..44: mol_type = genomic DNA

SEQ ID NO: 110447 - DNA, 22 bp, Homo sapiens
  misc_feature 1..22: note = chr15:29302734-29302756
  misc_feature 1..22: note = Hypo
  source 1..22: mol_type = genomic DNA
acaggtgcgagccaccacaccc

SEQ ID NO: 110448 - DNA, 30 bp, Homo sapiens; identical to SEQ ID NO: 77461
  misc_feature 1..30: note = chr15:29389670-29389700
  misc_feature 1..30: note = Hypo
  source 1..30: mol_type = genomic DNA

SEQ ID NO: 110449 - DNA, 35 bp, Homo sapiens; identical to SEQ ID NO: 77462
  misc_feature 1..35: note = chr15:29396552-29396587
  misc_feature 1..35: note = Hypo
  source 1..35: mol_type = genomic DNA

SEQ ID NO: 110450 - DNA, 30 bp, Homo sapiens; identical to SEQ ID NO: 44219
  misc_feature 1..30: note = chr15:29397531-29397561
  misc_feature 1..30: note = Hypo
  source 1..30: mol_type = genomic DNA

SEQ ID NO: 110451 - DNA, 349 bp, Homo sapiens; identical to SEQ ID NO: 77464
  misc_feature 1..349: note = chr15:29407125-29407474
  misc_feature 1..349: note = Hyper
  source 1..349: mol_type = genomic DNA

SEQ ID NO: 110452 - DNA, 389 bp, Homo sapiens
  misc_feature 1..389: note = chr15:29407737-29408126
  misc_feature 1..389: note = Hyper
  source 1..389: mol_type = genomic DNA
ccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtg

SEQ ID NO: 110453 - DNA, 23 bp, Homo sapiens
  misc_feature 1..23: note = chr15:29408816-29408839
  misc_feature 1..23: note = Hypo
  source 1..23: mol_type = genomic DNA
caagactccgtctcaaaaaaaaa

SEQ ID NO: 110454 - DNA, 58 bp, Homo sapiens; identical to SEQ ID NO: 77468
  misc_feature 1..58: note = chr15:29409339-29409397
  misc_feature 1..58: note = Hypo
  source 1..58: mol_type = genomic DNA

SEQ ID NO: 110455 - DNA, 30 bp, Homo sapiens; identical to SEQ ID NO: 77469
  misc_feature 1..30: note = chr15:29409660-29409690
  misc_feature 1..30: note = Hypo
  source 1..30: mol_type = genomic DNA

SEQ ID NO: 110456 - DNA, 33 bp, Homo sapiens; identical to SEQ ID NO: 77470
  misc_feature 1..33: note = chr15:29410533-29410566
  misc_feature 1..33: note = Hypo
  source 1..33: mol_type = genomic DNA

SEQ ID NO: 110457 - DNA, 25 bp, Homo sapiens
  misc_feature 1..25: note = chr15:29449033-29449058
  misc_feature 1..25: note = Hypo
  source 1..25: mol_type = genomic DNA
cctcagcaggccaggcgcagtggct

SEQ ID NO: 110458 - DNA, 71 bp, Homo sapiens; identical to SEQ ID NO: 77472
  misc_feature 1..71: note = chr15:29561245-29561316
  misc_feature 1..71: note = Hyper
  source 1..71: mol_type = genomic DNA

SEQ ID NO: 110459 - DNA, 22 bp, Homo sapiens
  misc_feature 1..22: note = chr15:29610811-29610833
  misc_feature 1..22: note = Hypo
  source 1..22: mol_type = genomic DNA
ccacgcccggccaaattaaggt

SEQ ID NO: 110460 - DNA, 171 bp, Homo sapiens; identical to SEQ ID NO: 77474
  misc_feature 1..171: note = chr15:29721859-29722030
  misc_feature 1..171: note = Hypo
  source 1..171: mol_type = genomic DNA

SEQ ID NO: 110461 - DNA, 524 bp, Homo sapiens; identical to SEQ ID NO: 35620
  misc_feature 1..524: note = chr15:29861915-29862439
  misc_feature 1..524: note = Hyper
  source 1..524: mol_type = genomic DNA

SEQ ID NO: 110462 - DNA, 352 bp, Homo sapiens; identical to SEQ ID NO: 77476
  misc_feature 1..352: note = chr15:29862870-29863222
  misc_feature 1..352: note = Hyper
  source 1..352: mol_type = genomic DNA

SEQ ID NO: 110463 - DNA, 132 bp, Homo sapiens; identical to SEQ ID NO: 77477
  misc_feature 1..132: note = chr15:29863519-29863651
  misc_feature 1..132: note = Hyper
  source 1..132: mol_type = genomic DNA

SEQ ID NO: 110464 - DNA, 118 bp, Homo sapiens; identical to SEQ ID NO: 77478
  misc_feature 1..118: note = chr15:30113866-30113984
  misc_feature 1..118: note = Hyper
  source 1..118: mol_type = genomic DNA

SEQ ID NO: 110465 - DNA, 30 bp, Homo sapiens; identical to SEQ ID NO: 77479
  misc_feature 1..30: note = chr15:30114780-30114810
  misc_feature 1..30: note = Hyper
  source 1..30: mol_type = genomic DNA

SEQ ID NO: 110466 - DNA, 860 bp, Homo sapiens; identical to SEQ ID NO: 77480
  misc_feature 1..860: note = chr15:30260547-30261407
  misc_feature 1..860: note = Hyper
  source 1..860: mol_type = genomic DNA

SEQ ID NO: 110467 - DNA, 43 bp, Homo sapiens; identical to SEQ ID NO: 77481
  misc_feature 1..43: note = chr15:31083763-31083806
  misc_feature 1..43: note = Hypo
  source 1..43: mol_type = genomic DNA

SEQ ID NO: 110468 - DNA, 60 bp, Homo sapiens; identical to SEQ ID NO: 77482
  misc_feature 1..60: note = chr15:31121966-31122026
  misc_feature 1..60: note = Hypo
  source 1..60: mol_type = genomic DNA

SEQ ID NO: 110469 - DNA, 30 bp, Homo sapiens; identical to SEQ ID NO: 77483
  misc_feature 1..30: note = chr15:31126524-31126554
  misc_feature 1..30: note = Hypo
  source 1..30: mol_type = genomic DNA

SEQ ID NO: 110470 - DNA, 30 bp, Homo sapiens; identical to SEQ ID NO: 44225
  misc_feature 1..30: note = chr15:31221190-31221220
  misc_feature 1..30: note = Hypo
  source 1..30: mol_type = genomic DNA

SEQ ID NO: 110471 - DNA, 167 bp, Homo sapiens; identical to SEQ ID NO: 44226
  misc_feature 1..167: note = chr15:31377678-31377845
  misc_feature 1..167: note = Hypo
  source 1..167: mol_type = genomic DNA

SEQ ID NO: 110472 - DNA, 112 bp, Homo sapiens; identical to SEQ ID NO: 77486
  misc_feature 1..112: note = chr15:31455390-31455502
  misc_feature 1..112: note = Hypo
  source 1..112: mol_type = genomic DNA

SEQ ID NO: 110473 - DNA, 30 bp, Homo sapiens; identical to SEQ ID NO: 44227
  misc_feature 1..30: note = chr15:31509535-31509565
  misc_feature 1..30: note = Hypo
  source 1..30: mol_type = genomic DNA

SEQ ID NO: 110474 - DNA, 30 bp, Homo sapiens; identical to SEQ ID NO: 44228
  misc_feature 1..30: note = chr15:31539632-31539662
  misc_feature 1..30: note = Hypo
  source 1..30: mol_type = genomic DNA

SEQ ID NO: 110475 - DNA, 33 bp, Homo sapiens; identical to SEQ ID NO: 77489
  misc_feature 1..33: note = chr15:31564940-31564973
  misc_feature 1..33: note = Hypo
  source 1..33: mol_type = genomic DNA

SEQ ID NO: 110476 - DNA, 30 bp, Homo sapiens; identical to SEQ ID NO: 77490
  misc_feature 1..30: note = chr15:31566708-31566738
  misc_feature 1..30: note = Hypo
  source 1..30: mol_type = genomic DNA

SEQ ID NO: 110477 - DNA, 30 bp, Homo sapiens; identical to SEQ ID NO: 77491
  misc_feature 1..30: note = chr15:31597382-31597412
  misc_feature 1..30: note = Hypo
  source 1..30: mol_type = genomic DNA

SEQ ID NO: 110478 - DNA, 159 bp, Homo sapiens; identical to SEQ ID NO: 77492
  misc_feature 1..159: note = chr15:31599458-31599617
  misc_feature 1..159: note = Hypo
  source 1..159: mol_type = genomic DNA

SEQ ID NO: 110479 - DNA, 30 bp, Homo sapiens; identical to SEQ ID NO: 77493
  misc_feature 1..30: note = chr15:31601868-31601898
  misc_feature 1..30: note = Hypo
  source 1..30: mol_type = genomic DNA

SEQ ID NO: 110480 - DNA, 56 bp, Homo sapiens; identical to SEQ ID NO: 44229
  misc_feature 1..56: note = chr15:31603992-31604048
  misc_feature 1..56: note = Hypo
  source 1..56: mol_type = genomic DNA

SEQ ID NO: 110481 - DNA, 30 bp, Homo sapiens; identical to SEQ ID NO: 77495
  misc_feature 1..30: note = chr15:31668057-31668087
  misc_feature 1..30: note = Hypo
  source 1..30: mol_type = genomic DNA

SEQ ID NO: 110482 - DNA, 30 bp, Homo sapiens; identical to SEQ ID NO: 77496
  misc_feature 1..30: note = chr15:31669119-31669149
  misc_feature 1..30: note = Hypo
  source 1..30: mol_type = genomic DNA

SEQ ID NO: 110483 - DNA, 142 bp, Homo sapiens; identical to SEQ ID NO: 77497
  misc_feature 1..142: note = chr15:31727629-31727771
  misc_feature 1..142: note = Hyper
  source 1..142: mol_type = genomic DNA

SEQ ID NO: 110484 - DNA, 937 bp, Homo sapiens
  misc_feature 1..937: note = chr15:31775237-31776174
  misc_feature 1..937: note = Hyper
  source 1..937: mol_type = genomic DNA
gagtttccacaggtacgaggcagatgctaggctagcacacccacttccaacagtatgacttgtttcctatccgtctactacctgagtggcgtcagtgtaggttcaggcaccattaggaacgtttgaccaaacacgtacacggcactgacagaggaggcgccggccttccggtggaccagggcatgtaaaaaagacaccgacacaatggaaaagaaatcctcgaaggtagaacctcgccgcccgcgccgcgccgcgccgctcagggccgggccccgcgcgcctcgcgccgccgccgcagctcctcgcggtagcagtaggagcagtagtgctcggtctcggcgcgcccgtagaacgcacagttctcgcgctggcagcgccgctgcaccggccccgggccgccacggccgcactcaccgttcgagcgcgcggtcggcgcgtcggcgtcggcgaactccaggccgtcgcgcagggcgccgaagccgttggtgtaggtctgcgacttgtgctcggccgcccccgccgtccccgccgcgcccggtagggccccgggcaccgcgcgcgccagcgactcgaccgtgttgacggtgcgcagggcggcggcgcgcgccgggctgtagctctgcgacgacagcgagcggttctgctgcgggtacgtggcgcacggccgcagcgcccccacggccggcgcgcacgcctcgtcccgcgcgcccgacgcctgcacgtggatgacgctctggcgcgctggcgccggggggctgcggccaggcactggtccgctggcgctcgcacgccgcgcgcctccccccggggaggccgtgccgcccgccgccgcccgcgccgcacgccctgccgcgggcccggggctcggccgctccttgagcttgagcaccagctgcgtgggtgggcccggagaggcgcgctccgggaccggcacgcc

SEQ ID NO: 110485 - DNA, 107 bp, Homo sapiens; identical to SEQ ID NO: 77502
  misc_feature 1..107: note = chr15:31778235-31778342
  misc_feature 1..107: note = Hypo
  source 1..107: mol_type = genomic DNA

SEQ ID NO: 110486 - DNA, 41 bp, Homo sapiens; identical to SEQ ID NO: 77503
  misc_feature 1..41: note = chr15:31813319-31813360
  misc_feature 1..41: note = Hypo
  source 1..41: mol_type = genomic DNA

SEQ ID NO: 110487 - DNA, 70 bp, Homo sapiens; identical to SEQ ID NO: 77504
  misc_feature 1..70: note = chr15:31830234-31830304
  misc_feature 1..70: note = Hypo
  source 1..70: mol_type = genomic DNA

SEQ ID NO: 110488 - DNA, 30 bp, Homo sapiens; identical to SEQ ID NO: 77505
  misc_feature 1..30: note = chr15:31862270-31862300
  misc_feature 1..30: note = Hypo
  source 1..30: mol_type = genomic DNA

SEQ ID NO: 110489 - DNA, 196 bp, Homo sapiens; identical to SEQ ID NO: 77506
  misc_feature 1..196: note = chr15:31897790-31897986
  misc_feature 1..196: note = Hypo
  source 1..196: mol_type = genomic DNA

SEQ ID NO: 110490 - DNA, 30 bp, Homo sapiens; identical to SEQ ID NO: 77507
  misc_feature 1..30: note = chr15:31991592-31991622
  misc_feature 1..30: note = Hypo
  source 1..30: mol_type = genomic DNA

SEQ ID NO: 110491 - DNA, 67 bp, Homo sapiens; identical to SEQ ID NO: 35629
  misc_feature 1..67: note = chr15:32162215-32162282
  misc_feature 1..67: note = Hyper
  source 1..67: mol_type = genomic DNA

SEQ ID NO: 110492 - DNA, 32 bp, Homo sapiens; identical to SEQ ID NO: 77509
  misc_feature 1..32: note = chr15:32162491-32162523
  misc_feature 1..32: note = Hyper
  source 1..32: mol_type = genomic DNA

SEQ ID NO: 110493 - DNA, 407 bp, Homo sapiens; identical to SEQ ID NO: 77510
  misc_feature 1..407: note = chr15:32322366-32322773
  misc_feature 1..407: note = Hyper
  source 1..407: mol_type = genomic DNA

SEQ ID NO: 110494 - DNA, 17 bp, Homo sapiens
  misc_feature 1..17: note = chr15:32934467-32934484
  misc_feature 1..17: note = Hypo
  source 1..17: mol_type = genomic DNA
tagaaggagggtttgcg

SEQ ID NO: 110495 - DNA, 2080 bp, Homo sapiens
  misc_feature 1..2080: note = chr15:33009591-33011671
  misc_feature 1..2080: note = Hyper
  source 1..2080: mol_type = genomic DNA
acaggctcctgctggcggccagcgagcccgccaggttaacgggggcgccggggtcagcgccctcgaagttgggggcctcgggcggggccgccggggagccacgacggccgctcgaccagagcatcccgcagtcccgttccctccagaggggaagaatggccgaatctggcacgatcccacggagatctcgctcttcccagcgcagtctccgctactgagcgcgggaccaacgcaggcgatgccgggcggccgacagggaaagcccagacctggggcagagaaggaatgaggggccgccagccggggggatttcctcccgctcttccctctccaacgggagcggaaaatgtgatttgctgtgcattccaggcgcggttccctggggtgacctctcccagccggcccgggcggggggagcagacaaagaggcgaggcgggcggagaggggaccccgcggggaagcaggaggggtgcggggggcgggggcagtaccgggaaagggggcggatagcgggtctggcggcggcggcggcgcctggccaatggagaggcgcggccccgggcgccgcgctctgccgccggcatttaaacgggagacggcgcgatgcctggcactcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacaggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctgggggcgtcttggggcgcccattggagtccgcgggttggagcatccggagaatccatgatgtgtgcatttgccgatccccgaggtgagatggagactggcaagggcagagccgctgtgttcagccacagcggaaaaccgaacggtgggtaatccgacagctgcggtgcggggcgcggccctggccgcggggtccagcgaacccgcagtgctcacaaggcagacaccacacgcgctcgcggaccggccacgcactcgcgggcgctcgcttctctactccagcctcttccccgccccgcgcacgcccgggctgaatggtagacgttctggcgccgggcagcggccaccggctggttcccacttccgcgcgcaccccttaaactgtgttctagaggccccagcctcgccttgcagcgcctcactagctcctgaggactagggactggcggctgaggcgggttggcggctgcaacgagctgggcgtctttcgttctctctcgctgcctggctggctccgctggcccctccacagcttgcggagcaaggccatagcaggggagtgggaggtatattggggctgtcacctccttgctggccggagttatttgtagactacagactccggaagaacagacgcgccaccgctctcgcttggcattgccttcggatcgcagctcctccttgggggtgccccagcttggcgtttatttgcctgcgccaggctctggcgacggtcaccgggccaggcggggagggacggacggcaggtgaccagcctctgctgtgaagaaattcctgcgcgcccggagctgtccctaatgcattcccgggtcgaatccgtctactgccttcc

SEQ ID NO: 110496 - DNA, 77 bp, Homo sapiens; identical to SEQ ID NO: 77517
  misc_feature 1..77: note = chr15:33438087-33438164
  misc_feature 1..77: note = Hypo
  source 1..77: mol_type = genomic DNA

SEQ ID NO: 110497 - DNA, 16 bp, Homo sapiens
  misc_feature 1..16: note = chr15:33438284-33438300
  misc_feature 1..16: note = Hypo
  source 1..16: mol_type = genomic DNA
tcgggcttcagcctcc

SEQ ID NO: 110498 - DNA, 223 bp, Homo sapiens; identical to SEQ ID NO: 77519
  misc_feature 1..223: note = chr15:33486950-33487173
  misc_feature 1..223: note = Hyper
  source 1..223: mol_type = genomic DNA

SEQ ID NO: 110499 - DNA, 97 bp, Homo sapiens; identical to SEQ ID NO: 77520
  misc_feature 1..97: note = chr15:33541637-33541734
  misc_feature 1..97: note = Hypo
  source 1..97: mol_type = genomic DNA

SEQ ID NO: 110500 - DNA, 1069 bp, Homo sapiens
  misc_feature 1..1069: note = chr15:33602706-33603775
  misc_feature 1..1069: note = Hyper
  source 1..1069: mol_type = genomic DNA
gcaaagcgggcaaagcgagcaaagcgagagggttggtacccagtctgggcgcgctggagctaagcaactggcctttgtttgtgaattggagcagtttaggggacatcctccggtcgccgcggggcgcgcgcctccgctgagtgtgcggtgcggtacccagcggtgcgggggaggctccaccgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgccgggggaagcagaggcgccggaggctggggcaccgccgacgcctcgggagccatggccgaagggggagaaggaggcgaggacgagatccagtttctgaggactgtgagtctccgcggcgggggcgaggccgtgggcaggtggggaggagcgcggagcgcggcgaggaggggctggctgcgctgcgccgcggtgccgggtgcccggtgccgggcgctttctccgcacccgcgggctgcagaggcggaccggccacctacccgcggggccgcgaggggctgcgtgggaaggggcaccatctcctgcctctcccttgttcccctaccgccacccctgccccaggccctccacctaggaccgctcgctctccaggcaacttgctacttggtctgaaacccttgatgcccaaacttcagccggggtttgttcgcggttgtcctgacccataagatcggcgttggaagccctcgccccggggtcggccctctgacacctccatactccaccccagccccattcctcttccagggcgcccccacgcacaggggaacctccgggaaggagccagcggggcaggggggag

SEQ ID NO: 110501 - DNA, 37 bp, Homo sapiens; identical to SEQ ID NO: 77523
  misc_feature 1..37: note = chr15:33628963-33629000
  misc_feature 1..37: note = Hypo
  source 1..37: mol_type = genomic DNA

SEQ ID NO: 110502 - DNA, 25 bp, Homo sapiens
  misc_feature 1..25: note = chr15:33632111-33632136
  misc_feature 1..25: note = Hypo
  source 1..25: mol_type = genomic DNA
ttaccttagtcgtggaacaccaaag

SEQ ID NO: 110503 - DNA, 17 bp, Homo sapiens
  misc_feature 1..17: note = chr15:33633532-33633549
  misc_feature 1..17: note = Hypo
  source 1..17: mol_type = genomic DNA
cccggtctgattcagtg

SEQ ID NO: 110504 - DNA, 30 bp, Homo sapiens; identical to SEQ ID NO: 44235
  misc_feature 1..30: note = chr15:33727786-33727816
  misc_feature 1..30: note = Hypo
  source 1..30: mol_type = genomic DNA

SEQ ID NO: 110505 - DNA, 30 bp, Homo sapiens; identical to SEQ ID NO: 44236
  misc_feature 1..30: note = chr15:33746640-33746670
  misc_feature 1..30: note = Hypo
  source 1..30: mol_type = genomic DNA

SEQ ID NO: 110506 - DNA, 45 bp, Homo sapiens; identical to SEQ ID NO: 77528
  misc_feature 1..45: note = chr15:33879242-33879287
  misc_feature 1..45: note = Hypo
  source 1..45: mol_type = genomic DNA

SEQ ID NO: 110507 - DNA, 30 bp, Homo sapiens; identical to SEQ ID NO: 77529
  misc_feature 1..30: note = chr15:33952401-33952431
  misc_feature 1..30: note = Hypo
  source 1..30: mol_type = genomic DNA

SEQ ID NO: 110508 - DNA, 229 bp, Homo sapiens; identical to SEQ ID NO: 77530
  misc_feature 1..229: note = chr15:33954397-33954626
  misc_feature 1..229: note = Hypo
  source 1..229: mol_type = genomic DNA

SEQ ID NO: 110509 - DNA, 80 bp, Homo sapiens; identical to SEQ ID NO: 77531
  misc_feature 1..80: note = chr15:34014994-34015074
  misc_feature 1..80: note = Hypo
  source 1..80: mol_type = genomic DNA

SEQ ID NO: 110510 - DNA, 30 bp, Homo sapiens; identical to SEQ ID NO: 77532
  misc_feature 1..30: note = chr15:34067983-34068013
  misc_feature 1..30: note = Hypo
  source 1..30: mol_type = genomic DNA

SEQ ID NO: 110511 - DNA, 30 bp, Homo sapiens; identical to SEQ ID NO: 77533
  misc_feature 1..30: note = chr15:34124561-34124591
  misc_feature 1..30: note = Hypo
  source 1..30: mol_type = genomic DNA

SEQ ID NO: 110512 - DNA, 19 bp, Homo sapiens
  misc_feature 1..19: note = chr15:34208027-34208046
  misc_feature 1..19: note = Hypo
  source 1..19: mol_type = genomic DNA
actccgtgctgttggagaa

SEQ ID NO: 110513 - DNA, 31 bp, Homo sapiens; identical to SEQ ID NO: 77535
  misc_feature 1..31: note = chr15:34339559-34339590
  misc_feature 1..31: note = Hypo
  source 1..31: mol_type = genomic DNA

SEQ ID NO: 110514 - DNA, 30 bp, Homo sapiens; identical to SEQ ID NO: 77536
  misc_feature 1..30: note = chr15:34353236-34353266
  misc_feature 1..30: note = Hypo
  source 1..30: mol_type = genomic DNA

SEQ ID NO: 110515 - DNA, 61 bp, Homo sapiens; identical to SEQ ID NO: 77537
  misc_feature 1..61: note = chr15:34394495-34394556
  misc_feature 1..61: note = Hyper
  source 1..61: mol_type = genomic DNA

SEQ ID NO: 110516 - DNA, 29 bp, Homo sapiens
  misc_feature 1..29: note = chr15:34630420-34630449
  misc_feature 1..29: note = Hyper
  source 1..29: mol_type = genomic DNA
agcatcctagagggcgggcgctgctcctc

SEQ ID NO: 110517 - DNA, 267 bp, Homo sapiens; identical to SEQ ID NO: 77538
  misc_feature 1..267: note = chr15:34634214-34634481
  misc_feature 1..267: note = Hypo
  source 1..267: mol_type = genomic DNA

SEQ ID NO: 110518 - DNA, 30 bp, Homo sapiens; identical to SEQ ID NO: 77539
  misc_feature 1..30: note = chr15:34726887-34726917
  misc_feature 1..30: note = Hypo
  source 1..30: mol_type = genomic DNA

SEQ ID NO: 110519 - DNA, 812 bp, Homo sapiens; identical to SEQ ID NO: 77540
  misc_feature 1..812: note = chr15:34728824-34729636
  misc_feature 1..812: note = Hyper
  source 1..812: mol_type = genomic DNA

SEQ ID NO: 110520 - DNA, 99 bp, Homo sapiens; identical to SEQ ID NO: 77541
  misc_feature 1..99: note = chr15:34729944-34730043
  misc_feature 1..99: note = Hyper
  source 1..99: mol_type = genomic DNA

SEQ ID NO: 110521 - DNA, 1024 bp, Homo sapiens
  misc_feature 1..1024: note = chr15:34786477-34787501
  misc_feature 1..1024: note = Hyper
  source 1..1024: mol_type = genomic DNA
gaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagacctt

SEQ ID NO: 110522 - DNA, 154 bp, Homo sapiens
  misc_feature 1..154: note = chr15:34806487-34806641
  misc_feature 1..154: note = Hyper
  source 1..154: mol_type = genomic DNA
ccccgcctgggctcaaaaaacgccggagccgccctgcaccgccctgtcgcggtctccggagcaggctggccgactgagggcgaccatgggtcccaagaaggctccggcagtcgcgggctcccacctcggggcgcggcgacgggggcctagaggg

SEQ ID NO: 110523 - DNA, 513 bp, Homo sapiens; identical to SEQ ID NO: 77545
  misc_feature 1..513: note = chr15:34806875-34807388
  misc_feature 1..513: note = Hyper
  source 1..513: mol_type = genomic DNA

SEQ ID NO: 110524 - DNA, 42 bp, Homo sapiens; identical to SEQ ID NO: 77546
  misc_feature 1..42: note = chr15:34876396-34876438
  misc_feature 1..42: note = Hyper
  source 1..42: mol_type = genomic DNA

SEQ ID NO: 110525 - DNA, 36 bp, Homo sapiens; identical to SEQ ID NO: 44238
  misc_feature 1..36: note = chr15:34879893-34879929
  misc_feature 1..36: note = Hypo
  source 1..36: mol_type = genomic DNA

SEQ ID NO: 110526 - DNA, 30 bp, Homo sapiens; identical to SEQ ID NO: 77548
  misc_feature 1..30: note = chr15:34911483-34911513
  misc_feature 1..30: note = Hypo
  source 1..30: mol_type = genomic DNA

SEQ ID NO: 110527 - DNA, 30 bp, Homo sapiens; identical to SEQ ID NO: 77549
  misc_feature 1..30: note = chr15:34915716-34915746
  misc_feature 1..30: note = Hypo
  source 1..30: mol_type = genomic DNA

SEQ ID NO: 110528 - DNA, 136 bp, Homo sapiens
  misc_feature 1..136: note = chr15:35014151-35014287
  misc_feature 1..136: note = Hyper
  source 1..136: mol_type = genomic DNA
ccagcactcggcgggcgcaggctgagctggtgacccgggcaggaccggagccaaaggattaatccatcacaatgagacgttctattctgggcaggcggcgcgagcagatgctgggcgccggcggaggcagcgtgca

SEQ ID NO: 110529 - DNA, 921 bp, Homo sapiens
  misc_feature 1..921: note = chr15:35046870-35047791
  misc_feature 1..921: note = Hyper
  source 1..921: mol_type = genomic DNA
ggaaagaaatccaagcgcgtcccgaccgatggggcagttggcgcggtctagagagagggcacgaacctcgggcgccgtccggggttcgggtctggatcccgcggacgccgggacgaggggcggggcggggtggcagcctgcaggtcctccagcgctcgcccgcccaggagaagtctcagcgccgctctccgccgcaggttgggggccaggggagggtccgaacaccggctctgttcctgctacttcagcgggcacctggcgctccggcgcggcagcctgcgaggccagggccgagcgcgcggagccgaatgctgggctcggggatccgcggccgccgcctctaatccgcccttaagtagtctccgcctgcgtcacgccaggtcggcggaggggagcagagcgcgccgtgcggctgtcgctgcgcgtcggagcccgaggggccggggacgcgcgcggggggagaggggcaagagtcctggaggcccggcggggagcggggcgatttcgaaaggaaggactgcagcgcccctcggggcttctcggggagcccaggtaacctcacctgaccgccagacccaagcaggcggagggggagccgggagcggacgcgtgggtgagtggggaggggagtgagtaggtatcttctcttctctcggtgcatccctcaccttttcgctttttgcctcctggagacaactgaaattccttccctagatggagatgctggctgagggagggcgagtgggggcgaccacttttaaatctcccttaggggacagagtggctgagagtgcttctgcagagtggctgcggttcggtgcctctgtggatccgacagtgaagtgagaaaggcttgatgggaatccatttaggctgaagggtaaatgcaggtgtggagctgtctctcggtataggggtcag

SEQ ID NO: 110530 - DNA, 30 bp, Homo sapiens; identical to SEQ ID NO: 77554
  misc_feature 1..30: note = chr15:35084827-35084857
  misc_feature 1..30: note = Hypo
  source 1..30: mol_type = genomic DNA

SEQ ID NO: 110531 - DNA, 192 bp, Homo sapiens; identical to SEQ ID NO: 77555
  misc_feature 1..192: note = chr15:35087595-35087787
  misc_feature 1..192: note = Hyper
  source 1..192: mol_type = genomic DNA

SEQ ID NO: 110532 - DNA, 17 bp, Homo sapiens
  misc_feature 1..17: note = chr15:35262895-35262912
  misc_feature 1..17: note = Hypo
  source 1..17: mol_type = genomic DNA
agcgagactagcctcaa

SEQ ID NO: 110533 - DNA, 120 bp, Homo sapiens; identical to SEQ ID NO: 77557
  misc_feature 1..120: note = chr15:35310610-35310730
  misc_feature 1..120: note = Hypo
  source 1..120: mol_type = genomic DNA

SEQ ID NO: 110534 - DNA, 39 bp, Homo sapiens; identical to SEQ ID NO: 77558
  misc_feature 1..39: note = chr15:35970597-35970636
  misc_feature 1..39: note = Hypo
  source 1..39: mol_type = genomic DNA

SEQ ID NO: 110535 - DNA, 258 bp, Homo sapiens; identical to SEQ ID NO: 77559
  misc_feature 1..258: note = chr15:37175038-37175296
  misc_feature 1..258: note = Hyper
  source 1..258: mol_type = genomic DNA

SEQ ID NO: 110536 - DNA, 35 bp, Homo sapiens; identical to SEQ ID NO: 77560
  misc_feature 1..35: note = chr15:37180103-37180138
  misc_feature 1..35: note = Hyper
  source 1..35: mol_type = genomic DNA

SEQ ID NO: 110537 - DNA, 291 bp, Homo sapiens; identical to SEQ ID NO: 1200
  misc_feature 1..291: note = chr15:37180507-37180798
  misc_feature 1..291: note = Hyper
  source 1..291: mol_type = genomic DNA

SEQ ID NO: 110538 - DNA, 337 bp, Homo sapiens; identical to SEQ ID NO: 77562
  misc_feature 1..337: note = chr15:37394400-37394737
  misc_feature 1..337: note = Hyper
  source 1..337: mol_type = genomic DNA

SEQ ID NO: 110539 - DNA, 42 bp, Homo sapiens
  misc_feature 1..42: note = chr15:37399219-37399261
  misc_feature 1..42: note = Hyper
  source 1..42: mol_type = genomic DNA
tttaggtcagaaggccgagtctcagtgcgagattgaggaagg

SEQ ID NO: 110540 - DNA, 339 bp, Homo sapiens
  misc_feature 1..339: note = chr15:37402997-37403336
  misc_feature 1..339: note = Hyper
  source 1..339: mol_type = genomic DNA
aactcaatctcagggcggggtgtgagagctgggggtgagctggctcgggccgggacagaggtctctctgcgtacgccccgctccgcccggcgccaagggaagccgctgtctcttccgtcgagttctgagaccttggcaaacttccctcccccaaccgccggcgtgacttctgagttgtcactaatccgaacctgatattcaccagagctccttcggtcaccgacaacgctccccgctgctgccgcggcctcccgcccgccctcctcggcgtgttttcatttctaagtctacgggcagggattgccccgacccagtgtgtgtgtgcgtgtgtgtgtgtgc

SEQ ID NO: 110541 - DNA, 163 bp, Homo sapiens; identical to SEQ ID NO: 44239
  misc_feature 1..163: note = chr15:38218484-38218647
  misc_feature 1..163: note = Hypo
  source 1..163: mol_type = genomic DNA

SEQ ID NO: 110542 - DNA, 30 bp, Homo sapiens; identical to SEQ ID NO: 77566
  misc_feature 1..30: note = chr15:38330892-38330922
  misc_feature 1..30: note = Hypo
  source 1..30: mol_type = genomic DNA

SEQ ID NO: 110543 - DNA, 178 bp, Homo sapiens; identical to SEQ ID NO: 77567
  misc_feature 1..178: note = chr15:39110605-39110783
  misc_feature 1..178: note = Hypo
  source 1..178: mol_type = genomic DNA

SEQ ID NO: 110544 - DNA, 30 bp, Homo sapiens; identical to SEQ ID NO: 77568
  misc_feature 1..30: note = chr15:39416451-39416481
  misc_feature 1..30: note = Hypo
  source 1..30: mol_type = genomic DNA

SEQ ID NO: 110545 - DNA, 378 bp, Homo sapiens
  misc_feature 1..378: note = chr15:39873123-39873501
  misc_feature 1..378: note = Hyper
  source 1..378: mol_type = genomic DNA
ctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagt

SEQ ID NO: 110546 - DNA, 691 bp, Homo sapiens; identical to SEQ ID NO: 77571
  misc_feature 1..691: note = chr15:40211553-40212244
  misc_feature 1..691: note = Hyper
  source 1..691: mol_type = genomic DNA

SEQ ID NO: 110547 - DNA, 353 bp, Homo sapiens; identical to SEQ ID NO: 77572
  misc_feature 1..353: note = chr15:40212601-40212954
  misc_feature 1..353: note = Hyper
  source 1..353: mol_type = genomic DNA

SEQ ID NO: 110548 - DNA, 17 bp, Homo sapiens
  misc_feature 1..17: note = chr15:40228636-40228653
  misc_feature 1..17: note = Hypo
  source 1..17: mol_type = genomic DNA
ggagtttctctctgtcg

SEQ ID NO: 110549 - DNA, 47 bp, Homo sapiens; identical to SEQ ID NO: 77574
  misc_feature 1..47: note = chr15:40368182-40368229
  misc_feature 1..47: note = Hypo
  source 1..47: mol_type = genomic DNA

SEQ ID NO: 110550 - DNA, 30 bp, Homo sapiens; identical to SEQ ID NO: 77575
  misc_feature 1..30: note = chr15:40420189-40420219
  misc_feature 1..30: note = Hypo
  source 1..30: mol_type = genomic DNA

SEQ ID NO: 110551 - DNA, 84 bp, Homo sapiens; identical to SEQ ID NO: 77576
  misc_feature 1..84: note = chr15:40420940-40421024
  misc_feature 1..84: note = Hypo
  source 1..84: mol_type = genomic DNA

SEQ ID NO: 110552 - DNA, 101 bp, Homo sapiens; identical to SEQ ID NO: 77577
  misc_feature 1..101: note = chr15:40423345-40423446
  misc_feature 1..101: note = Hypo
  source 1..101: mol_type = genomic DNA

SEQ ID NO: 110553 - DNA, 189 bp, Homo sapiens; identical to SEQ ID NO: 77578
  misc_feature 1..189: note = chr15:40532032-40532221
  misc_feature 1..189: note = Hypo
  source 1..189: mol_type = genomic DNA

SEQ ID NO: 110554 - DNA, 30 bp, Homo sapiens; identical to SEQ ID NO: 44244
  misc_feature 1..30: note = chr15:40532791-40532821
  misc_feature 1..30: note = Hypo
  source 1..30: mol_type = genomic DNA

SEQ ID NO: 110555 - DNA, 779 bp, Homo sapiens; identical to SEQ ID NO: 77580
  misc_feature 1..779: note = chr15:40544663-40545442
  misc_feature 1..779: note = Hyper
  source 1..779: mol_type = genomic DNA

SEQ ID NO: 110556 - DNA, 56 bp, Homo sapiens; identical to SEQ ID NO: 44245
  misc_feature 1..56: note = chr15:40545776-40545832
  misc_feature 1..56: note = Hypo
  source 1..56: mol_type = genomic DNA

SEQ ID NO: 110557 - DNA, 30 bp, Homo sapiens; identical to SEQ ID NO: 44246
  misc_feature 1..30: note = chr15:40546043-40546073
  misc_feature 1..30: note = Hypo
  source 1..30: mol_type = genomic DNA

SEQ ID NO: 110558 - DNA, 43 bp, Homo sapiens; identical to SEQ ID NO: 77583
  misc_feature 1..43: note = chr15:40574169-40574212
  misc_feature 1..43: note = Hyper
  source 1..43: mol_type = genomic DNA

SEQ ID NO: 110559 - DNA, 308 bp, Homo sapiens; identical to SEQ ID NO: 77584
  misc_feature 1..308: note = chr15:40575513-40575821
  misc_feature 1..308: note = Hyper
  source 1..308: mol_type = genomic DNA

SEQ ID NO: 110560 - DNA, 169 bp, Homo sapiens; identical to SEQ ID NO: 77585
  misc_feature 1..169: note = chr15:40639225-40639394
  misc_feature 1..169: note = Hypo
  source 1..169: mol_type = genomic DNA

SEQ ID NO: 110561 - DNA, 31 bp, Homo sapiens; identical to SEQ ID NO: 77586
  misc_feature 1..31: note = chr15:40676552-40676583
  misc_feature 1..31: note = Hypo
  source 1..31: mol_type = genomic DNA

SEQ ID NO: 110562 - DNA, 59 bp, Homo sapiens
  misc_feature 1..59: note = chr15:40729159-40729218
  misc_feature 1..59: note = Hyper
  source 1..59: mol_type = genomic DNA
ggcagactgcaaagacgtcccctggccggcaatctggaggctagcgctgggcagatggg

SEQ ID NO: 110563 - DNA, 27 bp, Homo sapiens
  misc_feature 1..27: note = chr15:40856301-40856328
  misc_feature 1..27: note = Hypo
  source 1..27: mol_type = genomic DNA
agccaccgcgcccggcccctaaattct

SEQ ID NO: 110564 - DNA, 30 bp, Homo sapiens; identical to SEQ ID NO: 77589
  misc_feature 1..30: note = chr15:41056770-41056800
  misc_feature 1..30: note = Hyper
  source 1..30: mol_type = genomic DNA

SEQ ID NO: 110565 - DNA, 30 bp, Homo sapiens; identical to SEQ ID NO: 77590
  misc_feature 1..30: note = chr15:41059436-41059466
  misc_feature 1..30: note = Hypo
  source 1..30: mol_type = genomic DNA

SEQ ID NO: 110566 - DNA, 87 bp, Homo sapiens; identical to SEQ ID NO: 77591
  misc_feature 1..87: note = chr15:41078532-41078619
  misc_feature 1..87: note = Hypo
  source 1..87: mol_type = genomic DNA

SEQ ID NO: 110567 - DNA, 30 bp, Homo sapiens; identical to SEQ ID NO: 71306
  misc_feature 1..30: note = chr15:41091139-41091169
  misc_feature 1..30: note = Hypo
  source 1..30: mol_type = genomic DNA

SEQ ID NO: 110568 - DNA, 30 bp, Homo sapiens; identical to SEQ ID NO: 77593
  misc_feature 1..30: note = chr15:41137117-41137147
  misc_feature 1..30: note = Hyper
  source 1..30: mol_type = genomic DNA

SEQ ID NO: 110569 - DNA, 30 bp, Homo sapiens; identical to SEQ ID NO: 77594
  misc_feature 1..30: note = chr15:41158108-41158138
  misc_feature 1..30: note = Hypo
  source 1..30: mol_type = genomic DNA

SEQ ID NO: 110570 - DNA, 93 bp, Homo sapiens; identical to SEQ ID NO: 77595
  misc_feature 1..93: note = chr15:41164710-41164803
  misc_feature 1..93: note = Hypo
  source 1..93: mol_type = genomic DNA

SEQ ID NO: 110571 - DNA, 412 bp, Homo sapiens; identical to SEQ ID NO: 77596
  misc_feature 1..412: note = chr15:41165245-41165657
  misc_feature 1..412: note = Hypo
  source 1..412: mol_type = genomic DNA

SEQ ID NO: 110572 - DNA, 58 bp, Homo sapiens; identical to SEQ ID NO: 77597
  misc_feature 1..58: note = chr15:41291802-41291860
  misc_feature 1..58: note = Hypo
  source 1..58: mol_type = genomic DNA

SEQ ID NO: 110573 - DNA, 30 bp, Homo sapiens; identical to SEQ ID NO: 77598
  misc_feature 1..30: note = chr15:41409360-41409390
  misc_feature 1..30: note = Hypo
  source 1..30: mol_type = genomic DNA

SEQ ID NO: 110574 - DNA, 45 bp, Homo sapiens; identical to SEQ ID NO: 77599
  misc_feature 1..45: note = chr15:41456235-41456280
  misc_feature 1..45: note = Hypo
  source 1..45: mol_type = genomic DNA

SEQ ID NO: 110575 - DNA, 36 bp, Homo sapiens; identical to SEQ ID NO: 77600
  misc_feature 1..36: note = chr15:41495761-41495797
  misc_feature 1..36: note = Hypo
  source 1..36: mol_type = genomic DNA

SEQ ID NO: 110576 - DNA, 1060 bp, Homo sapiens
  misc_feature 1..1060: note = chr15:41786804-41787864
  misc_feature 1..1060: note = Hyper
  source 1..1060: mol_type = genomic DNA
gctccgccggcgggtcgtggcgctggccctggggcgtctaagaagcggggcgaggagcaggcgacccgccgcggggactgggcgaagcgggggtagcggaccttgttggctgtgggttaggacaggagggatcggaggggctgagccttgccgggtgaaccctcggaaggagagaggcgaaggagagtttcccttaccccccgccccctctccggtgccgcggccgcacccccgccgttgccacggtttccctctcctgagtgggagtggagcggcgctccaggctctgctcgggagccgctgccgtctgctcccagcgcccgcacgaggcgtggacgcaggggagggaggggcgtgggcctgggagctctggctgggagcggaacgcagcccacccagtgcgcgccctgcctcccatcttcccggctcgccgctcctgagcgcggcagagaggggcggtaaactgaggctgcaagggggcaggatcactctgctagtctctgcctctgatagcctgggtgttctgggaccaggtctgaccctcggaaaacacagccctgggcactgttaagtcattcctgacgcccgccacttagggatgtgcggctcccgggacaccctccttgttcccctcgttttaaccaaggccaaataccttgaataactgtccgtggtcagcgcgaaggactttctttagatccacgtttcgcaagtgtccctgaggccgaggaagaggcgaggggcgcccccggcctcgggcgtctggggcctgcccataagtccgggtcggcgcggcggggcggggagagctgtggccgcgcgcctgctccgccgcacaatcggctgggacaaggcagggaagctgtggcgacctgcaggggttcacaagcccggaggccgatggggtttgtcagtgacaccagaggggaaaagcctcacagagcaggaacaccccccgccgccaggtgctgggtgcgccggctcggtcactagcctgccgcttccccttcttccccggtggtcagagcagccccggacccaggatcgtttctggggtaac

SEQ ID NO: 110577 - DNA, 74 bp, Homo sapiens
  misc_feature 1..74: note = chr15:41788152-41788226
  misc_feature 1..74: note = Hyper
  source 1..74: mol_type = genomic DNA
cctcggggacctgggcgaccccgccgccctccgagccgtcgggagccggtgcaaatcgccgctgagggcccttc

SEQ ID NO: 110578 - DNA, 1221 bp, Homo sapiens; identical to SEQ ID NO: 77603
  misc_feature 1..1221: note = chr15:41804641-41805862
  misc_feature 1..1221: note = Hyper
  source 1..1221: mol_type = genomic DNA

SEQ ID NO: 110579 - DNA, 30 bp, Homo sapiens; identical to SEQ ID NO: 77604
  misc_feature 1..30: note = chr15:41806074-41806104
  misc_feature 1..30: note = Hyper
  source 1..30: mol_type = genomic DNA

SEQ ID NO: 110580 - DNA, 95 bp, Homo sapiens; identical to SEQ ID NO: 77605
  misc_feature 1..95: note = chr15:41835731-41835826
  misc_feature 1..95: note = Hypo
  source 1..95: mol_type = genomic DNA

SEQ ID NO: 110581 - DNA, 103 bp, Homo sapiens; identical to SEQ ID NO: 77606
  misc_feature 1..103: note = chr15:41877608-41877711
  misc_feature 1..103: note = Hyper
  source 1..103: mol_type = genomic DNA

SEQ ID NO: 110582 - DNA, 30 bp, Homo sapiens; identical to SEQ ID NO: 44250
  misc_feature 1..30: note = chr15:41878349-41878379
  misc_feature 1..30: note = Hypo
  source 1..30: mol_type = genomic DNA

SEQ ID NO: 110583 - DNA, 45 bp, Homo sapiens; identical to SEQ ID NO: 35664
  misc_feature 1..45: note = chr15:41913327-41913372
  misc_feature 1..45: note = Hyper
  source 1..45: mol_type = genomic DNA

SEQ ID NO: 110584 - DNA, 224 bp, Homo sapiens; identical to SEQ ID NO: 77609
  misc_feature 1..224: note = chr15:41913733-41913957
  misc_feature 1..224: note = Hyper
  source 1..224: mol_type = genomic DNA

SEQ ID NO: 110585 - DNA, 73 bp, Homo sapiens; identical to SEQ ID NO: 77610
  misc_feature 1..73: note = chr15:41914167-41914240
  misc_feature 1..73: note = Hyper
  source 1..73: mol_type = genomic DNA

SEQ ID NO: 110586 - DNA, 973 bp, Homo sapiens; identical to SEQ ID NO: 77611
  misc_feature 1..973: note = chr15:41952201-41953174
  misc_feature 1..973: note = Hyper
  source 1..973: mol_type = genomic DNA

SEQ ID NO: 110587 - DNA, 62 bp, Homo sapiens; identical to SEQ ID NO: 77612
  misc_feature 1..62: note = chr15:41954254-41954316
  misc_feature 1..62: note = Hyper
  source 1..62: mol_type = genomic DNA

SEQ ID NO: 110588 - DNA, 49 bp, Homo sapiens; identical to SEQ ID NO: 77613
  misc_feature 1..49: note = chr15:42151201-42151250
  misc_feature 1..49: note = Hypo
  source 1..49: mol_type = genomic DNA

SEQ ID NO: 110589 - DNA, 30 bp, Homo sapiens; identical to SEQ ID NO: 77614
  misc_feature 1..30: note = chr15:42159399-42159429
  misc_feature 1..30: note = Hypo
  source 1..30: mol_type = genomic DNA

SEQ ID NO: 110590 - DNA, 77 bp, Homo sapiens; identical to SEQ ID NO: 77615
  misc_feature 1..77: note = chr15:42448018-42448095
  misc_feature 1..77: note = Hypo
  source 1..77: mol_type = genomic DNA

SEQ ID NO: 110591 - DNA, 91 bp, Homo sapiens; identical to SEQ ID NO: 77616
  misc_feature 1..91: note = chr15:42562561-42562652
  misc_feature 1..91: note = Hypo
  source 1..91: mol_type = genomic DNA

SEQ ID NO: 110592 - DNA, 399 bp, Homo sapiens; identical to SEQ ID NO: 77617
  misc_feature 1..399: note = chr15:42684673-42685072
  misc_feature 1..399: note = Hypo
  source 1..399: mol_type = genomic DNA

SEQ ID NO: 110593 - DNA, 41 bp, Homo sapiens; identical to SEQ ID NO: 77618
  misc_feature 1..41: note = chr15:42748507-42748548
  misc_feature 1..41: note = Hypo
  source 1..41: mol_type = genomic DNA

SEQ ID NO: 110594 - DNA, 40 bp, Homo sapiens; identical to SEQ ID NO: 44254
  misc_feature 1..40: note = chr15:42784374-42784414
  misc_feature 1..40: note = Hypo
  source 1..40: mol_type = genomic DNA

SEQ ID NO: 110595 - DNA, 79 bp, Homo sapiens; identical to SEQ ID NO: 77620
  misc_feature 1..79: note = chr15:42868395-42868474
  misc_feature 1..79: note = Hyper
  source 1..79: mol_type = genomic DNA

SEQ ID NO: 110596 - DNA, 141 bp, Homo sapiens; identical to SEQ ID NO: 44255
  misc_feature 1..141: note = chr15:43020219-43020360
  misc_feature 1..141: note = Hypo
  source 1..141: mol_type = genomic DNA

SEQ ID NO: 110597 - DNA, 30 bp, Homo sapiens; identical to SEQ ID NO: 77622
  misc_feature 1..30: note = chr15:43213577-43213607
  misc_feature 1..30: note = Hyper
  source 1..30: mol_type = genomic DNA

SEQ ID NO: 110598 - DNA, 198 bp, Homo sapiens; identical to SEQ ID NO: 77623
  misc_feature 1..198: note = chr15:43467727-43467925
  misc_feature 1..198: note = Hypo
  source 1..198: mol_type = genomic DNA

SEQ ID NO: 110599 - DNA, 30 bp, Homo sapiens; identical to SEQ ID NO: 77624
  misc_feature 1..30: note = chr15:43502442-43502472
  misc_feature 1..30: note = Hypo
  source 1..30: mol_type = genomic DNA

SEQ ID NO: 110600 - DNA, 30 bp, Homo sapiens; identical to SEQ ID NO: 77625
  misc_feature 1..30: note = chr15:43508293-43508323
  misc_feature 1..30: note = Hypo
  source 1..30: mol_type = genomic DNA

SEQ ID NO: 110601 - DNA, 16 bp, Homo sapiens
  misc_feature 1..16: note = chr15:43511842-43511858
  misc_feature 1..16: note = Hypo
  source 1..16: mol_type = genomic DNA
acagaataaaaagaac

SEQ ID NO: 110602 - DNA, 30 bp, Homo sapiens; identical to SEQ ID NO: 77627
  misc_feature 1..30: note = chr15:43519643-43519673
  misc_feature 1..30: note = Hypo
  source 1..30: mol_type = genomic DNA

SEQ ID NO: 110603 - DNA, 30 bp, Homo sapiens; identical to SEQ ID NO: 77628
  misc_feature 1..30: note = chr15:43527822-43527852
  misc_feature 1..30: note = Hypo
  source 1..30: mol_type = genomic DNA

SEQ ID NO: 110604 - DNA, 35 bp, Homo sapiens; identical to SEQ ID NO: 77629
  misc_feature 1..35: note = chr15:43622105-43622140
  misc_feature 1..35: note = Hyper
  source 1..35: mol_type = genomic DNA

SEQ ID NO: 110605 - DNA, 101 bp, Homo sapiens; identical to SEQ ID NO: 77630
  misc_feature 1..101: note = chr15:43661891-43661992
  misc_feature 1..101: note = Hypo
  source 1..101: mol_type = genomic DNA

SEQ ID NO: 110606 - DNA, 342 bp, Homo sapiens; identical to SEQ ID NO: 77631
  misc_feature 1..342: note = chr15:43810570-43810912
  misc_feature 1..342: note = Hyper
  source 1..342: mol_type = genomic DNA

SEQ ID NO: 110607 - DNA, 160 bp, Homo sapiens; identical to SEQ ID NO: 44258
  misc_feature 1..160: note = chr15:44037474-44037634
  misc_feature 1..160: note = Hypo
  source 1..160: mol_type = genomic DNA

SEQ ID NO: 110608 - DNA, 23 bp, Homo sapiens
  misc_feature 1..23: note = chr15:44090533-44090556
  misc_feature 1..23: note = Hypo
  source 1..23: mol_type = genomic DNA
actgcacccggccattactcctc

SEQ ID NO: 110609 - DNA, 274 bp, Homo sapiens; identical to SEQ ID NO: 77634
  misc_feature 1..274: note = chr15:44092138-44092412
  misc_feature 1..274: note = Hypo
  source 1..274: mol_type = genomic DNA

SEQ ID NO: 110610 - DNA, 208 bp, Homo sapiens; identical to SEQ ID NO: 77635
  misc_feature 1..208: note = chr15:44115848-44116056
  misc_feature 1..208: note = Hypo
  source 1..208: mol_type = genomic DNA

SEQ ID NO: 110611 - DNA, 170 bp, Homo sapiens; identical to SEQ ID NO: 35669
  misc_feature 1..170: note = chr15:44486726-44486896
  misc_feature 1..170: note = Hyper
  source 1..170: mol_type = genomic DNA

SEQ ID NO: 110612 - DNA, 24 bp, Homo sapiens
  misc_feature 1..24: note = chr15:44827765-44827789
  misc_feature 1..24: note = Hypo
  source 1..24: mol_type = genomic DNA
tttttttttttgagacgggtctaa

SEQ ID NO: 110613 - DNA, 27 bp, Homo sapiens
  misc_feature 1..27: note = chr15:45046196-45046223
  misc_feature 1..27: note = Hypo
  source 1..27: mol_type = genomic DNA
agccgcagtgcccggctgcttcaaaca

SEQ ID NO: 110614 - DNA, 30 bp, Homo sapiens; identical to SEQ ID NO: 77639
  misc_feature 1..30: note = chr15:45389393-45389423
  misc_feature 1..30: note = Hypo
  source 1..30: mol_type = genomic DNA

SEQ ID NO: 110615 - DNA, 597 bp, Homo sapiens
  misc_feature 1..597: note = chr15:45403593-45404190
  misc_feature 1..597: note = Hyper
  source 1..597: mol_type = genomic DNA
ggggcccgttctgcccggtggcggggtcgggcgccgcccacatgagcagggggttctgcgagtctcgggggaaagcggggtcgggccccgacgccagctgtccccccgagaagctccgcagcgcgtcgctccaggagtgcgaggagccatagatggcgctgccgtccagccagcccgtcacctggttggcctgcggggcacgcggcgggtgagcccgggtcgagaggcggcggcgggccagggaaggccggggcccggcgggtgtccgcggctggggagtgggcgcctctcccctccaggccctgccaggcccgaagcccaggccccacctggctggggtgcggtcccttcccgccgccttccccgcctcaccaggtcccgggggttgctgggactccgtccggtctcggggtcccagcggctcctctggaagggcagcaccacgtccccgcgctggtcggggtcgaacacggggtctccaggtgggatgcggatgttgaggaactcggcggggcaaccgggcgtttccacgctcaccacgtcggaaagaacatggtagcctgcgggcatggggcgccaatacgtgacaaaccgtcc

SEQ ID NO: 110616 - DNA, 249 bp, Homo sapiens; identical to SEQ ID NO: 77643
  misc_feature 1..249: note = chr15:45404917-45405166
  misc_feature 1..249: note = Hyper
  source 1..249: mol_type = genomic DNA

SEQ ID NO: 110617 - DNA, 139 bp, Homo sapiens; identical to SEQ ID NO: 77644
  misc_feature 1..139: note = chr15:45405416-45405555
  misc_feature 1..139: note = Hyper
  source 1..139: mol_type = genomic DNA

SEQ ID NO: 110618 - DNA, 443 bp, Homo sapiens
  misc_feature 1..443: note = chr15:45406452-45406895
  misc_feature 1..443: note = Hyper
  source 1..443: mol_type = genomic DNA
ctgggctgggacacccgtgtggcacgtcgcccacgctgctataaaaggggtcccgcgcgacttccaaactcagcgccaacccgcagaaccaggaaagtaacggctacagacagtgagaaatagtttcgctcgccggctagaaaaactctgtcggtaccaaccccagagcgttgagagcagcccacctccacgcttccttaacggagaggtgcaggactcagacttcaccagcccactcggtcccagccttgtacgcaaagagacgccaaggacgcgctctcccgcgtccaggcagccccagcttgctggcttgcctgcccgcctgcgtgcagcactcggccggcgtgcagcatgaccctgtggaacggcgtactgcctttttacccccagccccggcatgccgcaggcttcagcgttccactgctcatcgttattctagtgtt

SEQ ID NO: 110619 - DNA, 57 bp, Homo sapiens; identical to SEQ ID NO: 77647
  misc_feature 1..57: note = chr15:45409154-45409211
  misc_feature 1..57: note = Hyper
  source 1..57: mol_type = genomic DNA

SEQ ID NO: 110620 - DNA, 578 bp, Homo sapiens
  misc_feature 1..578: note = chr15:45421268-45421846
  misc_feature 1..578: note = Hyper
  source 1..578: mol_type = genomic DNA
ccgtggaacctcacacgaagcgcccccgggggtgtgattaaagagggaaccaggtcccgacgttctgtgaacaaacgcgcgcccttactctcagtggggctcccgtccgacccccactcctctcctaactcacgtaaggacccggctgtgaccggacaaaccgggtctggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctggcggggcgcgggcgcggctcgcagggcggtgggacccccaagacctcacgaggatccccggagggagacgtgactccggggtcttagaggggtttaggtcggatgggtgacttgctttgacgcctggcctggtctgtgggtggcaggtgatcgatggccttggact

SEQ ID NO: 110621 - DNA, 524 bp, Homo sapiens
  misc_feature 1..524: note = chr15:45427335-45427859
  misc_feature 1..524: note = Hyper
  source 1..524: mol_type = genomic DNA
aactcccggctgccccgccgagttcctcaacattcgcatcccgcccggagaccccatgttcgaccccgaccagcgcggggacgtggtgctgcccttccagagaagccgctgggaccccgagaccggacggagtcccagcaatccccgggacccggtgaggcggggaaggcggcgggaagggaccgcaccccagccaggtgggacctgggcttcgggcctggcagggcctggaggggagaggcgcccactccccagccgcggacacccgccgggccccggccttccctagctcgccgccgcccatcgacccgggctcacccgccgcgtgccccgcaggccaaccaggtgacgggctggctggacggcagcgccatctatggttcctcgcattcctggagcgacgcgctgcggagcttctccaggggacagctggcgtcggggcccgaccccgcttttccccgagactcgcagaaccccctgctcatgtgggcggcgcccgaccccgccaccgggcagaacgggcc

SEQ ID NO: 110622 - DNA, 290 bp, Homo sapiens; identical to SEQ ID NO: 77653
  misc_feature 1..290: note = chr15:45471645-45471935
  misc_feature 1..290: note = Hypo
  source 1..290: mol_type = genomic DNA

SEQ ID NO: 110623 - DNA, 387 bp, Homo sapiens
  misc_feature 1..387: note = chr15:45479446-45479833
  misc_feature 1..387: note = Hyper
  source 1..387: mol_type = genomic DNA
agagtttggggcttccgtctcagattagtcggttgagaatctgaacaaaggtgggtgaaggctcggaaccccggggtcaggggctcgcgtctgccagaagctgagacaccgaggggcccgggccaggccacctttgtccctctcgcagcctccagacccctgaccgccttccctcctggccatcccggcccggcgcggcactcaccctatcgctgctggcggggggtccggagatccgctcatcagcaggcggcgccgggggccccggggtctcgacccgaataaggcggtgtgggggagagccgtggcgcgggggcggcgtgggtccgggggcgacaggggtggcgagggcggcggagccggacgaccccccggagtaggggtctt

SEQ ID NO: 110624 - DNA, 30 bp, Homo sapiens; identical to SEQ ID NO: 77656
  misc_feature 1..30: note = chr15:45480705-45480735
  misc_feature 1..30: note = Hyper
  source 1..30: mol_type = genomic DNA

SEQ ID NO: 110625 - DNA, 26 bp, Homo sapiens
  misc_feature 1..26: note = chr15:45544198-45544224
  misc_feature 1..26: note = Hypo
  source 1..26: mol_type = genomic DNA
tctcggcctcccgaagtgctgggatt

SEQ ID NO: 110626 - DNA, 427 bp, Homo sapiens
  misc_feature 1..427: note = chr15:45670588-45671015
  misc_feature 1..427: note = Hyper
  source 1..427: mol_type = genomic DNA
tccgatgtagtgcaccgcctcggcgccgcggctcccgccgcgcagacaccgcacccgcagcatcgccctggcccggctggtccacgcgcggaatgttcctggcctctgggccgcgtcggtccaagccttcccgagagcgcgcccggagcggggtgggcgggcgcgcggggcccgaggccttttgtagccgcgctccgccccggccgccccccgcggccccattggctgccgggaacaggtggtggggccggcgtagcgccccgaattaggaactgtcgggaagcgccgcggccgctggctcgagcctccgatgcttgcccttttttagccagcggggccactgacggcttctgttgcacgtccggacccggacccagacccgagcgtcgcaagaaggcccgttggagtctcgcgcaactgggcagga

SEQ ID NO: 110627 - DNA, 30 bp, Homo sapiens; identical to SEQ ID NO: 77660
  misc_feature 1..30: note = chr15:45742581-45742611
  misc_feature 1..30: note = Hypo
  source 1..30: mol_type = genomic DNA

SEQ ID NO: 110628 - DNA, 154 bp, Homo sapiens
  misc_feature 1..154: note = chr15:45996505-45996659
  misc_feature 1..154: note = Hyper
  source 1..154: mol_type = genomic DNA
gtgcaagtaatggtacgcggagagggcgcgcgaaagcgcctggctcgttcctggagcccgggctgcggacgccccctgcgtgctgcgaaacctgaggggtctcggtccttcctggccttttataggccgtgcctagaaacgcttggcttgacca

SEQ ID NO: 110629 - DNA, 797 bp, Homo sapiens
  misc_feature 1..797: note = chr15:47476715-47477512
  misc_feature 1..797: note = Hyper
  source 1..797: mol_type = genomic DNA
ggggagctctggcggcgtccaggatgctccagcctcccggcgcgccgcggccggcgcagagacccgaccgcgaggcccgccgcccggttcccgtgcgcagcatggcccgaggcggcggcagagttgttggcactgataagacccgtcttttgtgtcttgcccgatcccggagctgtgccaggccggggggagggagcggaagccactttatggctcgtggccccacctcttgcccccaccccaaatcctccgggatttcaaaatgccgcggactcgggcgcaagtgagcgccaaacccgcaagctgggcgagttggatccgggtcggcagccggctgaaccgccacgctgccccgctttttttattttctttttagatacggcatctaattggtgggtgctgggaggcagggctggttgggtgagcacgagtacctgggtgtagggaacgacctaccttcttgctttccttggggtttagaggggaaggggtgggggcacccagagccccgaagcccggagcgtcccgcgctagcgggcttgcgcgcggccggcgagcaggcgttctctgggtgggtcccttgtctggctcattgttcgcggtgactgttcttggggccaggctgagcgacacagacaccgctcaccgggctgtaaataaaagtgacgacttggaggagtgggggtcaaggctgccgggagggaaaaggcttgcccattttagaaaccgacttggagctcggaagagcaaacgtagtcgacagagaaaaccgctcctgagtgcgaaacttagatctg

SEQ ID NO: 110630 - DNA, 35 bp, Homo sapiens; identical to SEQ ID NO: 77666
  misc_feature 1..35: note = chr15:48003206-48003241
  misc_feature 1..35: note = Hypo
  source 1..35: mol_type = genomic DNA

SEQ ID NO: 110631 - DNA, 146 bp, Homo sapiens; identical to SEQ ID NO: 35687
  misc_feature 1..146: note = chr15:48009524-48009670
  misc_feature 1..146: note = Hyper
  source 1..146: mol_type = genomic DNA

SEQ ID NO: 110632 - DNA, 88 bp, Homo sapiens; identical to SEQ ID NO: 77668
  misc_feature 1..88: note = chr15:48009881-48009969
  misc_feature 1..88: note = Hyper
  source 1..88: mol_type = genomic DNA

SEQ ID NO: 110633 - DNA, 808 bp, Homo sapiens; identical to SEQ ID NO: 77669
  misc_feature 1..808: note = chr15:48010089-48010897
  misc_feature 1..808: note = Hyper
  source 1..808: mol_type = genomic DNA

SEQ ID NO: 110634 - DNA, 232 bp, Homo sapiens; identical to SEQ ID NO: 77670
  misc_feature 1..232: note = chr15:48011225-48011457
  misc_feature 1..232: note = Hyper
  source 1..232: mol_type = genomic DNA

SEQ ID NO: 110635 - DNA, 30 bp, Homo sapiens; identical to SEQ ID NO: 77671
  misc_feature 1..30: note = chr15:48470064-48470094
  misc_feature 1..30: note = Hyper
  source 1..30: mol_type = genomic DNA

SEQ ID NO: 110636 - DNA, 253 bp, Homo sapiens
  misc_feature 1..253: note = chr15:48470373-48470626
  misc_feature 1..253: note = Hyper
  source 1..253: mol_type = genomic DNA
gcaggtgcgggctgtcgccaccagtggccccgggcacctcggccttgttggcgtccgccatcccgccgccgctgcctccgcctcggccgcctgagctgaggggctccgagcgcgacaatggcggctgccggggaagcggtaacggatcccgatttgaaaaggccccgagcgctcagtaacccggatctcgcgagaaccggtcgagactgggtgactgggagatggtgtgtgccgggtgcggggggtgggagtg

SEQ ID NO: 110637 - DNA, 50 bp, Homo sapiens
  misc_feature 1..50: note = chr15:48483818-48483868
  misc_feature 1..50: note = Hyper
  source 1..50: mol_type = genomic DNA
acgcgcgcgcgcacacgtacttcggcgggcgcccacgtcctctgtctcac

SEQ ID NO: 110638 - DNA, 30 bp, Homo sapiens; identical to SEQ ID NO: 77674
  misc_feature 1..30: note = chr15:48666415-48666445
  misc_feature 1..30: note = Hypo
  source 1..30: mol_type = genomic DNA

SEQ ID NO: 110639 - DNA, 20 bp, Homo sapiens
  misc_feature 1..20: note = chr15:48906097-48906117
  misc_feature 1..20: note = Hypo
  source 1..20: mol_type = genomic DNA
ctgggcgacagagtgagact

SEQ ID NO: 110640 - DNA, 87 bp, Homo sapiens; identical to SEQ ID NO: 77676
  misc_feature 1..87: note = chr15:48911244-48911331
  misc_feature 1..87: note = Hypo
  source 1..87: mol_type = genomic DNA

SEQ ID NO: 110641 - DNA, 1864 bp, Homo sapiens
  misc_feature 1..1864: note = chr15:48936726-48938590
  misc_feature 1..1864: note = Hyper
  source 1..1864: mol_type = genomic DNA
gagagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagacggttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcggctcttctgaggc

SEQ ID NO: 110642 - DNA, 204 bp, Homo sapiens; identical to SEQ ID NO: 44264
  misc_feature 1..204: note = chr15:49182759-49182963
  misc_feature 1..204: note = Hypo
  source 1..204: mol_type = genomic DNA

SEQ ID NO: 110643 - DNA, 78 bp, Homo sapiens; identical to SEQ ID NO: 77682
  misc_feature 1..78: note = chr15:49255775-49255853
  misc_feature 1..78: note = Hyper
  source 1..78: mol_type = genomic DNA

SEQ ID NO: 110644 - DNA, 139 bp, Homo sapiens; identical to SEQ ID NO: 77683
  misc_feature 1..139: note = chr15:49572508-49572647
  misc_feature 1..139: note = Hypo
  source 1..139: mol_type = genomic DNA

SEQ ID NO: 110645 - DNA, 157 bp, Homo sapiens; identical to SEQ ID NO: 77684
  misc_feature 1..157: note = chr15:50124618-50124775
  misc_feature 1..157: note = Hypo
  source 1..157: mol_type = genomic DNA

SEQ ID NO: 110646 - DNA, 19 bp, Homo sapiens
  misc_feature 1..19: note = chr15:50716090-50716109
  misc_feature 1..19: note = Hypo
  source 1..19: mol_type = genomic DNA
ccaccgtgcccagcctcgc

SEQ ID NO: 110647 - DNA, 102 bp, Homo sapiens; identical to SEQ ID NO: 77686
  misc_feature 1..102: note = chr15:51202472-51202574
  misc_feature 1..102: note = Hypo
  source 1..102: mol_type = genomic DNA

SEQ ID NO: 110648 - DNA, 422 bp, Homo sapiens; identical to SEQ ID NO: 77687
  misc_feature 1..422: note = chr15:51385846-51386268
  misc_feature 1..422: note = Hyper
  source 1..422: mol_type = genomic DNA

SEQ ID NO: 110649 - DNA, 417 bp, Homo sapiens; identical to SEQ ID NO: 77688
  misc_feature 1..417: note = chr15:51559380-51559797
  misc_feature 1..417: note = Hyper
  source 1..417: mol_type = genomic DNA

SEQ ID NO: 110650 - DNA, 209 bp, Homo sapiens
  misc_feature 1..209: note = chr15:51633966-51634175
  misc_feature 1..209: note = Hyper
  source 1..209: mol_type = genomic DNA
tcaacgctgcgggcacggtgttcgcgctgtgccagtggcgcgggctgagctcggcgctgcgggctttggaggcgcagcggggccgggagcagcgcgaggacagtgccctgcgctccttcctggccgagttgagccgcgcgccgcgcggggcgtccgcaccaccccaagacccggccagctcagctcgcaacaagcgcagccacagcggc

SEQ ID NO: 110651 - DNA, 320 bp, Homo sapiens; identical to SEQ ID NO: 77691
  misc_feature 1..320: note = chr15:51973774-51974094
  misc_feature 1..320: note = Hyper
  source 1..320: mol_type = genomic DNA

SEQ ID NO: 110652 - DNA, 26 bp, Homo sapiens
  misc_feature 1..26: note = chr15:52000764-52000790
  misc_feature 1..26: note = Hypo
  source 1..26: mol_type = genomic DNA
ctgccttgccgggcgcggaggctcac

SEQ ID NO: 110653 - DNA, 239 bp, Homo sapiens
  misc_feature 1..239: note = chr15:52404682-52404921
  misc_feature 1..239: note = Hyper
  source 1..239: mol_type = genomic DNA
tcagcgccaccagctcgaagcggttcccggggtagccgaggtaggcggagaaaaaggaccggtgaatctgccgtaacctggcggccgcggagcgcagcacggcggcctcgggcgtggatggcgccggctcgggggtgccgggttcccgggcgcagtaccccaggtagtcggccagcaacagctcggtgcgctcccgcagcgggtcggccatggtggtgcgctcccgcaactggtcaacc

SEQ ID NO: 110654 - DNA, 41 bp, Homo sapiens; identical to SEQ ID NO: 77693
  misc_feature 1..41: note = chr15:52967811-52967852
  misc_feature 1..41: note = Hypo
  source 1..41: mol_type = genomic DNA

SEQ ID NO: 110655 - DNA, 2833 bp, Homo sapiens
  misc_feature 1..2833: note = chr15:53075403-53078236
  misc_feature 1..2833: note = Hyper
  source 1..2833: mol_type = genomic DNA
tcacacccacagggacgcgaattccgattttataagcaggtgtgcacgtgcactcagatactcacacaaagccgcgtggagggacgaaaagatcaaccacccgatcgacgaggataggtttgatcttttcgattacctcagtgtgccagtgtatattcccggctgggcctagcgccctaagaaacttcggaactttagctgttaatttttgttttcttactatgacttcccaaagacattctatctgcctaccggggcgaagagaaatgggaccaggcgtcagggcggtgggaccctgtccagggtcctgactccgcgccagggctccagaccagtcggcctccgaaggccctttcacccaccccacacaagaggaaacaaagacttctcagctcaaggcctcagggctgcctcctgactccggtcagtttgcaggaagaggaaacaacaaaacaaaggaaccgccaatccgccgggtattatatccctcagctccaacctccgacttcggaccgccagggtcaccttctctacgctgaccccgcttttcttaaatgaaaacacgccaacaaaagcatacttcggatacaaaatccaagtacgcatcttttttggggaggttagagctgaggtgtacttcggaagatgagaattttgttttcatgaattgggtaacacccaggcattgttaggtaccccgacagaccctctagatatccttctcttcctccttcacactttcttcctatcaaaatagttattgttttgaaattcactagaacaacgacgttctaaaaacaaaggcgcagcaagcatccctttcttcgctgccgcgggctgaaccacggacgctcgcgggtcgcccagccccgacggcccgcagggggcgcgcgccgcagccgcagcacagcccggctacccccagaaagggagccgaatggagggaagcagggagcgcggagggctcgaggcttgcagataaggagaggcgcatcctgggatttgggtcctctgctgctacaacacaaccgtgctattgttggcactgtccgacccaagtgtcggtggtaagcggcgatgtcggggctgggtctctagcaaccgctgtgccctgggtcaggctggtcgccccagctaccgggatccctctccggatgcttccagggcgataggtgctgcacccattgacgggatagccgcatacctccgaacaggtagtggagttcgtctctggcaggcatcctagctgcgctgacaccaaggtcgccacacaatagccatcagccccccttaagccccagaagtaggtttcccctgccccagccatagcggttccagtcgtcgccacgagcccacttcttatccccaagcgcacctccctctcctcacccgggtttatgcccgttacacagagagaactacacagggggaactatggtcctacaccctcgaggggacagacaccggccgtgagacaggcaccacgcagagccttctggtgactgtccgcaggagcgagaccttttttggttttgcagtcggctaggtgtgtgtgtgtgagggtccccagttgactaccgggatgcactgccacttttcggcctggcgggctctgggactccttggtctccgtaggaggccatcctaggccttcggaggaggcgctcccagctggcggcgcccctcgccccgggctcagaggcggacacggtcggtcgcgccctgctggccctttgttcgcgccgcagcgggctgggagcagctgcgcgacaccagacccacagcgccaagacgcgaagcgcgaggaaaccgctgcgcttgactccttctcccccaactcttggacccaggaacgcttccagctcctgcgtcccacacgcccagtcctggcttctctcccggcccagaagtcttcaaggattgaagggctctgcctagggccccgcactcctgcctgactcccatggcccagaaaagcagggggacatttgaaatgtcaccccgggataaatattaacaaaaaagcaaatggacttgtgcaggggccagttatcaatcaaccaggccgcaaggccactcagggcaaacacagcccaggttgggctgggcgagactttctcatggccgccccccgaccgaacccctccccccttggctcaggtccttcttaggtcgttctggggcaaacaccggacgggaagggggcgccgccaactcccccgcggggtttggaggtttcctcgcctccaagtcccgcagggcagggtcggagtgcccaacacccacccccgcccgaacctcgggcctgcgcgccgccttcccctgggtccgcggtgctgcgcttgctgttgggtgtgtgtcgctgtctctttccgagccggcagctcctgctgtgtggccgaagccctctggaatctttaattggaaactaatcttggtcttgatagacgcccacgtcagaggcgcgccacccacccacaccccccgcctcatcccggaggagacgcggcgagaaccctgtcgctctgctctttaatggggcagcagcaagtagtacatggagggaacatatattgatttttaaaaggtagttaatttggtgggaatttcctcctgtcgcccttcttccaccagccgctgttatttcgtgaccggaaggcgcctccccaaacacagcgccacgtgcaagagggttttgaccctctgcaacaggctgccggcaactggaggacagaggggcgtggagaagccaccactctcccgctgcggagcgaaggaaccgagctcagtgagccctgacctcgcaaggtggttggaacgagactggggaggg

SEQ ID NO: 110656 - DNA, 251 bp, Homo sapiens; identical to SEQ ID NO: 35704
  misc_feature 1..251: note = chr15:53078741-53078992
  misc_feature 1..251: note = Hyper
  source 1..251: mol_type = genomic DNA

SEQ ID NO: 110657 - DNA, 863 bp, Homo sapiens
  misc_feature 1..863: note = chr15:53079219-53080082
  misc_feature 1..863: note = Hyper
  source 1..863: mol_type = genomic DNA
acggagcagtcaggacgaggagcagccccttcgcccactccctccggaacctcagttgctcgcgggcagcccacgggtggagatatggtgccggtagcacaagagctagagagtggaaaaccgggggccagcgattcgctggggcgcccagcgagcctcttctcccctgactggttcccgggcgcaggctgcaggaacctgcatgaggactttgcctggggcgaacgaaggcagagctgggctggaaaacctggcagggcagagtctcagccagcgcggtgctttgggaccggtggcctgcagcgcccaaacccaaagaacgctttgggtcgcttcggggcacgaatcgcaggctggtcggcacctgccacccccagcttctcattggcaggcacgagttggaggagggggctttggcctcacgctttgattttagactgtgaaacggctcagtgcccccggctcagagcggattgactgtctctcgttctccagggacgaattaatggagaacgatcagttaattaacaaaccctcattccggcttttaccttttctcttcgccaaggctcaggcctgggcgctgggctgagatggaggtggaggtggggggtgggggagtggggggggagggggcatggaccaggagtcaatcaacttggcaaccgccggccggatctcatcaaacccaggccaccctccgctgtccttagctctacctcccctcatgttctctaccctcaagggtcgccgaatcctcctgaaatccccggtggggttcgggctgggctcagctttcttctctgcctatccgcggtctcggggagccaggcgcggtgtctgcgctgcgccaaggagagctt

SEQ ID NO: 110658 - DNA, 1721 bp, Homo sapiens
  misc_feature 1..1721: note = chr15:53080299-53082020
  misc_feature 1..1721: note = Hyper
  source 1..1721: mol_type = genomic DNA
actgggaccttgggacggtcagcctccctctcctttccacagccaattccatgcgcagagagcgtcctaacccttacaactcgtctgtgctacacacccaccgcccaatggctctgaaactttttgcccatactcttagattgaggtcaccccagccagcgccaaaagaatgagcgcgggagggggtcacagcagccagttcggccaaacatcgacgctgctccggcacgctccagcccagcgcctgggatgtgtcagaggtacctgcgaggaacatttgcgtgcgattccacgcacgcgttgcatccctcttcccaaacccggatcgctgaactgagaggtggcgcagagtgtctcaccaggtgcggggatttctctccgcctcaggccgtacgagcttccctcgctgtccctgagcgcaaatgagcctcttcagtcgccgaggcccggccgcttagctctcggagccttccacagcccaacaccctgagccctggagtaggcaatttgctcccacagccctgtgctggcccttccaggcacagggagtcccccttctaggggtaggggcgggcgggatgaagcgcacccagccctctctcctacccttcctcctttggtcccttcggctttcgtgtaccttatctcccgcgcgcccagctccttggccggctcacctgctaagcggagcgcggacatgcgctggaactccggctcctgcagccacttccacatcctccggaaggtctcccggccggatttgagtttgctccagggtttggggttgcgcagcaggtccgagagggtcccctgggagcggcagagcaccctctgcgcgaagatggcctgtgggatgctgtagcgcttgagctcggtggtgatacgctgcgccacctctttggtattgatctcttccatctgccctgaattacttccattgctgacctgcgcgccggtcaccgaagggttgggctcccgggctgtgcccaggagttgcccgtggccctgggcgttcaggtgggcgtggggatggtgcggaggaaggccgttgatgggcaccatgccggccgaggtgggcgtgaggtgctgctccccgtggcggccgagcatggccgggtggtgggcttcgaagccgttgggggtgagcatcttgtcggtgggcatggcggcccccgggtgggcatagtgggggagcccttgctgggagttgtggatgctgcccagaccggagctggagaggggcgagaggctctggcccatgccggccacgtccttgtggtagggggtatagaggttattcatggaggccagcccgcgctcatcccgcatgagcgtgaagctaccgctcacgttgcccgccaggcgctggtggtggtgcgggtggtggtggtgatggtggtggtggtgatggtgggggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggca

SEQ ID NO: 110659 - DNA, 846 bp, Homo sapiens
  misc_feature 1..846: note = chr15:53082303-53083149
  misc_feature 1..846: note = Hyper
  source 1..846: mol_type = genomic DNA
ccaccttcccctctgcgtcctcggcttttttttttttaatattaatttccaaagaggatccgcgccgttgggagagcgcagtgccccagcccgcccgcctcggccacctctcgcccctctctttcttaaaattctgaggtctccggctcccctgccgcggcccgcgcgcctgccgcgtctgctgcctgcccgccccgctggccagcttgagccatggctctgttactgttacagactctgtggccgcggttcggtagccgccgccgccgccgccgcagcggcccgccctcacgcccgccaggcgcagcgcgcatgcgcgaggcccgcccccgccccctaggtcgcggcgcgccaggcccttggcgtcccggtacaaatgaaggagggggcccagcgccttccctgcggcgctggatggccagggagctgcgggcacgtgcgaaagattggcgcagagcgcgacctggggccgccgctgcaatcccaggagactcgcgcctggctcgctcgcctcccttgcttgagtgggctctgtcctcccagcccggggacgctcgtgtcgggcttctagcggctggagtgctgtgcttggagacatcgcccctctctctccagttgctgcttcccggtgcagcttgcccggggagctggggactgtgtcatcaccccttcggctctagcccactaagctttatttcccggggggctgctgggagtgcgctttcccacccttgaattcacggcctattgggggatgggggttggggtggggtggggtgcagattgcttaaagggctgggtccgtttggcggccgttgacccggcacccttcgtcctcccagatac

SEQ ID NO: 110660 - DNA, 30 bp, Homo sapiens; identical to SEQ ID NO: 77709
  misc_feature 1..30: note = chr15:53089890-53089920
  misc_feature 1..30: note = Hyper
  source 1..30: mol_type = genomic DNA

SEQ ID NO: 110661 - DNA, 30 bp, Homo sapiens
  misc_feature 1..30: note = chr15:53090730-53090760
  misc_feature 1..30: note = Hyper
  source 1..30: mol_type = genomic DNA
cgtcccccgtgcctccgtgggttctttacc

SEQ ID NO: 110662 - DNA, 97 bp, Homo sapiens
  misc_feature 1..97: note = chr15:53090981-53091078
  misc_feature 1..97: note = Hyper
  source 1..97: mol_type = genomic DNA
gagggggtgggggagcgaaaggttaaatcctgaccctggaggaccgcgggaaagttcagagcccgagggtcaatctcaggcccgagttcccatcccc

SEQ ID NO: 110663 - DNA, 3062 bp, Homo sapiens
  misc_feature 1..3062: note = chr15:53095628-53098690
  misc_feature 1..3062: note = Hyper
  source 1..3062: mol_type = genomic DNA
aacgaaaaagctcaccgccagacagcttccagcactcgaaccaatacaagtaaagcacatttgcaaatgtgtttgactgtttttgtaggtttaagaagactacgtttttctgaccacttcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtcgcgaggtgagaggtgcggggaggatagacctcgggctcggcgcacagggtctgggccagacgcacaagcccaaattccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatctccaggagctgcctgacggaagttgatgtcagctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgccggacgaggcggcggcggcggcggcggggggttggggcggcgatgtctgcctcctcccgcccgcttgatcctacaatgccggctgcggatcaatacccgctcactgtaatcccagtaattgtagggctcgcagcttttattttaaagaaataggacactagggcgccggcaggcggctgaggcagaacggttgggctgcggtgcctccgggggccttttggggcgccttttaccccagagctcagaaagctccgggcagcggggtggtggcgggatggccagtagccagggcccacctggcggcccgccgggatgtggaggcccactgggttccggcccggcatggcgctggcgagaaggcgccgctgggcgcgtagggtaggcagcacgcgggatttagccttttcccgacctgcgcgcgggccctggcgggaaggccaggtccgggatgggcgtcttgggcttgggcgccgactgtgggcggtcttggccccagaccccgacgcgtggggacccaggatgctggaactcaggccttcggcctagaaagacagaggttttgtctcctttctgccgccttccagggccggaggccgggccaggctcccgggtggcctagctcgggcctagtctgcgtctggccctcggtctgggaattggcagggacgctaggacctggtgatctaacgcccgcgcggcctcttacgccggggtttcctccaggtgctcgttgccacgcgttcgcccgacgcccgcagatcccgtcgcgcccgcaggctaggccagctccgcaagccgcctgctacctctgccgcccgccccttgctggcagagtccgggcaggactgccggggcctggggccgcagtccccgcgccgctggccgcccgcagcttctggcgcccccgaaaatgaccatctgtcattcaattaaggtttcagggcagctgatgggggagccagggtcagcgaccccaggacaaaacggcctgctgcctcggataggagaagttcaaatgttaaatgcagaatattgtgccctctcccagtccggggccccacccggccgcaggtccggccagtggacagcagtagggtgaagggcaacggtcattagcactt

SEQ ID NO: 110664 - DNA, 145 bp, Homo sapiens; identical to SEQ ID NO: 15900
  misc_feature 1..145: note = chr15:53976280-53976425
  misc_feature 1..145: note = Hypo
  source 1..145: mol_type = genomic DNA

SEQ ID NO: 110665 - DNA, 311 bp, Homo sapiens; identical to SEQ ID NO: 77715
  misc_feature 1..311: note = chr15:54051665-54051976
  misc_feature 1..311: note = Hyper
  source 1..311: mol_type = genomic DNA

SEQ ID NO: 110666 - DNA, 465 bp, Homo sapiens; identical to SEQ ID NO: 77716
  misc_feature 1..465: note = chr15:54270462-54270927
  misc_feature 1..465: note = Hyper
  source 1..465: mol_type = genomic DNA

SEQ ID NO: 110667 - DNA, 30 bp, Homo sapiens; identical to SEQ ID NO: 77717
  misc_feature 1..30: note = chr15:54633940-54633970
  misc_feature 1..30: note = Hypo
  source 1..30: mol_type = genomic DNA

SEQ ID NO: 110668 - DNA, 22 bp, Homo sapiens
  misc_feature 1..22: note = chr15:55452971-55452993
  misc_feature 1..22: note = Hypo
  source 1..22: mol_type = genomic DNA
gagccaccgcacccagccaaca

SEQ ID NO: 110669 - DNA, 43 bp, Homo sapiens; identical to SEQ ID NO: 44269
  misc_feature 1..43: note = chr15:55689108-55689151
  misc_feature 1..43: note = Hypo
  source 1..43: mol_type = genomic DNA

SEQ ID NO: 110670 - DNA, 86 bp, Homo sapiens; identical to SEQ ID NO: 77720
  misc_feature 1..86: note = chr15:55699080-55699166
  misc_feature 1..86: note = Hypo
  source 1..86: mol_type = genomic DNA

SEQ ID NO: 110671 - DNA, 92 bp, Homo sapiens; identical to SEQ ID NO: 44271
  misc_feature 1..92: note = chr15:55806620-55806712
  misc_feature 1..92: note = Hypo
  source 1..92: mol_type = genomic DNA

SEQ ID NO: 110672 - DNA, 1364 bp, Homo sapiens
  misc_feature 1..1364: note = chr15:55879812-55881176
  misc_feature 1..1364: note = Hyper
  source 1..1364: mol_type = genomic DNA
cacaaagtcgggaggcgagggatccgcgcggatgtctcgggggccagcgggcgcccgggccgcgcgctcggatcgcagcctcggccccggggtgccggcgggacgcgggctgcgcggacttaggcccggacagagccccatggcctcccggcggccgggcacggggccccgcgcacctcactcaccccggttcccccaatccggcacccttctcggttacctcgaactctcttcagcgaaatgggatccttctcctgttctgctgacattacagaccgcaaagcatgactcccccccaggccgcgggaattcggtctctttgatgctgcggcggcggctcctcctcctcgcggggccgctgcggctgcgaggcaagcctcggagccgaggcacggccgagggcggtggggacgcgggccgactttgcaaagtttgggaggaggacgaggcctcggggcggcggggcggcggggcggcgtgcgggcaccggcggggctcagcggcggtggccgggagcgcggcctgggggcggccccccacccggggccggcatgtgctgagggcgagtgcgccgccgccgccgccgcctcctcccactccttcttcttcgccgccgcctcaggagccgctgacaggggaagcaggaggctcgcggcccggccctggcggcacactcacagcgccctctgaggaggaggtctgctctctcgccgctcccgagtcgcagacacaaaagcccccagactggagccgcctgtaaaacccgctctggggcgggcgagggacgtggcgcggccccgcggcttccccgccctgagctccccagccccgcgcggggacgggcttcggggggcgggggccgctgcctcgtcccgcggcgcctcccgccaccgccgccgcctcgcgctccgcctcggcccagcccccacggcccgcgcgcgcctcttgctccaagccggggctcgcgggcccgcggctcttgcagcccgggtgggcagcgcgcgcctaggggccgccccgccccgcgcccggcgctccctcgccgaccgccaggcccgagaacgcccgaccccgcggccgacgctaccgggcccagctttcgcaaggaaagggcatctccgaacttcgtcggaggccacagcagcaggcgtctcggcctcgcagctagggatcggaaagatgaacgtaccatgcgaggaaactttgtaagcgggagctggagagttctcggcgggcatgtggggatccagattccccgactccgtgtccgcgtggccgtggtgtggacacctgtctgtagaatgcctccacttggtattttaacgacttgactcttcaagaaagagcgacgtagaataaatacc

SEQ ID NO: 110673 - DNA, 20 bp, Homo sapiens
  misc_feature 1..20: note = chr15:55933134-55933154
  misc_feature 1..20: note = Hypo
  source 1..20: mol_type = genomic DNA
gaacccgggaggcaacaaac

SEQ ID NO: 110674 - DNA, 1123 bp, Homo sapiens
  misc_feature 1..1123: note = chr15:56034387-56035510
  misc_feature 1..1123: note = Hyper
  source 1..1123: mol_type = genomic DNA
ttcccccctcctttccggggcacaaatcggccacttcacttccaaccctgccaattccaccctcccatctcctcctggctggatccagatccggcaagctggtgccgattggggttatgagttcacctattccctctcgcagccctaaaaagtgggggaactcccacaacagacacgggaagccgcgaggaaccgcggcgccccctgcacggcgaggctgccactaaggaaacaatataaataaagccacgtgcagccgcggcggccccggcgggctggcgacccggagtccggccggtcgcggaggcgcggacgcggccggagccgggacaatggcgcgagaaggaagagaccagagtggacagcggccgccagaactccgcagccacgggcgcgcggcgcggaggggcgtgcgcccggagaagctcccgcagccctgcccaagcagcgcagaggccgcaagcaactagtgtctgcagctggcggttccggacaggccgcagggcgagagcgggggccgggggtcagcgccaccacggaggaccccgccgcgcgctccccacgccccatcgtttcctctttccccatcccactcgcgcccgctcccgccccacagcggtaagagaaagcagaagaaagcgcgcccacctggcaaaggactgagcagcagcaggagcaggagcgcgcggagcagcatccccggcggtcgcagccgggcgaggggtcgcagaggaggcgccattcagcgtagccgcgcgggcatgctccccggccgcccagagcccctgtccgtctgcggcccccgccccgggcgctctctgctctgcggctggtcgcacgcagcctggctccccgctccggctccggcaccggcgtggcgagcgtctctgcggcggcgaggctggtgctcggacggccgctcgcgagaagcaaggggcctgagagtccggctgggggcggagtgaggcggcggctgcagagggcgggggcggcggagtggacagcgccgcggccgcgggcctgggactactttctacatctggcccttggtctgggccagggaggtcggcgcggccggcggagggagacgctgggagggggccagtggcggccgggtcggagc

SEQ ID NO: 110675 - DNA, 84 bp, Homo sapiens; identical to SEQ ID NO: 77729
  misc_feature 1..84: note = chr15:57618488-57618572
  misc_feature 1..84: note = Hypo
  source 1..84: mol_type = genomic DNA

SEQ ID NO: 110676 - DNA, 30 bp, Homo sapiens; identical to SEQ ID NO: 77730
  misc_feature 1..30: note = chr15:57967966-57967996
  misc_feature 1..30: note = Hypo
  source 1..30: mol_type = genomic DNA

SEQ ID NO: 110677 - DNA, 1059 bp, Homo sapiens
  misc_feature 1..1059: note = chr15:58357149-58358208
  misc_feature 1..1059: note = Hyper
  source 1..1059: mol_type = genomic DNA
aaaattcacatgaaacgctgacgttggagttactgtacttatcagtcaggtttccgtgaaatttgtcaaaccggccagagcgctggtgtcttgacaattccttacgggaaagcccctcagcaccctccgggctgtggaggacctgattgggaccaacagccgaggggcccggaaggcggaggaccgagaggcgacggccaggctgcgtggccaagctgacggggaaccccggcctccatctgaggatactaagcggttccgacgccttcccccgcggcagtcgggaccgggagaatcggacagaaaccagcctcagagtccggggcaggagccgttgacggctgcccctcaacgctgcgcttcgggttgggttaagtccccaaggcgtcctcagaccacggcggggcttcaaacgccccagtcccgaagacaggcagggggtccctctgctgcgccgggatgacaggctggccccgacgaccccggccccgtcccgcagccctcacccgctgaagagatcggggaaaccgaagaaggttctagaaagtctccgtggacgacgggcgctgggcggccgcttaccttggtgtacttaatttcgagattgggcgtgggcgacggcaggaggtgcagcgacgccatgagggcggcggggtcggccttcacctcgccgggcatctctatcttgctggaagtcatggtggcgggccgggtgtccctagcccgcggcgtggggcagtgcgggctgtgcgcgcggtccgcggcccgggggcgcgctcgcctgtatataggcaggtgtcaagctggggctcttcttattggacgtgagggccgaggcgcggggggctggtccatcctacctaggacgcccggcgcagcctccatttacataaagcccgcgccgcgcggccgggacgcttggcgcccacggtcaagtccgcccggcgctcccgccccccggccgcggagaccagcccacgccgcctccacagtcctcgacggtgggagcggaacttgcgccgcggcccgcgggcctcggccagccggacttggtctccg

SEQ ID NO: 110678 - DNA, 305 bp, Homo sapiens
  misc_feature 1..305: note = chr15:58358458-58358763
  misc_feature 1..305: note = Hyper
  source 1..305: mol_type = genomic DNA
tccgttctcctcctccgggcaggggcgccaggctctcggcagctacgccctctcccccgaccccccgactcccctcagccgggccgaggtgcatggtggccagagggtcagggagaggtggcagtgggtgcgagtccccctcgcctcgggctcagaatgaggatccctgcgagcgggtcagcgcggggcggcccttgccaggcgtcgcccgcccagttgctgccctctgccggccgggaccgcccgggcggcttgcgctgtggcgggaggatatgggcagtgatcatccccggctcctccgagga

SEQ ID NO: 110679 - DNA, 101 bp, Homo sapiens; identical to SEQ ID NO: 77734
  misc_feature 1..101: note = chr15:59158436-59158537
  misc_feature 1..101: note = Hypo
  source 1..101: mol_type = genomic DNA

SEQ ID NO: 110680 - DNA, 30 bp, Homo sapiens; identical to SEQ ID NO: 44273
  misc_feature 1..30: note = chr15:59243729-59243759
  misc_feature 1..30: note = Hypo
  source 1..30: mol_type = genomic DNA

SEQ ID NO: 110681 - DNA, 24 bp, Homo sapiens
  misc_feature 1..24: note = chr15:59279029-59279053
  misc_feature 1..24: note = Hypo
  source 1..24: mol_type = genomic DNA
tgaatgatacggaaaatatgagtg

SEQ ID NO: 110682 - DNA, 30 bp, Homo sapiens; identical to SEQ ID NO: 77737
  misc_feature 1..30: note = chr15:59445742-59445772
  misc_feature 1..30: note = Hypo
  source 1..30: mol_type = genomic DNA

SEQ ID NO: 110683 - DNA, 64 bp, Homo sapiens; identical to SEQ ID NO: 77738
  misc_feature 1..64: note = chr15:59453450-59453514
  misc_feature 1..64: note = Hypo
  source 1..64: mol_type = genomic DNA

SEQ ID NO: 110684 - DNA, 159 bp, Homo sapiens; identical to SEQ ID NO: 35730
  misc_feature 1..159: note = chr15:59729656-59729815
  misc_feature 1..159: note = Hyper
  source 1..159: mol_type = genomic DNA

SEQ ID NO: 110685 - DNA, 30 bp, Homo sapiens; identical to SEQ ID NO: 77740
  misc_feature 1..30: note = chr15:59846186-59846216
  misc_feature 1..30: note = Hypo
  source 1..30: mol_type = genomic DNA

SEQ ID NO: 110686 - DNA, 21 bp, Homo sapiens
  misc_feature 1..21: note = chr15:59950342-59950363
  misc_feature 1..21: note = Hypo
  source 1..21: mol_type = genomic DNA
aaactccgtctcaaaaaaaaa

SEQ ID NO: 110687 - DNA, 23 bp, Homo sapiens
  misc_feature 1..23: note = chr15:60085007-60085030
  misc_feature 1..23: note = Hypo
  source 1..23: mol_type = genomic DNA
tcattatccggatgaaaagtata

SEQ ID NO: 110688 - DNA, 18 bp, Homo sapiens
  misc_feature 1..18: note = chr15:60121321-60121339
  misc_feature 1..18: note = Hypo
  source 1..18: mol_type = genomic DNA
actgactcacggccccgg

SEQ ID NO: 110689 - DNA, 80 bp, Homo sapiens; identical to SEQ ID NO: 77744
  misc_feature 1..80: note = chr15:60286430-60286510
  misc_feature 1..80: note = Hyper
  source 1..80: mol_type = genomic DNA

SEQ ID NO: 110690 - DNA, 872 bp, Homo sapiens
  misc_feature 1..872: note = chr15:60286804-60287676
  misc_feature 1..872: note = Hyper
  source 1..872: mol_type = genomic DNA
tattcactaatccagcgcattgccaaatacccccttaattctgcttaacactaaaagggttttgagcaccataatgagattcttctgtctgctaattaattgacacgctcctgaatattcatatgagctagcaccaatacgttcctaattgcaccgtggaatagatctcagaggaaagtaaatcgccatagacttaattaaaataatgtattccagatccagcacggggaaagatgagacatttgccttcgagctcgctaagaaagtggcacctggttggtggaggggagagataccaaatgtcggcgcccagcctgaaataagtggcatgggacgcgcagggagggcgttcagcttcagaaagcagcggctacgctgggtccaaacccggcggctcgggaggccatagctcctaggtgcgtccgagctcctgctaccctgcgcggtgttgtcctaccggaggaagtggctgatgggcagtctaggatcccggcccctgacccagggccctctcctccctgcggtcctggtccgggtcatggtcccggggctggtctgaagtgctgtctacagagggcacttggggaaacatcgtaggtccggaaattcccagggaaagtttttgcaggagttgtggacgccgcagcagccccaactctcccaacccagcttgcgacccgagagaagtcgctcacacttctctttgggggagggcgacagttccggggaggacgcttggatcccgaaaatgacgggatccaggtcccacaaccctcaggaagcgctgcggtcttcaaaactgcgcagctaaattcctgggcgcattctccctttcttggcgagtccagtgcccgtgccggggagcattccag

SEQ ID NO: 110691 - DNA, 30 bp, Homo sapiens; identical to SEQ ID NO: 77747
  misc_feature 1..30: note = chr15:60288131-60288161
  misc_feature 1..30: note = Hyper
  source 1..30: mol_type = genomic DNA

SEQ ID NO: 110692 - DNA, 171 bp, Homo sapiens; identical to SEQ ID NO: 77748
  misc_feature 1..171: note = chr15:60288412-60288583
  misc_feature 1..171: note = Hyper
  source 1..171: mol_type = genomic DNA

SEQ ID NO: 110693 - DNA, 132 bp, Homo sapiens; identical to SEQ ID NO: 77749
  misc_feature 1..132: note = chr15:60288786-60288918
  misc_feature 1..132: note = Hyper
  source 1..132: mol_type = genomic DNA

SEQ ID NO: 110694 - DNA, 316 bp, Homo sapiens; identical to SEQ ID NO: 35735
  misc_feature 1..316: note = chr15:60289310-60289626
  misc_feature 1..316: note = Hyper
  source 1..316: mol_type = genomic DNA

SEQ ID NO: 110695 - DNA, 30 bp, Homo sapiens; identical to SEQ ID NO: 35736
  misc_feature 1..30: note = chr15:60289876-60289906
  misc_feature 1..30: note = Hyper
  source 1..30: mol_type = genomic DNA

SEQ ID NO: 110696 - DNA, 48 bp, Homo sapiens; identical to SEQ ID NO: 77752
  misc_feature 1..48: note = chr15:60292201-60292249
  misc_feature 1..48: note = Hyper
  source 1..48: mol_type = genomic DNA

SEQ ID NO: 110697 - DNA, 2262 bp, Homo sapiens
  misc_feature 1..2262: note = chr15:60295917-60298179
  misc_feature 1..2262: note = Hyper
  source 1..2262: mol_type = genomic DNA
agtcaagtcaaatttcgacctaactctccggggactggggggcaagggtgtgttttcattattataacccatgcaaccaaccccgggtagtgctaagcgcaggaaaagggtcggcttcaggggaaagccgtgcctaaagttacctaacgatacaaaccggatacaacgcagaggaaacagaataccccagccaagcaatttccatgtcaaacatcatccgcgcggctgctccatctgtgaacgtgagtggtcgcctggctccctcttccgcggcggccgcttcctcataccttcacacggcgcacaccggccggcgcgtccagctgcctgcccagtggccgaggctcttccccctcgcccagtcttgagctggaagtgattcctattggccaaggtgtccatgtaaataggtgtgaaagaaaccagagctggccgggctctcccttctcgctcagtcccctccctctgcagcccccgctccccctcctcttcctcctcctcccaaggcgattgtcatatgatagctaagaagtggcacattaatgaagcgccgctacaggggtcttttctgctcctgtcaccgcttaaaactatcagatggttcgagggaggacatggaggcagccacctagctcagcggagacgcggagcccacagcagcgccctccggagccctaacacgtcgctgccaccatccgcgccgggactccgcagccgagctcggccgcccgcaggacgctccaggagcgtcgcggaccgggcggcacgggacgctgcggggctgagctcaagagcccaggttcgcgccgagtccaaccggacccggacgctgcgcgcggagtgcgcgtcgagtgcgcgccgagagagaagcggcgcgcagcggcgtcctcccggatgcggacgcgcaacttgaagcaactttaaggtgagcagctctctgttccgtccctgccccctattctggccccagtaccgacttacttcccggctatcctcgcgccgttcgccggcttcccctcccgcgcccactaagcccgcaaagttgctggcgaaagagtccgggcgctggctgatcgagcgccgcaggccccacccccgacccccgaagtctgttactcggtctggctgaccccgccggtgtctctgtgcatccatgctacctttccctattacccacccccttcccagatccgagcagtccgccggcccgcgcggacccagagcaagaagagggcgaggaagaagatgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgccggcatgatcgactcggccacccccatctccatggcgagtggcgactacagcgcctacggcgtgccgttgaagccgctgtgccacgcggcgggccaaacgctgcccgccatccccgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcactgacccgcaggagcccacgccccctctcgttctcctccccac

SEQ ID NO: 110698 - DNA, 30 bp, Homo sapiens; identical to SEQ ID NO: 77757
  misc_feature 1..30: note = chr15:60615951-60615981
  misc_feature 1..30: note = Hypo
  source 1..30: mol_type = genomic DNA

SEQ ID NO: 110699 - DNA, 30 bp, Homo sapiens; identical to SEQ ID NO: 77758
  misc_feature 1..30: note = chr15:60789762-60789792
  misc_feature 1..30: note = Hypo
  source 1..30: mol_type = genomic DNA

SEQ ID NO: 110700 - DNA, 321 bp, Homo sapiens; identical to SEQ ID NO: 77759
  misc_feature 1..321: note = chr15:60883283-60883604
  misc_feature 1..321: note = Hyper
  source 1..321: mol_type = genomic DNA

SEQ ID NO: 110701 - DNA, 32 bp, Homo sapiens; identical to SEQ ID NO: 77760
  misc_feature 1..32: note = chr15:60896339-60896371
  misc_feature 1..32: note = Hypo
  source 1..32: mol_type = genomic DNA

SEQ ID NO: 110702 - DNA, 30 bp, Homo sapiens; identical to SEQ ID NO: 44275
  misc_feature 1..30: note = chr15:60915264-60915294
  misc_feature 1..30: note = Hypo
  source 1..30: mol_type = genomic DNA

SEQ ID NO: 110703 - DNA, 30 bp, Homo sapiens; identical to SEQ ID NO: 77762
  misc_feature 1..30: note = chr15:60924136-60924166
  misc_feature 1..30: note = Hypo
  source 1..30: mol_type = genomic DNA

SEQ ID NO: 110704 - DNA, 30 bp, Homo sapiens; identical to SEQ ID NO: 77763
  misc_feature 1..30: note = chr15:61065077-61065107
  misc_feature 1..30: note = Hypo
  source 1..30: mol_type = genomic DNA

SEQ ID NO: 110705 - DNA, 127 bp, Homo sapiens; identical to SEQ ID NO: 77764
  misc_feature 1..127: note = chr15:61113449-61113576
  misc_feature 1..127: note = Hypo
  source 1..127: mol_type = genomic DNA

SEQ ID NO: 110706 - DNA, 30 bp, Homo sapiens; identical to SEQ ID NO: 44276
  misc_feature 1..30: note = chr15:61305596-61305626
  misc_feature 1..30: note = Hypo
  source 1..30: mol_type = genomic DNA

SEQ ID NO: 110707 - DNA, 250 bp, Homo sapiens; identical to SEQ ID NO: 77766
  misc_feature 1..250: note = chr15:61519861-61520111
  misc_feature 1..250: note = Hyper
  source 1..250: mol_type = genomic DNA

SEQ ID NO: 110708 - DNA, 89 bp, Homo sapiens; identical to SEQ ID NO: 77767
  misc_feature 1..89: note = chr15:61520408-61520497
  misc_feature 1..89: note = Hyper
  source 1..89: mol_type = genomic DNA

SEQ ID NO: 110709 - DNA, 742 bp, Homo sapiens
  misc_feature 1..742: note = chr15:61520754-61521496
  misc_feature 1..742: note = Hyper
  source 1..742: mol_type = genomic DNA
ccgaaaacacacccccgactcgggcagccagggccgaaactgtcaagaggagaaaaggtaaagcggaaggagggtggccataaacagatttttttgccccttcttaaaaggacactgccgctttaaaagtttctttcccgggcccccactccccgcatctccgtattttgggggagcgtatttaattgaggcaacgcagctttcctccagtgtttgcagaaaaatcaaagccaggggggtgagcccgccggctgtcaaccttcccgccgcctcccccgccccactctgctcccgcaagccgagaacgggctgcaaaagtttgcaacatttctggggggcggaggggggaggggaggggggtcctccgggctcggggcgccgccgcaggctcgcgcgcggccgccggaccccgcgccccgggcgcccgctcccggccgccccccgctccgcgcccgggctcccgccgccccctccccagcccctctccagcctcctacctctgctggtgctggaatagctctgtctgcgcaccggggcaggcggctcgctcttgcgggcggattcctggttcagcggggtctccctggagccggcggccgcgtccgcgccgctgctgcctggctcgctggcggcggggtcgggggctgccggagctgactccatgttttttcccaatgtagagatcgctggagatggcgagctccgagactccctctatcttctgttttcagagcaactctat

SEQ ID NO: 110710 - DNA, 22 bp, Homo sapiens
  misc_feature 1..22: note = chr15:61521556-61521578
  misc_feature 1..22: note = Hyper
  source 1..22: mol_type = genomic DNA
cgaccggcgaaagcaggaggga

SEQ ID NO: 110711 - DNA, 165 bp, Homo sapiens; identical to SEQ ID NO: 77771
  misc_feature 1..165: note = chr15:61521809-61521974
  misc_feature 1..165: note = Hyper
  source 1..165: mol_type = genomic DNA

SEQ ID NO: 110712 - DNA, 139 bp, Homo sapiens; identical to SEQ ID NO: 77772
  misc_feature 1..139: note = chr15:61739721-61739860
  misc_feature 1..139: note = Hypo
  source 1..139: mol_type = genomic DNA

SEQ ID NO: 110713 - DNA, 37 bp, Homo sapiens; identical to SEQ ID NO: 77773
  misc_feature 1..37: note = chr15:62068181-62068218
  misc_feature 1..37: note = Hypo
  source 1..37: mol_type = genomic DNA

SEQ ID NO: 110714 - DNA, 30 bp, Homo sapiens; identical to SEQ ID NO: 44277
  misc_feature 1..30: note = chr15:62361320-62361350
  misc_feature 1..30: note = Hypo
  source 1..30: mol_type = genomic DNA

SEQ ID NO: 110715 - DNA, 44 bp, Homo sapiens; identical to SEQ ID NO: 44278
  misc_feature 1..44: note = chr15:62367703-62367747
  misc_feature 1..44: note = Hypo
  source 1..44: mol_type = genomic DNA

SEQ ID NO: 110716 - DNA, 159 bp, Homo sapiens; identical to SEQ ID NO: 77776
  misc_feature 1..159: note = chr15:62456236-62456395
  misc_feature 1..159: note = Hyper
  source 1..159: mol_type = genomic DNA

SEQ ID NO: 110717 - DNA, 245 bp, Homo sapiens; identical to SEQ ID NO: 77777
  misc_feature 1..245: note = chr15:62456686-62456931
  misc_feature 1..245: note = Hyper
  source 1..245: mol_type = genomic DNA

SEQ ID NO: 110718 - DNA, 158 bp, Homo sapiens; identical to SEQ ID NO: 77778
  misc_feature 1..158: note = chr15:62457138-62457296
  misc_feature 1..158: note = Hyper
  source 1..158: mol_type = genomic DNA

SEQ ID NO: 110719 - DNA, 80 bp, Homo sapiens; identical to SEQ ID NO: 77779
  misc_feature 1..80: note = chr15:62684233-62684313
  misc_feature 1..80: note = Hyper
  source 1..80: mol_type = genomic DNA

SEQ ID NO: 110720 - DNA, 91 bp, Homo sapiens; identical to SEQ ID NO: 77780
  misc_feature 1..91: note = chr15:62821527-62821618
  misc_feature 1..91: note = Hypo
  source 1..91: mol_type = genomic DNA

SEQ ID NO: 110721 - DNA, 243 bp, Homo sapiens; identical to SEQ ID NO: 77781
  misc_feature 1..243: note = chr15:63334477-63334720
  misc_feature 1..243: note = Hyper
  source 1..243: mol_type = genomic DNA

SEQ ID NO: 110722 - DNA, 74 bp, Homo sapiens; identical to SEQ ID NO: 77782
  misc_feature 1..74: note = chr15:63334921-63334995
  misc_feature 1..74: note = Hyper
  source 1..74: mol_type = genomic DNA

SEQ ID NO: 110723 - DNA, 72 bp, Homo sapiens; identical to SEQ ID NO: 77783
  misc_feature 1..72: note = chr15:63335932-63336004
  misc_feature 1..72: note = Hyper
  source 1..72: mol_type = genomic DNA

SEQ ID NO: 110724 - DNA, 35 bp, Homo sapiens; identical to SEQ ID NO: 77784
  misc_feature 1..35: note = chr15:63390437-63390472
  misc_feature 1..35: note = Hypo
  source 1..35: mol_type = genomic DNA

SEQ ID NO: 110725 - DNA, 501 bp, Homo sapiens; identical to SEQ ID NO: 77785
  misc_feature 1..501: note = chr15:63673771-63674272
  misc_feature 1..501: note = Hyper
  source 1..501: mol_type = genomic DNA

SEQ ID NO: 110726 - DNA, 249 bp, Homo sapiens; identical to SEQ ID NO: 77786
  misc_feature 1..249: note = chr15:63753342-63753591
  misc_feature 1..249: note = Hypo
  source 1..249: mol_type = genomic DNA

SEQ ID NO: 110727 - DNA, 30 bp, Homo sapiens; identical to SEQ ID NO: 77787
  misc_feature 1..30: note = chr15:63756300-63756330
  misc_feature 1..30: note = Hypo
  source 1..30: mol_type = genomic DNA

SEQ ID NO: 110728 - DNA, 82 bp, Homo sapiens; identical to SEQ ID NO: 77788
  misc_feature 1..82: note = chr15:63779643-63779725
  misc_feature 1..82: note = Hyper
  source 1..82: mol_type = genomic DNA

SEQ ID NO: 110729 - DNA, 30 bp, Homo sapiens; identical to SEQ ID NO: 77789
  misc_feature 1..30: note = chr15:63795471-63795501
  misc_feature 1..30: note = Hyper
  source 1..30: mol_type = genomic DNA

SEQ ID NO: 110730 - DNA, 43 bp, Homo sapiens; identical to SEQ ID NO: 77790
  misc_feature 1..43: note = chr15:63795851-63795894
  misc_feature 1..43: note = Hyper
  source 1..43: mol_type = genomic DNA

SEQ ID NO: 110731 - DNA, 30 bp, Homo sapiens; identical to SEQ ID NO: 77791
  misc_feature 1..30: note = chr15:64210208-64210238
  misc_feature 1..30: note = Hypo
  source 1..30: mol_type = genomic DNA

SEQ ID NO: 110732 - DNA, 30 bp, Homo sapiens; identical to SEQ ID NO: 44280
  misc_feature 1..30: note = chr15:64440388-64440418
  misc_feature 1..30: note = Hypo
  source 1..30: mol_type = genomic DNA

SEQ ID NO: 110733 - DNA, 91 bp, Homo sapiens; identical to SEQ ID NO: 77793
  misc_feature 1..91: note = chr15:64443195-64443286
  misc_feature 1..91: note = Hypo
  source 1..91: mol_type = genomic DNA

SEQ ID NO: 110734 - DNA, 38 bp, Homo sapiens; identical to SEQ ID NO: 77794
  misc_feature 1..38: note = chr15:64649878-64649916
  misc_feature 1..38: note = Hypo
  source 1..38: mol_type = genomic DNA

SEQ ID NO: 110735 - DNA, 30 bp, Homo sapiens; identical to SEQ ID NO: 77795
  misc_feature 1..30: note = chr15:65036371-65036401
  misc_feature 1..30: note = Hypo
  source 1..30: mol_type = genomic DNA

SEQ ID NO: 110736 - DNA, 152 bp, Homo sapiens; identical to SEQ ID NO: 44282
  misc_feature 1..152: note = chr15:65043526-65043678
  misc_feature 1..152: note = Hypo
  source 1..152: mol_type = genomic DNA

SEQ ID NO: 110737 - DNA, 50 bp, Homo sapiens; identical to SEQ ID NO: 77797
  misc_feature 1..50: note = chr15:65068204-65068254
  misc_feature 1..50: note = Hyper
  source 1..50: mol_type = genomic DNA

SEQ ID NO: 110738 - DNA, 32 bp, Homo sapiens
  misc_feature 1..32: note = chr15:65116283-65116315
  misc_feature 1..32: note = Hyper
  source 1..32: mol_type = genomic DNA
ccggcctcggcgaaacgcgtgaagaggcgcgc

SEQ ID NO: 110739 - DNA, 30 bp, Homo sapiens; identical to SEQ ID NO: 77798
  misc_feature 1..30: note = chr15:65118647-65118677
  misc_feature 1..30: note = Hypo
  source 1..30: mol_type = genomic DNA

SEQ ID NO: 110740 - DNA, 35 bp, Homo sapiens; identical to SEQ ID NO: 77799
  misc_feature 1..35: note = chr15:65119226-65119261
  misc_feature 1..35: note = Hypo
  source 1..35: mol_type = genomic DNA

SEQ ID NO: 110741 - DNA, 29 bp, Homo sapiens
  misc_feature 1..29: note = chr15:65127732-65127761
  misc_feature 1..29: note = Hypo
  source 1..29: mol_type = genomic DNA
tgagccaccgcgcccggcctggatttatg

SEQ ID NO: 110742 - DNA, 48 bp, Homo sapiens; identical to SEQ ID NO: 77801
  misc_feature 1..48: note = chr15:65204187-65204235
  misc_feature 1..48: note = Hyper
  source 1..48: mol_type = genomic DNA

SEQ ID NO: 110743 - DNA, 30 bp, Homo sapiens; identical to SEQ ID NO: 77802
  misc_feature 1..30: note = chr15:65214117-65214147
  misc_feature 1..30: note = Hypo
  source 1..30: mol_type = genomic DNA

SEQ ID NO: 110744 - DNA, 37 bp, Homo sapiens; identical to SEQ ID NO: 77803
  misc_feature 1..37: note = chr15:65322459-65322496
  misc_feature 1..37: note = Hypo
  source 1..37: mol_type = genomic DNA

SEQ ID NO: 110745 - DNA, 227 bp, Homo sapiens
  misc_feature 1..227: note = chr15:65360172-65360399
  misc_feature 1..227: note = Hyper
  source 1..227: mol_type = genomic DNA
tggcgacgccctggacggccacgcaggtctgcggccggtgggccccgcgcagtgcgcccgcccgtcggggcccaggggagcgggatgcaggcttccctggagcgcgcggccccggacccgtcggcgtccgcgccctcggccccgcgtccagcgggctgccaccccgcggggaggaggggccggtggagcctggcgggcggggccaccccaagcgccaccaaattcct

SEQ ID NO: 110746 - DNA, 50 bp, Homo sapiens; identical to SEQ ID NO: 77806
  misc_feature 1..50: note = chr15:65622968-65623018
  misc_feature 1..50: note = Hypo
  source 1..50: mol_type = genomic DNA

SEQ ID NO: 110747 - DNA, 197 bp, Homo sapiens; identical to SEQ ID NO: 77807
  misc_feature 1..197: note = chr15:65625104-65625301
  misc_feature 1..197: note = Hypo
  source 1..197: mol_type = genomic DNA

SEQ ID NO: 110748 - DNA, 287 bp, Homo sapiens
  misc_feature 1..287: note = chr15:65647864-65648151
  misc_feature 1..287: note = Hyper
  source 1..287: mol_type = genomic DNA
cggcgggccccttcccggcggccgggcccgaggcgggggccggttcccacagccgaccgggccgcgcgccgcctttgaagtggccgcagctgcgccccggcccgcggctaatccccgccgacgcgggcgtcccgcccccccgcccctcccgcatagcaatagtgtccgcgctgaatggcgctggctaattacctcgctcgcaccaccgcgggtgaatgagagaatccggcattgtgcgcggcgaatggagaaaataagacagccattgtcctcgcacgccaaacgag

SEQ ID NO: 110749 - DNA, 1174 bp, Homo sapiens; identical to SEQ ID NO: 77810
  misc_feature 1..1174: note = chr15:65669070-65670244
  misc_feature 1..1174: note = Hyper
  source 1..1174: mol_type = genomic DNA

SEQ ID NO: 110750 - DNA, 151 bp, Homo sapiens; identical to SEQ ID NO: 35762
  misc_feature 1..151: note = chr15:65670634-65670785
  misc_feature 1..151: note = Hyper
  source 1..151: mol_type = genomic DNA

SEQ ID NO: 110751 - DNA, 564 bp, Homo sapiens; identical to SEQ ID NO: 77812
  misc_feature 1..564: note = chr15:65713759-65714323
  misc_feature 1..564: note = Hyper
  source 1..564: mol_type = genomic DNA

SEQ ID NO: 110752 - DNA, 84 bp, Homo sapiens; identical to SEQ ID NO: 77813
  misc_feature 1..84: note = chr15:65714747-65714831
  misc_feature 1..84: note = Hyper
  source 1..84: mol_type = genomic DNA

SEQ ID NO: 110753 - DNA, 580 bp, Homo sapiens
  misc_feature 1..580: note = chr15:65715098-65715678
  misc_feature 1..580: note = Hyper
  source 1..580: mol_type = genomic DNA
tcgctcctgcctctccgggcgcccgcccttaccgcgcgcggccaacaggcagaaggtcaacgcgaggagcccgcggccgcggccggcgtccccccgcgccatggggctgggctcgggccgccgccgccgccgccgcctccccgtgcttcggccgccgccgcggggggagagcgcgccgggcgtcagtggcccggggaggcgcggcgccgcgggcgggggcgcggcctcgggggcccgggcccgagctggggccggcgcgggggccagggccgctgccgcctcacccgcccctccatcgccatcttgggcgagcggcccgggagggggcgcccggcgagtgtggccaccctggccccgccggggaccctgcgcccgcgcgccacggccctgcgcctcgcgggggctcctctcggcccgggtctgtgtcccggtgcctcgccctctccgggtcgccgcgggcccccgtgaggccgcctgttgctgggtctgtctcttagtctccccgtctctgagtcttctggtctctctgcctcagcgtctctatttcttctccctgttgctgcctcggggtctccacctc

SEQ ID NO: 110754 - DNA, 95 bp, Homo sapiens; identical to SEQ ID NO: 77816
  misc_feature 1..95: note = chr15:65826384-65826479
  misc_feature 1..95: note = Hypo
  source 1..95: mol_type = genomic DNA

SEQ ID NO: 110755 - DNA, 103 bp, Homo sapiens; identical to SEQ ID NO: 44285
  misc_feature 1..103: note = chr15:65862091-65862194
  misc_feature 1..103: note = Hypo
  source 1..103: mol_type = genomic DNA

SEQ ID NO: 110756 - DNA, 30 bp, Homo sapiens; identical to SEQ ID NO: 77818
  misc_feature 1..30: note = chr15:65946844-65946874
  misc_feature 1..30: note = Hypo
  source 1..30: mol_type = genomic DNA

SEQ ID NO: 110757 - DNA, 83 bp, Homo sapiens; identical to SEQ ID NO: 77819
  misc_feature 1..83: note = chr15:66017661-66017744
  misc_feature 1..83: note = Hypo
  source 1..83: mol_type = genomic DNA

SEQ ID NO: 110758 - DNA, 33 bp, Homo sapiens; identical to SEQ ID NO: 44286
  misc_feature 1..33: note = chr15:66147762-66147795
  misc_feature 1..33: note = Hypo
  source 1..33: mol_type = genomic DNA

SEQ ID NO: 110759 - DNA, 30 bp, Homo sapiens; identical to SEQ ID NO: 77821
  misc_feature 1..30: note = chr15:66198204-66198234
  misc_feature 1..30: note = Hypo
  source 1..30: mol_type = genomic DNA

SEQ ID NO: 110760 - DNA, 41 bp, Homo sapiens; identical to SEQ ID NO: 77822
  misc_feature 1..41: note = chr15:66596944-66596985
  misc_feature 1..41: note = Hypo
  source 1..41: mol_type = genomic DNA

SEQ ID NO: 110761 - DNA, 192 bp, Homo sapiens; identical to SEQ ID NO: 44287
  misc_feature 1..192: note = chr15:66598802-66598994
  misc_feature 1..192: note = Hypo
  source 1..192: mol_type = genomic DNA

SEQ ID NO: 110762 - DNA, 104 bp, Homo sapiens; identical to SEQ ID NO: 77824
  misc_feature 1..104: note = chr15:66647729-66647833
  misc_feature 1..104: note = Hypo
  source 1..104: mol_type = genomic DNA

SEQ ID NO: 110763 - DNA, 97 bp, Homo sapiens; identical to SEQ ID NO: 77825
  misc_feature 1..97: note = chr15:66649671-66649768
  misc_feature 1..97: note = Hypo
  source 1..97: mol_type = genomic DNA

SEQ ID NO: 110764 - DNA, 30 bp, Homo sapiens; identical to SEQ ID NO: 44288
  misc_feature 1..30: note = chr15:66788210-66788240
  misc_feature 1..30: note = Hypo
  source 1..30: mol_type = genomic DNA

SEQ ID NO: 110765 - DNA, 30 bp, Homo sapiens; identical to SEQ ID NO: 77827
  misc_feature 1..30: note = chr15:66789348-66789378
  misc_feature 1..30: note = Hypo
  source 1..30: mol_type = genomic DNA

SEQ ID NO: 110766 - DNA, 26 bp, Homo sapiens
  misc_feature 1..26: note = chr15:66798718-66798744
  misc_feature 1..26: note = Hypo
  source 1..26: mol_type = genomic DNA
agataaggccgggcgcgatggttcac

SEQ ID NO: 110767 - DNA, 185 bp, Homo sapiens; identical to SEQ ID NO: 77829
  misc_feature 1..185: note = chr15:66963175-66963360
  misc_feature 1..185: note = Hypo
  source 1..185: mol_type = genomic DNA

SEQ ID NO: 110768 - DNA, 62 bp, Homo sapiens; identical to SEQ ID NO: 77830
  misc_feature 1..62: note = chr15:66963672-66963734
  misc_feature 1..62: note = Hypo
  source 1..62: mol_type = genomic DNA

SEQ ID NO: 110769 - DNA, 72 bp, Homo sapiens; identical to SEQ ID NO: 44292
  misc_feature 1..72: note = chr15:66964011-66964083
  misc_feature 1..72: note = Hypo
  source 1..72: mol_type = genomic DNA

SEQ ID NO: 110770 - DNA, 33 bp, Homo sapiens; identical to SEQ ID NO: 77832
  misc_feature 1..33: note = chr15:66995234-66995267
  misc_feature 1..33: note = Hyper
  source 1..33: mol_type = genomic DNA

SEQ ID NO: 110771 - DNA, 30 bp, Homo sapiens; identical to SEQ ID NO: 77833
  misc_feature 1..30: note = chr15:67322314-67322344
  misc_feature 1..30: note = Hypo
  source 1..30: mol_type = genomic DNA

SEQ ID NO: 110772 - DNA, 39 bp, Homo sapiens; identical to SEQ ID NO: 44293
  misc_feature 1..39: note = chr15:67457364-67457403
  misc_feature 1..39: note = Hypo
  source 1..39: mol_type = genomic DNA

SEQ ID NO: 110773 - DNA, 81 bp, Homo sapiens; identical to SEQ ID NO: 15907
  misc_feature 1..81: note = chr15:67545405-67545486
  misc_feature 1..81: note = Hypo
  source 1..81: mol_type = genomic DNA

SEQ ID NO: 110774 - DNA, 30 bp, Homo sapiens; identical to SEQ ID NO: 77836
  misc_feature 1..30: note = chr15:68074740-68074770
  misc_feature 1..30: note = Hypo
  source 1..30: mol_type = genomic DNA

SEQ ID NO: 110775 - DNA, 620 bp, Homo sapiens
  misc_feature 1..620: note = chr15:68112054-68112674
  misc_feature 1..620: note = Hyper
  source 1..620: mol_type = genomic DNA
gcctggtccaggcagcggaaacccagagggtacggcctcccaccaaatccggaccctctccagcctcagtctctggtccgcaacaggagtgaggtgggcccggagctctgagcaccttctcaccggctccaaggcccccgccttctcctcacttttggtctcgggttggggcccggcaggccccgcccagcctccttcacttccttgggccagggccgccgccgcgccgggctctgccctatgtggccgttggattaatatccagatattaagtaaacactaaattagcaaaactacaagaaaattttacagccctttgcatttggcaatcattgagtgttaattagaaattcattacaattaaaaccctgcctaaacagggcctgcgcgccttaattacatctgatttttaattcagaatacgtgtttacacagtaagcgctacgtaccccgtgattatccccaatcctctttatactgtactaattatgtaaattaaacctaattaactgacgaaaactgccgttaattcaactagtaaaagatatgtgcttgcggaggaggcgcgtccgcgcagcctcagcccaagccggagcccaaatggacgccaaacccggggc

SEQ ID NO: 110776 - DNA, 30 bp, Homo sapiens; identical to SEQ ID NO: 77840
  misc_feature 1..30: note = chr15:68112976-68113006
  misc_feature 1..30: note = Hyper
  source 1..30: mol_type = genomic DNA

SEQ ID NO: 110777 - DNA, 1295 bp, Homo sapiens; identical to SEQ ID NO: 77841
  misc_feature 1..1295: note = chr15:68113226-68114521
  misc_feature 1..1295: note = Hyper
  source 1..1295: mol_type = genomic DNA

SEQ ID NO: 110778 - DNA, 192 bp, Homo sapiens; identical to SEQ ID NO: 77842
  misc_feature 1..192: note = chr15:68114819-68115011
  misc_feature 1..192: note = Hyper
  source 1..192: mol_type = genomic DNA

SEQ ID NO: 110779 - DNA, 1371 bp, Homo sapiens; identical to SEQ ID NO: 77843
  misc_feature 1..1371: note = chr15:68115216-68116587
  misc_feature 1..1371: note = Hyper
  source 1..1371: mol_type = genomic DNA

SEQ ID NO: 110780 - DNA, 30 bp, Homo sapiens; identical to SEQ ID NO: 77844
  misc_feature 1..30: note = chr15:68116962-68116992
  misc_feature 1..30: note = Hyper
  source 1..30: mol_type = genomic DNA

SEQ ID NO: 110781 - DNA, 1481 bp, Homo sapiens; identical to SEQ ID NO: 77845
  misc_feature 1..1481: note = chr15:68117203-68118684
  misc_feature 1..1481: note = Hyper
  source 1..1481: mol_type = genomic DNA

SEQ ID NO: 110782 - DNA, 3844 bp, Homo sapiens
  misc_feature 1..3844: note = chr15:68118886-68122730
  misc_feature 1..3844: note = Hyper
  source 1..3844: mol_type = genomic DNA
aacttcaactcctggcgtcgtcacctcaaactcagtgacaagtcggccacagacgaactgagccatgcttgggaggacgtcaaggccatgtttaatggcggcacgcgcaagcggaccttctccctacaaggaggcggcggaggcggtgccaatggcgggtcgggtgggcaggggaagggtggtgctggcggcggtggcggcggtggcccagggtgcggtgcagagatggccccaggcccgccgccccacaaaagcctgcgctgtggcgaagatgaggctgccgggcctccggggccacctccaccccacccgcagcgcggacttggcctggcgactggagctagtggcccggcgggcccaggagggcccggtggcggcgccggcgtacgaagctacccggtgatcccggtgcccagcaaaggctttgggctcctgcaaaagctgcccccaccacttttcccccatccttacggcttccctacggccttcggcctatgccccaaaaaggacgacccggttttaggcgcgggcgagccaaagggcggtcctggcactgggagcggcggcggcggcgcggggacaggcgggggtgcggggggcccgggagccagccacttgcccccgggggcaggggcgggcccgggcggcggcgccatgttctgggggcatcaaccctccggggcagccaaggacgcagcggcagtggctgcagcggccgccgccgccactgtgtacccgacgtttcccatgttctggccagcagcaggcagcctcccggtaccgtcctaccccgctgctcagagccaagccaaggccgtggcggcagccgtggcggcggcagcggcggcggcagcggcagctgctggcagcggtgccccagagcccctggacggtgccgagccagccaaagagagtggcctcggcgcggaggagcgctgcccgagcgctctgtcccgcgggcccctggacgaagacggcacggacgaggcgctgccaccgcccctggccccgttgcccccgccgcccccgccgcccgcacgcaaaggctcctacgtgtcggccttccggccggtggtcaaggacaccgagagcatcgctaagctctacgggagcgcccgggaggcgtacggcgcggggcctgctcgggggccgggacccggcgctgggagcggcggctacgtgagcccggactttctgagcgagggcagctccagctacaattccgcctcgcccgacgtggacaccgcggacgagcccgaggtggacgtggaatccaaccgcttccccgacgacgaggacgcccaagaggagaccgagcccagcgcacccagcgcagggggcggcccagacggtgaacagcccactggacccccttccgccacctcctctggcgcggacggtcccgcaaactctcccgacggcggcagcccccgcccccggcgccgcctcgggccacccccagctggccggcccgcatttggggacttggcagccgaagacttggtgcggagacctgagaggagcccgccaagcggcggcggcggctacgagctgcgagagccttgcgggcccctaggaggccccgcgccggccaaggtgagccccgcgcccgccccgccagtggcgccttcccacctaccctgtgcgcggcagggctgcggggccgggcggagaacgggaattttgttccgcgcaggcgtgggagcagcaggcctcggccactctccgcaggcccagccttgggcgcgctgcgaaactgggcccacccgcaccctccagtgagggtttcgaagggaagggaagctgggggcggcgggaggactggggaacttgtgtgctttgtttttgttgatgggaatggggaggagaccggctgagactgccagacacagagacagaaaaggggtgtggagaaagaaagaggaggtaagaaaggaacccagagccagagaaaagcgctcgcccgggtgggcatcagagccccaaggaagaggagaagagaggacagtgtggcctctccctgagtcgggccccagcagtaccgggtccccggaatctcccaccaccccaactcgcagttttccgagtctcttcgcactcccgccttgggaaccacagggttcgttgctgggaagctgtctcgggaccgcgtgcggagcgggaggggggctctcaagctggcagggccggggcttgaggggcaggatgcagccaggctggagtcgttggccattttgaaagtgagtgcgcatacctgtacattcggttcattaaaacacgaatcattaaccggatgcgaaaggcgtcatttatgccgcggacggggcactggcgggagggaaaatgcctaaaaggaggcgggtgcagagggtggaggacactttgaacgcccctcggcttgggagccgctttgtgtttagagtaattttcccgagggcgctaacaattaccctgaatctacaagggggcaagggtgcgccgcgtgcgtcactgtgcccgctcaagtccagcgggcgcaccaacctttgccactccgtcggctttccctcttggccgcggggtagggctgggcgtctttgggccgccgcagggcgccaccctaatcgcctgtcatttctcggccgtcgcaggtgttcgcgcccgagagggatgagcacgtgaagagcgcggcggtggcgctggggcccgcggcctcctacgtctgcacccccgaggcccacggtaacgcctgtcgcggccgctggccactgtaatgggggaaccgcagacagagggccggggtcaaggaaggcctgcgaaggaagacaaggagagagacgcagagaaagagggagagggaaagaaaaataatgaaaacaaggaagctaagctagtactcccaacaacttccaatctttagttacttaaaaacaacagtgacaacgccctctccaccacacgcacacacatgctgcagtacacccagacacggcgttaaacccttaacaaaatcacgcccgacacggccttcaaatcctctcatttattcagcaagtgtgtttggccgcggggtcccctttggctaggccggatcggggcggaggatgggggcacatggccgcgcgcttgggtaccccagaagcgccagggtagctgaggcccatcgcggggtggtgggggccgccctgcacttgcgcgccttaccaggttcctcacagaggaggggttgggggcagcggaaaatcgggcaggtcgaggcagccgaaccccggacgatgtccccccacccaccccgaaggtcgcagcctgggccgcgttctcagcaggagtcgggcggacagacccggcggccacgcgcgctcgcggtgccccagtatctgcgcgcgatgtaggtcgctcgtccctggtgggctcggctgctcgcctagctcttttccaaggggctggggcgggggcctgaagcccggagatgagcagaccaggcgcgggggtggggggtgcccggcccaaagcctcagggcgcgctcctgggcgcacagccgggaaccagaggcggccacgacgcttttaattagggctggggcgccccgaccgcggcagctccggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagccagcccttgaacccatcgctctccaccgcacccaggagctgggacccaggtcgcccaggttcccagaggcttgcgagaaaggctttta

SEQ ID NO: 110783 - DNA, 1021 bp, Homo sapiens; identical to SEQ ID NO: 77851
  misc_feature 1..1021: note = chr15:68125223-68126244
  misc_feature 1..1021: note = Hyper
  source 1..1021: mol_type = genomic DNA

SEQ ID NO: 110784 - DNA, 100 bp, Homo sapiens; identical to SEQ ID NO: 77852
  misc_feature 1..100: note = chr15:68126468-68126568
  misc_feature 1..100: note = Hyper
  source 1..100: mol_type = genomic DNA

SEQ ID NO: 110785 - DNA, 224 bp, Homo sapiens; identical to SEQ ID NO: 77853
  misc_feature 1..224: note = chr15:68126905-68127129
  misc_feature 1..224: note = Hyper
  source 1..224: mol_type = genomic DNA

SEQ ID NO: 110786 - DNA, 1010 bp, Homo sapiens; identical to SEQ ID NO: 77854
  misc_feature 1..1010: note = chr15:68127492-68128502
  misc_feature 1..1010: note = Hyper
  source 1..1010: mol_type = genomic DNA

SEQ ID NO: 110787 - DNA, 250 bp, Homo sapiens; identical to SEQ ID NO: 77855
  misc_feature 1..250: note = chr15:68260400-68260650
  misc_feature 1..250: note = Hyper
  source 1..250: mol_type = genomic DNA

SEQ ID NO: 110788 - DNA, 241 bp, Homo sapiens; identical to SEQ ID NO: 77856
  misc_feature 1..241: note = chr15:68549380-68549621
  misc_feature 1..241: note = Hyper
  source 1..241: mol_type = genomic DNA

SEQ ID NO: 110789 - DNA, 65 bp, Homo sapiens; identical to SEQ ID NO: 35785
  misc_feature 1..65: note = chr15:68569420-68569485
  misc_feature 1..65: note = Hyper
  source 1..65: mol_type = genomic DNA

SEQ ID NO: 110790 - DNA, 80 bp, Homo sapiens; identical to SEQ ID NO: 77858
  misc_feature 1..80: note = chr15:68569712-68569792
  misc_feature 1..80: note = Hyper
  source 1..80: mol_type = genomic DNA

SEQ ID NO: 110791 - DNA, 30 bp, Homo sapiens; identical to SEQ ID NO: 77859
  misc_feature 1..30: note = chr15:68631675-68631705
  misc_feature 1..30: note = Hypo
  source 1..30: mol_type = genomic DNA

SEQ ID NO: 110792 - DNA, 810 bp, Homo sapiens; identical to SEQ ID NO: 77860
  misc_feature 1..810: note = chr15:68723523-68724333
  misc_feature 1..810: note = Hyper
  source 1..810: mol_type = genomic DNA

SEQ ID NO: 110793 - DNA, 49 bp, Homo sapiens; identical to SEQ ID NO: 77861
  misc_feature 1..49: note = chr15:68851848-68851897
  misc_feature 1..49: note = Hyper
  source 1..49: mol_type = genomic DNA

SEQ ID NO: 110794 - DNA, 53 bp, Homo sapiens; identical to SEQ ID NO: 77862
  misc_feature 1..53: note = chr15:68870354-68870407
  misc_feature 1..53: note = Hyper
  source 1..53: mol_type = genomic DNA

SEQ ID NO: 110795 - DNA, 265 bp, Homo sapiens; identical to SEQ ID NO: 35787
  misc_feature 1..265: note = chr15:68870820-68871085
  misc_feature 1..265: note = Hyper
  source 1..265: mol_type = genomic DNA

SEQ ID NO: 110796 - DNA, 134 bp, Homo sapiens; identical to SEQ ID NO: 77864
  misc_feature 1..134: note = chr15:68871386-68871520
  misc_feature 1..134: note = Hyper
  source 1..134: mol_type = genomic DNA

SEQ ID NO: 110797 - DNA, 87 bp, Homo sapiens; identical to SEQ ID NO: 77865
  misc_feature 1..87: note = chr15:68871739-68871826
  misc_feature 1..87: note = Hyper
  source 1..87: mol_type = genomic DNA

SEQ ID NO: 110798 - DNA, 30 bp, Homo sapiens; identical to SEQ ID NO: 77866
  misc_feature 1..30: note = chr15:69109310-69109340
  misc_feature 1..30: note = Hyper
  source 1..30: mol_type = genomic DNA

SEQ ID NO: 110799 - DNA, 198 bp, Homo sapiens; identical to SEQ ID NO: 77867
  misc_feature 1..198: note = chr15:69136224-69136422
  misc_feature 1..198: note = Hyper
  source 1..198: mol_type = genomic DNA

SEQ ID NO: 110800 - DNA, 30 bp, Homo sapiens; identical to SEQ ID NO: 77868
  misc_feature 1..30: note = chr15:69265691-69265721
  misc_feature 1..30: note = Hypo
  source 1..30: mol_type = genomic DNA

SEQ ID NO: 110801 - DNA, 17 bp, Homo sapiens
  misc_feature 1..17: note = chr15:69324757-69324774
  misc_feature 1..17: note = Hypo
  source 1..17: mol_type = genomic DNA
tttttttttctgagacg

SEQ ID NO: 110802 - DNA, 192 bp, Homo sapiens; identical to SEQ ID NO: 77870
  misc_feature 1..192: note = chr15:69366538-69366730
  misc_feature 1..192: note = Hyper
  source 1..192: mol_type = genomic DNA

SEQ ID NO: 110803 - DNA, 36 bp, Homo sapiens; identical to SEQ ID NO: 77871
  misc_feature 1..36: note = chr15:69367021-69367057
  misc_feature 1..36: note = Hyper
  source 1..36: mol_type = genomic DNA

SEQ ID NO: 110804 - DNA, 152 bp, Homo sapiens; identical to SEQ ID NO: 77872
  misc_feature 1..152: note = chr15:69591361-69591513
  misc_feature 1..152: note = Hyper
  source 1..152: mol_type = genomic DNA

SEQ ID NO: 110805 - DNA, 93 bp, Homo sapiens; identical to SEQ ID NO: 77873
  misc_feature 1..93: note = chr15:69754330-69754423
  misc_feature 1..93: note = Hypo
  source 1..93: mol_type = genomic DNA

SEQ ID NO: 110806 - DNA, 30 bp, Homo sapiens; identical to SEQ ID NO: 15908
  misc_feature 1..30: note = chr15:70075720-70075750
  misc_feature 1..30: note = Hypo
  source 1..30: mol_type = genomic DNA

SEQ ID NO: 110807 - DNA, 38 bp, Homo sapiens; identical to SEQ ID NO: 77875
  misc_feature 1..38: note = chr15:70347537-70347575
  misc_feature 1..38: note = Hypo
  source 1..38: mol_type = genomic DNA

SEQ ID NO: 110808 - DNA, 120 bp, Homo sapiens; identical to SEQ ID NO: 77876
  misc_feature 1..120: note = chr15:70617030-70617150
  misc_feature 1..120: note = Hypo
  source 1..120: mol_type = genomic DNA

SEQ ID NO: 110809 - DNA, 30 bp, Homo sapiens; identical to SEQ ID NO: 77877
  misc_feature 1..30: note = chr15:70708037-70708067
  misc_feature 1..30: note = Hypo
  source 1..30: mol_type = genomic DNA

SEQ ID NO: 110810 - DNA, 217 bp, Homo sapiens; identical to SEQ ID NO: 77878
  misc_feature 1..217: note = chr15:70877477-70877694
  misc_feature 1..217: note = Hyper
  source 1..217: mol_type = genomic DNA

SEQ ID NO: 110811 - DNA, 46 bp, Homo sapiens; identical to SEQ ID NO: 77879
  misc_feature 1..46: note = chr15:71054883-71054929
  misc_feature 1..46: note = Hyper
  source 1..46: mol_type = genomic DNA

SEQ ID NO: 110812 - DNA, 43 bp, Homo sapiens; identical to SEQ ID NO: 35791
  misc_feature 1..43: note = chr15:71055227-71055270
  misc_feature 1..43: note = Hyper
  source 1..43: mol_type = genomic DNA

SEQ ID NO: 110813 - DNA, 123 bp, Homo sapiens; identical to SEQ ID NO: 77881
  misc_feature 1..123: note = chr15:71055857-71055980
  misc_feature 1..123: note = Hyper
  source 1..123: mol_type = genomic DNA

SEQ ID NO: 110814 - DNA, 18 bp, Homo sapiens
  misc_feature 1..18: note = chr15:71117912-71117930
  misc_feature 1..18: note = Hypo
  source 1..18: mol_type = genomic DNA
tttttttttttgagacgg

SEQ ID NO: 110815 - DNA, 219 bp, Homo sapiens; identical to SEQ ID NO: 77883
  misc_feature 1..219: note = chr15:71145980-71146199
  misc_feature 1..219: note = Hyper
  source 1..219: mol_type = genomic DNA

SEQ ID NO: 110816 - DNA, 328 bp, Homo sapiens; identical to SEQ ID NO: 77884
  misc_feature 1..328: note = chr15:71146426-71146754
  misc_feature 1..328: note = Hyper
  source 1..328: mol_type = genomic DNA

SEQ ID NO: 110817 - DNA, 30 bp, Homo sapiens; identical to SEQ ID NO: 77885
  misc_feature 1..30: note = chr15:71184469-71184499
  misc_feature 1..30: note = Hyper
  source 1..30: mol_type = genomic DNA

SEQ ID NO: 110818 - DNA, 30 bp, Homo sapiens; identical to SEQ ID NO: 77886
  misc_feature 1..30: note = chr15:71185265-71185295
  misc_feature 1..30: note = Hyper
  source 1..30: mol_type = genomic DNA

SEQ ID NO: 110819 - DNA, 442 bp, Homo sapiens; identical to SEQ ID NO: 77887
  misc_feature 1..442: note = chr15:71408156-71408598
  misc_feature 1..442: note = Hyper
  source 1..442: mol_type = genomic DNA

SEQ ID NO: 110820 - DNA, 30 bp, Homo sapiens; identical to SEQ ID NO: 77888
  misc_feature 1..30: note = chr15:72040931-72040961
  misc_feature 1..30: note = Hypo
  source 1..30: mol_type = genomic DNA

SEQ ID NO: 110821 - DNA, 225 bp, Homo sapiens; identical to SEQ ID NO: 77889
  misc_feature 1..225: note = chr15:72102723-72102948
  misc_feature 1..225: note = Hypo
  source 1..225: mol_type = genomic DNA

SEQ ID NO: 110822 - DNA, 17 bp, Homo sapiens
  misc_feature 1..17: note = chr15:72411795-72411812
  misc_feature 1..17: note = Hypo
  source 1..17: mol_type = genomic DNA
tggaggtcatttagccg

SEQ ID NO: 110823 - DNA, 197 bp, Homo sapiens; identical to SEQ ID NO: 44301
  misc_feature 1..197: note = chr15:72412112-72412309
  misc_feature 1..197: note = Hypo
  source 1..197: mol_type = genomic DNA

SEQ ID NO: 110824 - DNA, 30 bp, Homo sapiens; identical to SEQ ID NO: 44302
  misc_feature 1..30: note = chr15:72462639-72462669
  misc_feature 1..30: note = Hypo
  source 1..30: mol_type = genomic DNA

SEQ ID NO: 110825 - DNA, 249 bp, Homo sapiens; identical to SEQ ID NO: 77893
  misc_feature 1..249: note = chr15:72476661-72476910
  misc_feature 1..249: note = Hyper
  source 1..249: mol_type = genomic DNA

SEQ ID NO: 110826 - DNA, 147 bp, Homo sapiens; identical to SEQ ID NO: 77894
  misc_feature 1..147: note = chr15:72490031-72490178
  misc_feature 1..147: note = Hyper
  source 1..147: mol_type = genomic DNA

SEQ ID NO: 110827 - DNA, 766 bp, Homo sapiens; identical to SEQ ID NO: 77895
  misc_feature 1..766: note = chr15:72564641-72565407
  misc_feature 1..766: note = Hyper
  source 1..766: mol_type = genomic DNA

SEQ ID NO: 110828 - DNA, 399 bp, Homo sapiens; identical to SEQ ID NO: 77896
  misc_feature 1..399: note = chr15:72581446-72581845
  misc_feature 1..399: note = Hypo
  source 1..399: mol_type = genomic DNA

SEQ ID NO: 110829 - DNA, 125 bp, Homo sapiens; identical to SEQ ID NO: 77897
  misc_feature 1..125: note = chr15:72743646-72743771
  misc_feature 1..125: note = Hypo
  source 1..125: mol_type = genomic DNA

SEQ ID NO: 110830 - DNA, 29 bp, Homo sapiens
  misc_feature 1..29: note = chr15:72768983-72769012
  misc_feature 1..29: note = Hypo
  source 1..29: mol_type = genomic DNA
tcagccaccgtgcccggcctgtagaagat

SEQ ID NO: 110831 - DNA, 177 bp, Homo sapiens; identical to SEQ ID NO: 77899
  misc_feature 1..177: note = chr15:73611026-73611203
  misc_feature 1..177: note = Hyper
  source 1..177: mol_type = genomic DNA

SEQ ID NO: 110832 - DNA, 92 bp, Homo sapiens; identical to SEQ ID NO: 77900
  misc_feature 1..92: note = chr15:73615572-73615664
  misc_feature 1..92: note = Hypo
  source 1..92: mol_type = genomic DNA

SEQ ID NO: 110833 - DNA, 121 bp, Homo sapiens; identical to SEQ ID NO: 77901
  misc_feature 1..121: note = chr15:73617637-73617758
  misc_feature 1..121: note = Hypo
  source 1..121: mol_type = genomic DNA

SEQ ID NO: 110834 - DNA, 30 bp, Homo sapiens; identical to SEQ ID NO: 77902
  misc_feature 1..30: note = chr15:73639194-73639224
  misc_feature 1..30: note = Hyper
  source 1..30: mol_type = genomic DNA

SEQ ID NO: 110835 - DNA, 1325 bp, Homo sapiens
  misc_feature 1..1325: note = chr15:73659600-73660925
  misc_feature 1..1325: note = Hyper
  source 1..1325: mol_type = genomic DNA
aatgcagcccagacccgagaagaccagtgactgaacccagaggaaagttcccccagcgcggtgcaggagggggcctgggggtgtctcggagcctagaggcgccctgcctctcttggagctcccagcgcaaggcaggaaagttaactccggctgggaggcagggtcaggaggaggcatgcctgccaccgcgcagggcacccacaggatcatcgctgtggccccttacctgaagtcactgtaggggtggataatccaaaatccggccgacttgaccctctcctgttcgcgctccacggctttctggctgccgaacatccttagggagaatttgttgaccccgggttggagcatggccccgaactggcgctgcatgaagccggcctggcccaggcgcacctcggcctccgggaggatctggtcgccggcagccgcgcctccctccactttgatagcggtgtccaccgagggctgctcgcaggaggcggaggccggctgcggtggctgctggggcggcggcggcgaggctgcgggctgcgccgaggcgccggggcgctcgggctcggccgccaggcctgggggcgtcctgtcctcgccgggggacgcgtcgccctcggcgatgagccgccgctcctccgcggagtcatgcaggtgtccgtgactgctgccgctccccgtgccgccgctgccgccgccccggctgcccagcgaggccaggctcccgcggaagcgcctgcagtcgccgttcgtgctggacttgcccgcgccgcgggccggcccttcgctgtccgctgccccgagggccgagctccgggactccgtgccacccgcggccgccgagggggagggcgagggcagtggccgcagccggatgctcctgcggctggggtcttggcggcccccggccccctcctcctcggcgtcctcttcctcgtccatgatccacgccttggcccccacctgctgcgggaggctgtagagccgcttgcgcatggacggcggcagcttgtccatggcgccaggggccggggtcggaccgggccgggggcaggagcgcggcgccgcggacgggctccaggtccgcccgccggtcagtccgcccgtggggacgcgtcctttgccgccggcgtgggggcagcctcaggcgcccatgcttgggcaggctgcgcgccgcggggaggatcctagtcccgctccgagtccccgggctcgccgcgctacacctcctcccgggcccggctgggcgcggggaccccgcgctcccttcttgcctccctccctccctctggcgttcaggggcgcggcgcgccgcccggctccaggcgccc

SEQ ID NO: 110836 - DNA, 292 bp, Homo sapiens; identical to SEQ ID NO: 77906
  misc_feature 1..292: note = chr15:73661569-73661861
  misc_feature 1..292: note = Hyper
  source 1..292: mol_type = genomic DNA

SEQ ID NO: 110837 - DNA, 30 bp, Homo sapiens; identical to SEQ ID NO: 44306
  misc_feature 1..30: note = chr15:73919229-73919259
  misc_feature 1..30: note = Hypo
  source 1..30: mol_type = genomic DNA

SEQ ID NO: 110838 - DNA, 557 bp, Homo sapiens
  misc_feature 1..557: note = chr15:74044686-74045243
  misc_feature 1..557: note = Hyper
  source 1..557: mol_type = genomic DNA
ggggtcgggaatgagcgagggtccggcagatttggggctccgaggccacaggtgaccggggcgcggggaggccgaggagacgccgggcaggtcccagcgcgtgagccaaagtcggagggctgggagggcgccgggatcccctcagcccacgcccggcattccccgggctctgcaccgtccgggattcgctctgtccagtccagatcggccgggtccgtgttccgctggggtctgccctgccctaccccgcccggagtgagctggcaccgccgggcgcccgggacgcgctcagcccggacccagaacgtccgtgccccggcacccgcggcgtccggagcggccgcgagggtctgctcagcccagccccgcggtcggccctgggcgagaccgctcccacggctcagttcacgttccgaaaggtccggaatccaccgggtccccgaggaggggcgatgtcagccgcggggacccggtccccgccgggcccagccgagagcgcgcgaagccgggggccccggccgggctgggttcggcggcccgggcgcaggcgggagcag

SEQ ID NO: 110839 - DNA, 243 bp, Homo sapiens; identical to SEQ ID NO: 77910
  misc_feature 1..243: note = chr15:74045655-74045898
  misc_feature 1..243: note = Hyper
  source 1..243: mol_type = genomic DNA

SEQ ID NO: 110840 - DNA, 137 bp, Homo sapiens; identical to SEQ ID NO: 77911
  misc_feature 1..137: note = chr15:74219483-74219620
  misc_feature 1..137: note = Hyper
  source 1..137: mol_type = genomic DNA

SEQ ID NO: 110841 - DNA, 38 bp, Homo sapiens; identical to SEQ ID NO: 77912
  misc_feature 1..38: note = chr15:74264561-74264599
  misc_feature 1..38: note = Hypo
  source 1..38: mol_type = genomic DNA

SEQ ID NO: 110842 - DNA, 143 bp, Homo sapiens; identical to SEQ ID NO: 77913
  misc_feature 1..143: note = chr15:74392457-74392600
  misc_feature 1..143: note = Hyper
  source 1..143: mol_type = genomic DNA

SEQ ID NO: 110843 - DNA, 293 bp, Homo sapiens; identical to SEQ ID NO: 77914
  misc_feature 1..293: note = chr15:74420441-74420734
  misc_feature 1..293: note = Hyper
  source 1..293: mol_type = genomic DNA

SEQ ID NO: 110844 - DNA, 955 bp, Homo sapiens
  misc_feature 1..955: note = chr15:74421964-74422919
  misc_feature 1..955: note = Hyper
  source 1..955: mol_type = genomic DNA
gcgcctccgcctcctcgtcgctgaaagaaatgtcggggtttcatcagagctagggagcgacagtcgggaacagcgagtctgccgaagccggctgttgtgtgagggtgtgagacggcggggcggtgaggggccaccgcggcttgggggatagtgcgtgtggggttgaccgtgtgtctgcttgagaggctgtgaagatatggggggcagatatgggagaaatgctcgggcctgaagtccccagcccaccgtgctcaagagtagcggacgttttgccaccatccttgtctgtgctactgtctgctgcagcttccgtgccccgttctcctggagcaggcaagacctggagtgaggtgcttgggtgcgctcgagagagcttccccctgctccacctgtcccgcggtgcgcgcaggccaacgcgtcgggcagtgggcttcaagcgctggtttagccacaaaagaccagaagtaaagagttccggcttaagaggctgggcagggctgcggtgggctggggaggggggtgtcccttcccagcacgccctgcagggctgtgcgttctggtgtcgggttagactagcaggcggggcgggggggttggggcggcggggcgggggagactagggcttatatcagcccagatccaggcaaaaatggtagggagggtgcggcgctctgctaacactatcaattatgcatcatgttgaacgtggcttcggggaggaggcggctagcagcggggggtgcgggagggaagggtccgcgcgagctcggctgcgcgcagctcagcgggtcccgctcgaagtctgtcggtgccaccgcctgcatttgcaaaaagagtttaaaggcaaagacacgccttccccccccacttcagccgcgcgcctttccttcccccaaattcctcaaagatggtttgtctcacgtgttgcagggcgtaaaagcggcttgcattcaat

SEQ ID NO: 110845 - DNA, 86 bp, Homo sapiens; identical to SEQ ID NO: 77916
  misc_feature 1..86: note = chr15:74428149-74428235
  misc_feature 1..86: note = Hyper
  source 1..86: mol_type = genomic DNA

SEQ ID NO: 110846 - DNA, 386 bp, Homo sapiens; identical to SEQ ID NO: 77917
  misc_feature 1..386: note = chr15:74428737-74429123
  misc_feature 1..386: note = Hyper
  source 1..386: mol_type = genomic DNA

SEQ ID NO: 110847 - DNA, 505 bp, Homo sapiens
  misc_feature 1..505: note = chr15:74658090-74658595
  misc_feature 1..505: note = Hyper
  source 1..505: mol_type = genomic DNA
gtgagctcgggtgaacgcagcgagcgagggcagaggccagcagaggcgaggagtggatgctgcagggccgcaggccgggcagagaaacgcataccgggtcgctccctgcttcgccgccgcctcctggcagggccagcgaagccagtgctccagcgcccccgtaacacctcaaagcgcacggagtccgtgttggggaacttggcggcagagtgactgggacctaggacctgcggtggggccgccgccgcctccgcggggccgagcgcctggacctcgccctgaggtaaacgcgggtcgacccggggggcggatgggctcgggctgtgtcgaggggaggcggaggtgagcgacccgcgaagagcgcaggagcaggccgggggccacgctagggcggacccaatttcggaatagcgcggcccgggcggcggcgtgcgctgggaggaatgctgggtctgtcgctagcgccaaacttgaccacgctgcgaccttttcactctgtgctctg

SEQ ID NO: 110848 - DNA, 157 bp, Homo sapiens; identical to SEQ ID NO: 77921
  misc_feature 1..157: note = chr15:74679719-74679876
  misc_feature 1..157: note = Hypo
  source 1..157: mol_type = genomic DNA

SEQ ID NO: 110849 - DNA, 30 bp, Homo sapiens; identical to SEQ ID NO: 77922
  misc_feature 1..30: note = chr15:74686156-74686186
  misc_feature 1..30: note = Hypo
  source 1..30: mol_type = genomic DNA

SEQ ID NO: 110850 - DNA, 104 bp, Homo sapiens; identical to SEQ ID NO: 77923
  misc_feature 1..104: note = chr15:74790274-74790378
  misc_feature 1..104: note = Hypo
  source 1..104: mol_type = genomic DNA

SEQ ID NO: 110851 - DNA, 17 bp, Homo sapiens
  misc_feature 1..17: note = chr15:74818772-74818789
  misc_feature 1..17: note = Hypo
  source 1..17: mol_type = genomic DNA
taataactcctttgccg

SEQ ID NO: 110852 - DNA, 46 bp, Homo sapiens; identical to SEQ ID NO: 77925
  misc_feature 1..46: note = chr15:74903896-74903942
  misc_feature 1..46: note = Hypo
  source 1..46: mol_type = genomic DNA

SEQ ID NO: 110853 - DNA, 30 bp, Homo sapiens; identical to SEQ ID NO: 77926
  misc_feature 1..30: note = chr15:74911209-74911239
  misc_feature 1..30: note = Hypo
  source 1..30: mol_type = genomic DNA

SEQ ID NO: 110854 - DNA, 188 bp, Homo sapiens; identical to SEQ ID NO: 77927
  misc_feature 1..188: note = chr15:74911445-74911633
  misc_feature 1..188: note = Hypo
  source 1..188: mol_type = genomic DNA

SEQ ID NO: 110855 - DNA, 30 bp, Homo sapiens; identical to SEQ ID NO: 77928
  misc_feature 1..30: note = chr15:74953756-74953786
  misc_feature 1..30: note = Hypo
  source 1..30: mol_type = genomic DNA

SEQ ID NO: 110856 - DNA, 35 bp, Homo sapiens; identical to SEQ ID NO: 77929
  misc_feature 1..35: note = chr15:75018960-75018995
  misc_feature 1..35: note = Hyper
  source 1..35: mol_type = genomic DNA

SEQ ID NO: 110857 - DNA, 214 bp, Homo sapiens; identical to SEQ ID NO: 77930
  misc_feature 1..214: note = chr15:75118706-75118920
  misc_feature 1..214: note = Hyper
  source 1..214: mol_type = genomic DNA

SEQ ID NO: 110858 - DNA, 171 bp, Homo sapiens; identical to SEQ ID NO: 77931
  misc_feature 1..171: note = chr15:75119374-75119545
  misc_feature 1..171: note = Hyper
  source 1..171: mol_type = genomic DNA

SEQ ID NO: 110859 - DNA, 30 bp, Homo sapiens; identical to SEQ ID NO: 77932
  misc_feature 1..30: note = chr15:75134683-75134713
  misc_feature 1..30: note = Hypo
  source 1..30: mol_type = genomic DNA

SEQ ID NO: 110860 - DNA, 101 bp, Homo sapiens; identical to SEQ ID NO: 44311
  misc_feature 1..101: note = chr15:75143124-75143225
  misc_feature 1..101: note = Hypo
  source 1..101: mol_type = genomic DNA

SEQ ID NO: 110861 - DNA, 87 bp, Homo sapiens; identical to SEQ ID NO: 77934
  misc_feature 1..87: note = chr15:75205464-75205551
  misc_feature 1..87: note = Hypo
  source 1..87: mol_type = genomic DNA

SEQ ID NO: 110862 - DNA, 238 bp, Homo sapiens
  misc_feature 1..238: note = chr15:75248605-75248843
  misc_feature 1..238: note = Hyper
  source 1..238: mol_type = genomic DNA
gccacacctcgcgtacgctccggtagcgcagccgcgtgacctggtgcaggcccgccaggcggcgcttgaggatctcggcgcacgtgacggttttggtggtggcccggccgcagccgctgaagacgatggcgcgcgtggctggctgcgccatgctggcggtggcgaaggccatcaggttccggatcttgctgccttccttgacccgcatgtgcaccgcgcccggcgccaggtctgcgaa

SEQ ID NO: 110863 - DNA, 30 bp, Homo sapiens; identical to SEQ ID NO: 35815
  misc_feature 1..30: note = chr15:75250808-75250838
  misc_feature 1..30: note = Hyper
  source 1..30: mol_type = genomic DNA

SEQ ID NO: 110864 - DNA, 766 bp, Homo sapiens
  misc_feature 1..766: note = chr15:75251045-75251811
  misc_feature 1..766: note = Hyper
  source 1..766: mol_type = genomic DNA
tcctgggagtggctgcggcgactggaccttggcaccgcaatgtgtgaatggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtggaaggagcgagctctccgtccccgggagtatgcaagtttgggctgcacgatcacttggaagggattgggcggagttctgtcatttggagaaagggtcctgggagcttcaggtttgtgtagggcgaggacggggcggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatgtacatcgtgattagccgcggggtcgctaattacagctgaagccattcattacactgtcagcgcgcgtcgcagcccgccggctgtgcgctccctcctagccgtgaaggggtgtagggggtgggggcgggagatgcgggga

SEQ ID NO: 110865 - DNA, 30 bp, Homo sapiens; identical to SEQ ID NO: 77939
  misc_feature 1..30: note = chr15:75288351-75288381
  misc_feature 1..30: note = Hyper
  source 1..30: mol_type = genomic DNA

SEQ ID NO: 110866 - DNA, 336 bp, Homo sapiens
  misc_feature 1..336: note = chr15:75470896-75471232
  misc_feature 1..336: note = Hyper
  source 1..336: mol_type = genomic DNA
ctgtggggggtggggcggggccggtggccgcgactccaccccgcgcccctagtcgagtaaacaagccacgggcggcgcctgggggccgctcctgcaagccggggcgctgggttacatcacggttccctggagactcccgccccagcggccgggtccctgaggcccgcgcccgcccgccgcctgtgtccgagaagcagagagctggcaagggcccgccagggcgggaaggctcccacgttttctccggaggcccctgggactttgttgcaattgggttcagcccgggcatgggctgaacgtggacgcgcgggaaccgcgcctcggtttccccatctg

SEQ ID NO: 110867 - DNA, 30 bp, Homo sapiens; identical to SEQ ID NO: 77942
  misc_feature 1..30: note = chr15:75516785-75516815
  misc_feature 1..30: note = Hypo
  source 1..30: mol_type = genomic DNA

SEQ ID NO: 110868 - DNA, 50 bp, Homo sapiens; identical to SEQ ID NO: 77943
  misc_feature 1..50: note = chr15:75990686-75990736
  misc_feature 1..50: note = Hypo
  source 1..50: mol_type = genomic DNA

SEQ ID NO: 110869 - DNA, 122 bp, Homo sapiens; identical to SEQ ID NO: 77944
  misc_feature 1..122: note = chr15:76005149-76005271
  misc_feature 1..122: note = Hyper
  source 1..122: mol_type = genomic DNA

SEQ ID NO: 110870 - DNA, 38 bp, Homo sapiens; identical to SEQ ID NO: 77945
  misc_feature 1..38: note = chr15:76012901-76012939
  misc_feature 1..38: note = Hypo
  source 1..38: mol_type = genomic DNA

SEQ ID NO: 110871 - DNA, 56 bp, Homo sapiens; identical to SEQ ID NO: 77946
  misc_feature 1..56: note = chr15:76195506-76195562
  misc_feature 1..56: note = Hypo
  source 1..56: mol_type = genomic DNA

SEQ ID NO: 110872 - DNA, 86 bp, Homo sapiens; identical to SEQ ID NO: 77947
  misc_feature 1..86: note = chr15:76197435-76197521
  misc_feature 1..86: note = Hypo
  source 1..86: mol_type = genomic DNA

SEQ ID NO: 110873 - DNA, 100 bp, Homo sapiens; identical to SEQ ID NO: 77948
  misc_feature 1..100: note = chr15:76351669-76351769
  misc_feature 1..100: note = Hyper
  source 1..100: mol_type = genomic DNA

SEQ ID NO: 110874 - DNA, 30 bp, Homo sapiens; identical to SEQ ID NO: 77949
  misc_feature 1..30: note = chr15:76372926-76372956
  misc_feature 1..30: note = Hypo
  source 1..30: mol_type = genomic DNA

SEQ ID NO: 110875 - DNA, 30 bp, Homo sapiens; identical to SEQ ID NO: 15913
  misc_feature 1..30: note = chr15:76510088-76510118
  misc_feature 1..30: note = Hypo
  source 1..30: mol_type = genomic DNA

SEQ ID NO: 110876 - DNA, 524 bp, Homo sapiens
  misc_feature 1..524: note = chr15:76627514-76628038
  misc_feature 1..524: note = Hyper
  source 1..524: mol_type = genomic DNA
aggtggaggcggagctcaaaagccggacgctactggacgaggcttaaagcgctcgccccagcgcggggccggtgaggaacgttcaccgtggaccatggtcgaataatgttagcgtgcactcggggcctcgccctagccttctgcaaagcctcggcctgcgccctcggctgcatccgtttcgacgccaaccaacctcatgctcttagtagaacggcagtagcgaccgcgccctcaggcccacaagcccgaaggtctgggcagggtctggaatggcggtggagacactttatccgcaggcgtttcacctcgcgccccacccaggcgcacaccaagttcttggtactccttttaatgggaaaacaagaacagacaccatggttggataaatgttatttataattcatgggccggtctttgaaccctttcaaacaaaacccacagcgatttctttgaaagaatgcctggactgtgctcagagctctcagattttctcaggaccaacgagccgccgcctcgcagatacc

SEQ ID NO: 110877 - DNA, 893 bp, Homo sapiens
  misc_feature 1..893: note = chr15:76628327-76629220
  misc_feature 1..893: note = Hyper
  source 1..893: mol_type = genomic DNA
gaggggcagcagcagcggcagcagcagcaaggatggagtcaggacccgtcccagtcccgggtgagcgcttttggatctgggttctggctcaacccacgtaatgccccaatctaaagttttctacgtgtgtgtggataggaaagtctaaatagagtttatcagaacccaggtggtcattctctacactctctctagcttggacccgaagaacaaaggcacatgagaggagaaaggtgaccagctggacgatgacggtcacgtccaaacggatcccccttgtcctcggctctctcgtcctgagagtgggtttaatttttttttttttaatttatataagaagggagctcttaaaggagagccatctccaccctcaggtatccatcacccagctccagcgcgcctgggaaaaccgccccgaaagtccaagaggaagctcagagttgtaacggccgcggagccagctcggcggtgacgcaaggtccagtccagattgccaggcccggggcatgagagaggatccttgtaggtttcggaggtgggggggctgcactccattgttcactccgggccaatcagggttggcccacttcctcccagccaatctcccttcacccccagcctccaacccaacccaccccgcccatcagcccctggatccccatcacctcccccgcatccccggcagttctggggaagcttcgtgacgccacaggtcccgcccccagctccggcccggggctagtgcgtgttgacgtcatgctgcgtgcgggccggtgcggaatcgctccttcaactccgcggggcagtaggagttagttagcaaagagccgaggccgggcgcgcgaccctcgtccttctgcccctggccgcacactttgcgcacatctcttttt

SEQ ID NO: 110878 - DNA, 1344 bp, Homo sapiens
  misc_feature 1..1344: note = chr15:76629665-76631009
  misc_feature 1..1344: note = Hyper
  source 1..1344: mol_type = genomic DNA
gtctgagaggatgagcggggactgccgaaagacgatgtgtctgtgttgggataggaggcagccgctgtgagtgggagtgtgtgagcggaaatgccaggacagcaccgttaggtgttgatatccaggcgtccgcagtgcctgtgtatttactctcttcttagtttcgtgtttgcgtttagtttcaagacacgtcgacaaaacgactgtcattaatgaatgtaataacgaaatatttggggtgggggacagaagaaaccttcagcaatccacaagatactggtttttcgtttccaatgccctggacctttagagagctcatcatctttccttatggtcgcaagtcttgaaagaaagagcaagagagcgagcgggttgggttggggctggagtagccgaggccggcctgggtccgggcagtcaggcctgacgcggccccgcgcccttccccggcagagaagcccgggacggccatgtgcgtgggctgcgggagtcagatccacgaccagtttatcctgcgggtgtcgcccgacctcgagtggcacgcggcctgcctcaagtgtgccgagtgcagccagtacctggacgagacgtgcacgtgcttcgtgagagacgggaagacctactgcaagcgggactatgtcaggtgaggccggcgggaacgcgggctgggccaccgcgcgcaggggccggggccgggactggggatggcggcctgcccgcgcgccccggccctgcccagggagaaggccatccgcatcccgcacgggtgccgcagcgctcccccgggcccgggaatgcccgcaggcgggtcaccgcagtctcctggtggccacaaagtgtcctgggcgcgcgccggagccgtagcagccagggagatgagggcggccgcaggcccagcgctgacaccgccgcaccttgggcccgcaggctgttcggcatcaagtgcgccaagtgccaggtgggcttcagcagcagcgacctggtgatgagggcgcgggacagcgtgtaccacatcgagtgcttccgctgctccgtgtgcagccgccagctgctgcctggggacgagttctcgctgcgggagcacgagctgctctgccgcgccgaccacggcctcctgctcgagcgcgccgcggccggcagcccgcgcagccccggcccgcttcccggcgcccgcggcctgcatctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctg

SEQ ID NO: 110879 - DNA, 672 bp, Homo sapiens
  misc_feature 1..672: note = chr15:76632131-76632803
  misc_feature 1..672: note = Hyper
  source 1..672: mol_type = genomic DNA
gccctcgtaggcccccggcatattcgcacctcccacccagtcccctgggcagcgcctcgccctgggtccacgtcggtccctttccctctccagagtcctgggcaagcctctttcctcttcctctgaaactccgacttcttccggagggcttcgctcgttccgagggtcctgcgactggaggaggcacatccctgagcagccactccctccccgcagcggcctgtcgccgagctcccgcgccctgcttgagctcgggagagatcgctgcggggcagtccggcccgggagcgagagaaagaacgaaaatgcacagctctctccgagtaaggcgaacagatggagaggaagacgaacaattaaacgaaacaaacagaataaaacagaaacgaaatcgggccccggggggctgggccacccggaggttgggctcggggcgggtgggtggcggcccctcgctaacctctggcctcaccctgtcctggcagacgctgggtcgggccggcagcccgcgttgcgcccgcacgtgcacaagcagacggagaagacgacccgcgtgcggactgtgctgaacgagaagcagctgcacactctgcggacctgctacgccgccaacccgcggcccgacgctctcatgaaggagcagctggtggagatgaccggcctgagcccgcg

SEQ ID NO: 110880 - DNA, 30 bp, Homo sapiens; identical to SEQ ID NO: 77960
  misc_feature 1..30: note = chr15:76633746-76633776
  misc_feature 1..30: note = Hyper
  source 1..30: mol_type = genomic DNA

SEQ ID NO: 110881 - DNA, 48 bp, Homo sapiens; identical to SEQ ID NO: 77961
  misc_feature 1..48: note = chr15:76634240-76634288
  misc_feature 1..48: note = Hyper
  source 1..48: mol_type = genomic DNA

SEQ ID NO: 110882 - DNA, 785 bp, Homo sapiens
  misc_feature 1..785: note = chr15:76634951-76635736
  misc_feature 1..785: note = Hyper
  source 1..785: mol_type = genomic DNA
gggggtggggctgggcgcatgcgcgctgagggccctcccagaagcaggagcgccccattggcgacccctgggcacctggcggcccaggcccgcgggcaggaggcgggacccgtttgggcgggaaacctgcggcacttgtggcggttgagcggcggactccggcctagggttatgcgggcgagggcgcgccccgctcccggaaccagccttggcctggcgcctgccgagccccgagccccactctcgctcggcgccgcgggccctcccggcgcttccttccccagcggtccgcggccctgggtgaggctcgaagccccgcgcgctgcccctggccctgcagcacagcagtgaggccaaccccggccagagcgggcggccgtgacgggccgtgccccgcgctgtccccggagtggatgcgcgacgtgatcaatccgcggcatttattaattccacagtctagacagaggcgggggccgggcggcggctgcttatctgcgtttggcatcacctgcaagcgatacaccgaggggccgcaacgagcccccgctaggagcgcggctgccgggaaaataagtccacccagaaccagtctggcgtgtccttggtttattttctttccagaccgaagtggagggggtcgggggtggcccgggtgggagggagctgggaatggcccctggatatgccgtgcccaggtcacttggtgtgacatttcaaacccctgcgacttgttttcttgaaaactggctttagtgatcgcaggaaataaccgagagatactgaat

SEQ ID NO: 110883 - DNA, 809 bp, Homo sapiens
  misc_feature 1..809: note = chr15:76638317-76639126
  misc_feature 1..809: note = Hyper
  source 1..809: mol_type = genomic DNA
ggtcagctgttagggcgtgggggagggagggggcagggagcagggacgaggaagtggaagaataggggattgtgaggagtgatttctttccagattatcgagactcaagactttccagaacgtggcaaagagccctggaagaaatgtcccaggaacgccgcggtcaggaccgaggctccccggggccaggttcagggttcgaggtcccagcctcgcaactgctggcgtctggagggcgggagagtggccgggcccgaagctgcggctccgacgtacagttgcgagtctggggcggtgggccccgcagagctccgggggaagggagccgccgccgctgcggggaattggcttgggcaacgccgctgagtgttcaaacgtcgctgctcccgggccttgggcagcctctcctacctgacccaaattctgggctgcaaagcccgggcgaagttgtcgctttcactccgaatacgcccagtcgcaccgtcaacttcataggctgggcccggcagaggcctttcgcctccgcccagcggtctccgctgcggcccctcagcctctggagagccggggggcggccctcgccccggcagaaagcaacctgtggcggcactgcgtccccgcgagctacaaccagacgcggccgcgctcacctgggcgttgcgctcccccgagccccggagagtttagaagccgtaaaagcccggggagctggagcttaaatcgcccggaccgggccggggcgcccgaaagcagtgaactcgagacccccaggaaccgcgtgcgccgggaggcaccgggacgctcccggg

SEQ ID NO: 110884 - DNA, 115 bp, Homo sapiens
  misc_feature 1..115: note = chr15:76639564-76639679
  misc_feature 1..115: note = Hyper
  source 1..115: mol_type = genomic DNA
ctcagcccggccctgcggctccgggagttgctgagcactcgcggccagcggctggagtcctgggtcccgctctctggtgcccggcggcggagtcgccacgcgaggctggaggggt

SEQ ID NO: 110885 - DNA, 30 bp, Homo sapiens; identical to SEQ ID NO: 77966
  misc_feature 1..30: note = chr15:77198053-77198083
  misc_feature 1..30: note = Hyper
  source 1..30: mol_type = genomic DNA

SEQ ID NO: 110886 - DNA, 26 bp, Homo sapiens
  misc_feature 1..26: note = chr15:77448975-77449001
  misc_feature 1..26: note = Hypo
  source 1..26: mol_type = genomic DNA
atcttggctcccgaaataaaataatt

SEQ ID NO: 110887 - DNA, 78 bp, Homo sapiens; identical to SEQ ID NO: 77968
  misc_feature 1..78: note = chr15:77852833-77852911
  misc_feature 1..78: note = Hypo
  source 1..78: mol_type = genomic DNA

SEQ ID NO: 110888 - DNA, 247 bp, Homo sapiens; identical to SEQ ID NO: 77969
  misc_feature 1..247: note = chr15:77906751-77906998
  misc_feature 1..247: note = Hypo
  source 1..247: mol_type = genomic DNA

SEQ ID NO: 110889 - DNA, 39 bp, Homo sapiens; identical to SEQ ID NO: 77970
  misc_feature 1..39: note = chr15:77908085-77908124
  misc_feature 1..39: note = Hypo
  source 1..39: mol_type = genomic DNA

SEQ ID NO: 110890 - DNA, 444 bp, Homo sapiens; identical to SEQ ID NO: 77971
  misc_feature 1..444: note = chr15:77924553-77924997
  misc_feature 1..444: note = Hyper
  source 1..444: mol_type = genomic DNA

SEQ ID NO: 110891 - DNA, 260 bp, Homo sapiens; identical to SEQ ID NO: 77972
  misc_feature 1..260: note = chr15:77925465-77925725
  misc_feature 1..260: note = Hyper
  source 1..260: mol_type = genomic DNA

SEQ ID NO: 110892 - DNA, 258 bp, Homo sapiens; identical to SEQ ID NO: 77973
  misc_feature 1..258: note = chr15:77927171-77927429
  misc_feature 1..258: note = Hyper
  source 1..258: mol_type = genomic DNA

SEQ ID NO: 110893 - DNA, 950 bp, Homo sapiens
  misc_feature 1..950: note = chr15:78111427-78112377
  misc_feature 1..950: note = Hyper
  source 1..950: mol_type = genomic DNA
agccccaagcgtgcacgccccccacggacgcgcacccagcaccccacccccgccgctgcccccgaggctcccgcccaatcagaggccgcgcgcgccgcgccgccggcgggcagacacaccggctccccggcctgcgcccctgcggccctggccccgctgcagcgtcccggcccggccacactcaccgtcccgggcgcgccgtccgcgcgcggctccgctccgggccggcatcccccggctcggctgcctccggtccccgctccggcctcggttcccgctccgcagggctcggctccgcgatggtggccgcggcggcgagcgcggcagggagggcgtgtgtatgcgcgtgagagcgcgcagcgtgtgcatgtgcgtgtgcgcgggagggtcccggctcccctgcgcgtcccgctcctgcctcctgctcgccacgatgcgatgccggcagaatctctaccgcgcgcccccactgcccggcgcccacactcgcgcacacacgcgcacacccaggcgcgcacacccggctccgcactcccgactcgccctcctggagcgctcacaaagaccccctgccgggacggccggagcctgcggagcgcggccctgggcccctccgggacccgccggccttaggtgccccgctgctccccgtagggaccccgcgggcggcccggctcccgcaccctgcctggccgggccgcggccgcgctcccagcccgaacctgggcccaggtgccgactcgggcttctcgcactcccgcgggaagcgccggccccctccgcggcgccgccgcccttctcccccccttccagtccggcctctccggcgcctccctgccttgtcccacctgcccagcccggtcctcgttctccccgctgctctccgtctgtctcgccgccgccctctcccgcgccccttcctccccaccgccctgcgctgcctctcacat

SEQ ID NO: 110894 - DNA, 408 bp, Homo sapiens; identical to SEQ ID NO: 77976
  misc_feature 1..408: note = chr15:78236748-78237156
  misc_feature 1..408: note = Hyper
  source 1..408: mol_type = genomic DNA

SEQ ID NO: 110895 - DNA, 30 bp, Homo sapiens; identical to SEQ ID NO: 44317
  misc_feature 1..30: note = chr15:78252931-78252961
  misc_feature 1..30: note = Hypo
  source 1..30: mol_type = genomic DNA

SEQ ID NO: 110896 - DNA, 48 bp, Homo sapiens; identical to SEQ ID NO: 77978
  misc_feature 1..48: note = chr15:78277490-78277538
  misc_feature 1..48: note = Hypo
  source 1..48: mol_type = genomic DNA

SEQ ID NO: 110897 - DNA, 79 bp, Homo sapiens; identical to SEQ ID NO: 77979
  misc_feature 1..79: note = chr15:78327585-78327664
  misc_feature 1..79: note = Hyper
  source 1..79: mol_type = genomic DNA

SEQ ID NO: 110898 - DNA, 30 bp, Homo sapiens; identical to SEQ ID NO: 77980
  misc_feature 1..30: note = chr15:78486343-78486373
  misc_feature 1..30: note = Hypo
  source 1..30: mol_type = genomic DNA

SEQ ID NO: 110899 - DNA, 166 bp, Homo sapiens; identical to SEQ ID NO: 77981
  misc_feature 1..166: note = chr15:78501776-78501942
  misc_feature 1..166: note = Hypo
  source 1..166: mol_type = genomic DNA

SEQ ID NO: 110900 - DNA, 30 bp, Homo sapiens; identical to SEQ ID NO: 44320
  misc_feature 1..30: note = chr15:78503615-78503645
  misc_feature 1..30: note = Hypo
  source 1..30: mol_type = genomic DNA

SEQ ID NO: 110901 - DNA, 56 bp, Homo sapiens; identical to SEQ ID NO: 77983
  misc_feature 1..56: note = chr15:78506312-78506368
  misc_feature 1..56: note = Hypo
  source 1..56: mol_type = genomic DNA

SEQ ID NO: 110902 - DNA, 43 bp, Homo sapiens; identical to SEQ ID NO: 77984
  misc_feature 1..43: note = chr15:78556892-78556935
  misc_feature 1..43: note = Hyper
  source 1..43: mol_type = genomic DNA

SEQ ID NO: 110903 - DNA, 168 bp, Homo sapiens; identical to SEQ ID NO: 77985
  misc_feature 1..168: note = chr15:78557205-78557373
  misc_feature 1..168: note = Hyper
  source 1..168: mol_type = genomic DNA

SEQ ID NO: 110904 - DNA, 23 bp, Homo sapiens
  misc_feature 1..23: note = chr15:78571000-78571023
  misc_feature 1..23: note = Hypo
  source 1..23: mol_type = genomic DNA
cttttttttttgagacggagtct

SEQ ID NO: 110905 - DNA, 214 bp, Homo sapiens; identical to SEQ ID NO: 77987
  misc_feature 1..214: note = chr15:78596058-78596272
  misc_feature 1..214: note = Hypo
  source 1..214: mol_type = genomic DNA

SEQ ID NO: 110906 - DNA, 167 bp, Homo sapiens; identical to SEQ ID NO: 77988
  misc_feature 1..167: note = chr15:78609740-78609907
  misc_feature 1..167: note = Hypo
  source 1..167: mol_type = genomic DNA

SEQ ID NO: 110907 - DNA, 30 bp, Homo sapiens; identical to SEQ ID NO: 77989
  misc_feature 1..30: note = chr15:78617409-78617439
  misc_feature 1..30: note = Hypo
  source 1..30: mol_type = genomic DNA

SEQ ID NO: 110908 - DNA, 888 bp, Homo sapiens
  misc_feature 1..888: note = chr15:78632506-78633394
  misc_feature 1..888: note = Hyper
  source 1..888: mol_type = genomic DNA
tccccagttggagagcgggtgcccgcacctctggaggctgaggcacaactgggctgggagttgagcgcataccgagtaggggctgcgggggagcgggggcagggccggcggggcggggccagaagcccggcggggttgggggcgctctcctagtgactcaaggcgcgcagcgctgggcgcaaagcgccagtctccgccttgcgagctcagagtgtgcccgctgcgccgccgctgtccgtacctgccgccgccgccaccgccaccatgcccaacttcgccggcacctggaagatgcgcagcagcgagaatttcgacgagctgctcaaggcactgggtaagctggtgcagagggcgcgccccgacggggagatgcggcccggaggtgccctggtcccggaagtgccccggtcctggagggggtggaagttggggagcccaggcaggagggagtccccggggcaatagatcgccttgtctcccaggcgcaccgggtctcggagaagctggtagagatcccggaacccacgcgttcagcgaacgtttgctgaatgtttggcgccctcctcgatggtgcggactttatctcgtgctagatcatagcgaggagagattactggagagcaaggaggatcagggacttaaatttggagactcaaatttgggaccaggctctgccacgaattcactgtgcaactcgaggaaagtcacttaccctctctgtgcctcagtctctcatctcgaaaacaagggcgagggcagggaaacgagtggatcaattttaaggcccctttctaaagttagggtatgaccagtgcccgaccggtcccgagactggcggcgaggccccgtgacccaagcctgtggtgcaccctgcgcaggtgtgaacgc

SEQ ID NO: 110909 - DNA, 1461 bp, Homo sapiens
  misc_feature 1..1461: note = chr15:78912231-78913692
  misc_feature 1..1461: note = Hyper
  source 1..1461: mol_type = genomic DNA
tcccaggcaggaggtcggttgagagcgtatggcgttctgagtagtgcaggcctcggcaccgagggcggaaagcgctctgagctcacagccgcacgacagaccgccggcctgggccctccaggaattccctgcagccttgcccggtccccgactctcgctacccaccagccctcccaggcacccaagagcctcccagcggcgggccagggccggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagt

SEQ ID NO: 110910 - DNA, 312 bp, Homo sapiens; identical to SEQ ID NO: 77996
  misc_feature 1..312: note = chr15:78933373-78933685
  misc_feature 1..312: note = Hyper
  source 1..312: mol_type = genomic DNA

SEQ ID NO: 110911 - DNA, 68 bp, Homo sapiens; identical to SEQ ID NO: 44323
  misc_feature 1..68: note = chr15:79055979-79056047
  misc_feature 1..68: note = Hypo
  source 1..68: mol_type = genomic DNA

SEQ ID NO: 110912 - DNA, 71 bp, Homo sapiens; identical to SEQ ID NO: 77998
  misc_feature 1..71: note = chr15:79057076-79057147
  misc_feature 1..71: note = Hypo
  source 1..71: mol_type = genomic DNA

SEQ ID NO: 110913 - DNA, 92 bp, Homo sapiens; identical to SEQ ID NO: 77999
  misc_feature 1..92: note = chr15:79059735-79059827
  misc_feature 1..92: note = Hypo
  source 1..92: mol_type = genomic DNA

SEQ ID NO: 110914 - DNA, 102 bp, Homo sapiens; identical to SEQ ID NO: 78000
  misc_feature 1..102: note = chr15:79064055-79064157
  misc_feature 1..102: note = Hypo
  source 1..102: mol_type = genomic DNA

SEQ ID NO: 110915 - DNA, 41 bp, Homo sapiens; identical to SEQ ID NO: 78001
  misc_feature 1..41: note = chr15:79103265-79103306
  misc_feature 1..41: note = Hyper
  source 1..41: mol_type = genomic DNA

SEQ ID NO: 110916 - DNA, 30 bp, Homo sapiens; identical to SEQ ID NO: 78002
  misc_feature 1..30: note = chr15:79104054-79104084
  misc_feature 1..30: note = Hyper
  source 1..30: mol_type = genomic DNA

SEQ ID NO: 110917 - DNA, 27 bp, Homo sapiens
  misc_feature 1..27: note = chr15:79163864-79163891
  misc_feature 1..27: note = Hypo
  source 1..27: mol_type = genomic DNA
agagggaaactccgtctcagaaagaaa

SEQ ID NO: 110918 - DNA, 1479 bp, Homo sapiens
  misc_feature 1..1479: note = chr15:79381789-79383268
  misc_feature 1..1479: note = Hyper
  source 1..1479: mol_type = genomic DNA
ctcaggaaaccagagcgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgccagctgggagcccaccaccgctcgatggtaccgaaccgacccgtgtagccccataaccccagcccaactccgaggagctagcgcagaccgctctccgccctcagctgcggcgaggcaagggctggcagcgctcggacgcctccgtcttgcccttcccatgcctaagcgcggggaattacacgttcccggtgtagaacagacgatcggggctattagggctgggcggtgggagtgggggttgggagcaccatttttggctggacgtgtgtccagactcatcgtctctggtccttaggaccccatcttcctctgcatctccaggtgtcggcccctctgtacccgcctcccacggggctcgtccggcgaagggcagccgcagcccacatctactccccgccctcaatccctgccccctctgcccgccgcagtcactcgcctggctgggagcaagcctcccctctcgctgagggtgcagagagcgcctagggcgccaagagtagaggggccaaagttcaagcgccatcagccagccgaaggccctgagcccccagggccgcggccgggacgcagggaggtcaggacgcgacgctcgcctcacctgtttctccagcggctccttggccgacagcgccggcttgggggagggcgcgcggtcgcagacgcagccctccagcaggtaaagccccgagggccgcgagctcgagtcgctctcgaagtagaagagcaggttctgcagcagcgcgaaccacttggtttgccattttgtgttgtccgaactccgcttgctcaggtagcctttgcgcgtgccgtccttgcgcgccagcagtcccagggacgcgacgtggccatcattcagccggatccccttctgcatggtgctcagaggccagcgagaccccacgcgcttacatcttctccgcgcagcagccccccgtccgtgcgcgctgcgcgctgcctctctctggcgctcgctcgctcgctccctctagctctcccctccccccaaatatctacactccaggatctggcgccgagccgcggcttcttgaatccagatataccattccccgctggaacctcttctccgctccgcagagccccagtacccggaagatgccgcccgaccctcctccggtgccgggcaaactgagggactggcgatctgcgcgctggcgaggggcaggcggagtcatgtgacgccgatccctcgaagagcccgtttcagcagcgcggacagggacacacgcacgcagccccgccgaggcgcagagccgcgcgcaggctgcaacttggtgcctcctc

SEQ ID NO: 110919 - DNA, 818 bp, Homo sapiens
  misc_feature 1..818: note = chr15:79383328-79384146
  misc_feature 1..818: note = Hyper
  source 1..818: mol_type = genomic DNA
tcccctcatctccccttctctccctcggatgttaaaaagcaaatcagatcaattttcgtttaacccaatgaaaccccgaaggctcgccatcccgggagtttgcgtctttgcgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattcgcctacacagttacacggcatttatccgagaacgtcacagcgcccgcatgctgcaccgggagggcgcgcgggccgccgggcgagccgggagctggggcggggagcgcgcatcgctgtctgccgcagagggcagcgagctcgccccgacccggagcaagccgcgcctggcccgggcgctttgcagcggggatgggtgccc

SEQ ID NO: 110920 - DNA, 243 bp, Homo sapiens; identical to SEQ ID NO: 78008
  misc_feature 1..243: note = chr15:79502049-79502292
  misc_feature 1..243: note = Hyper
  source 1..243: mol_type = genomic DNA

SEQ ID NO: 110921 - DNA, 720 bp, Homo sapiens; identical to SEQ ID NO: 35852
  misc_feature 1..720: note = chr15:79574779-79575499
  misc_feature 1..720: note = Hyper
  source 1..720: mol_type = genomic DNA

SEQ ID NO: 110922 - DNA, 481 bp, Homo sapiens; identical to SEQ ID NO: 78010
  misc_feature 1..481: note = chr15:79575852-79576333
  misc_feature 1..481: note = Hyper
  source 1..481: mol_type = genomic DNA

SEQ ID NO: 110923 - DNA, 30 bp, Homo sapiens; identical to SEQ ID NO: 78011
  misc_feature 1..30: note = chr15:79672460-79672490
  misc_feature 1..30: note = Hypo
  source 1..30: mol_type = genomic DNA

SEQ ID NO: 110924 - DNA, 1446 bp, Homo sapiens
  misc_feature 1..1446: note = chr15:79724051-79725497
  misc_feature 1..1446: note = Hyper
  source 1..1446: mol_type = genomic DNA
cttgccactgggggccgcagtcaccttcagcataggggagtggggagacgcgaaccccgcgggtggctccgggtggtgggctccctccagcgcgcagcttccgctcgctttcccctcggcgctgcagccgcgacctgggaccgaacggacaccgccttcccggggctccggcggcgctctgactcccactttcctccgccgcagcctctggcagggcacccccttggcgcgacgccgcgcccctccccgggaccgccccctcggtcccccagggtgcgctcagttgctgcccgtgcgccccgccagcttgagcgccccgggcgggcggcggtggagaagcccagcccagctctccccagccgcgttcccggcccgcgctgctcccagcctgcaagcccatgacgtggcgacgccgaccgagacacaaagaccgaggctgagaccgccaggggttgagggtgaggccgcgtcccggggccgctggagcgcgggcgtcatgcgagactgtcccggctgcgcgccgccccagaggagtccgagcgcccccttcagccgcggcgcgctggccctggccgggactgcagccaggtgggcgccgcgcgtgtgagcgccgcgcgtgtgagcgcagacctggactcgggcggcggaggcgaaagtcgctccatccgcggggtgcaaccctgggcgcggaatccgggctgccgggtgacagtgaccagctgactctggagcctaccggaggcgcggcatcggaggccgtgcggaccactgccgaacagccgctggagacccgcagagaagggcgggccctgcgcccggggcgcctcggaggtaagttcggagagcccgggccgggcggagggcgggagcgcacgagtgtgtgtgtgtgtgtgtgtgttcgcggtgtgcccgcggctcggtgcacacgcgcgcgggttgtaaagtcaggagctgcgggagcgcctccctgcctcggcttggccccggagcattgcgggccgcggaggtgtgggggcccttgtcgctgcgctcagggcagcggcggaaaaggtgtgtgcggatgcggggcggggccgcacctggtggacagagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttcacctgtcagaaagcacgggagctgggcctggcccgcggggagcgtaagctcgctcacacgcggtccaactcaggc

SEQ ID NO: 110925 - DNA, 24 bp, Homo sapiens
  misc_feature 1..24: note = chr15:80217740-80217764
  misc_feature 1..24: note = Hypo
  source 1..24: mol_type = genomic DNA
gagccaccgcgcctggccagtgat

SEQ ID NO: 110926 - DNA, 30 bp, Homo sapiens; identical to SEQ ID NO: 78017
  misc_feature 1..30: note = chr15:80279955-80279985
  misc_feature 1..30: note = Hypo
  source 1..30: mol_type = genomic DNA

SEQ ID NO: 110927 - DNA, 30 bp, Homo sapiens; identical to SEQ ID NO: 78018
  misc_feature 1..30: note = chr15:80473548-80473578
  misc_feature 1..30: note = Hypo
  source 1..30: mol_type = genomic DNA

SEQ ID NO: 110928 - DNA, 30 bp, Homo sapiens; identical to SEQ ID NO: 78019
  misc_feature 1..30: note = chr15:80513587-80513617
  misc_feature 1..30: note = Hypo
  source 1..30: mol_type = genomic DNA

SEQ ID NO: 110929 - DNA, 30 bp, Homo sapiens; identical to SEQ ID NO: 35858
  misc_feature 1..30: note = chr15:80543967-80543997
  misc_feature 1..30: note = Hyper
  source 1..30: mol_type = genomic DNA

SEQ ID NO: 110930 - DNA, 463 bp, Homo sapiens
  misc_feature 1..463: note = chr15:80544203-80544666
  misc_feature 1..463: note = Hyper
  source 1..463: mol_type = genomic DNA
cggcagggctcggcccgacttcagcgagcagatcctccgcctgcggccggtgacccgcgcgacgccccggcggcaccgacaatgctgtgctccagccccgcaggcgccgcggcagcgggtcccgggatgctcccgcggtccttacctggcgaggcccgtcccgtgcgctcccggggtcctggctgggccggcgccgagcccagggcgaccgcggatcgccggctacggcgtttcccggtgacgggggcgcgggctcgcggggcgcggggggcgctgcccaggcccggctcggcaggagtcagagcccccagcggcgcgggcgagcccgggccagcagccgagagggggctctgagcggagccgcggccgtcctggcattttaaaggcgaggcagctggacgctgttcaagcggaaacgcagagagaaacttcagcccccggggcagagcgttggcagcgaggg

SEQ ID NO: 110931 - DNA, 149 bp, Homo sapiens; identical to SEQ ID NO: 78023
  misc_feature 1..149: note = chr15:80624470-80624619
  misc_feature 1..149: note = Hypo
  source 1..149: mol_type = genomic DNA

SEQ ID NO: 110932 - DNA, 225 bp, Homo sapiens; identical to SEQ ID NO: 78024
  misc_feature 1..225: note = chr15:80696318-80696543
  misc_feature 1..225: note = Hyper
  source 1..225: mol_type = genomic DNA

SEQ ID NO: 110933 - DNA, 30 bp, Homo sapiens; identical to SEQ ID NO: 78025
  misc_feature 1..30: note = chr15:80697219-80697249
  misc_feature 1..30: note = Hyper
  source 1..30: mol_type = genomic DNA

SEQ ID NO: 110934 - DNA, 69 bp, Homo sapiens; identical to SEQ ID NO: 78026
  misc_feature 1..69: note = chr15:81072720-81072789
  misc_feature 1..69: note = Hyper
  source 1..69: mol_type = genomic DNA

SEQ ID NO: 110935 - DNA, 115 bp, Homo sapiens; identical to SEQ ID NO: 78027
  misc_feature 1..115: note = chr15:81073160-81073275
  misc_feature 1..115: note = Hyper
  source 1..115: mol_type = genomic DNA

SEQ ID NO: 110936 - DNA, 30 bp, Homo sapiens; identical to SEQ ID NO: 78028
  misc_feature 1..30: note = chr15:81198888-81198918
  misc_feature 1..30: note = Hypo
  source 1..30: mol_type = genomic DNA

SEQ ID NO: 110937 - DNA, 21 bp, Homo sapiens
  misc_feature 1..21: note = chr15:81282983-81283004
  misc_feature 1..21: note = Hypo
  source 1..21: mol_type = genomic DNA
aaaaaaaccaaaggccgcacg

SEQ ID NO: 110938 - DNA, 21 bp, Homo sapiens
  misc_feature 1..21: note = chr15:81283124-81283145
  misc_feature 1..21: note = Hypo
  source 1..21: mol_type = genomic DNA
aaaaaacgcttcattctttat

SEQ ID NO: 110939 - DNA, 30 bp, Homo sapiens; identical to SEQ ID NO: 78031
  misc_feature 1..30: note = chr15:81771801-81771831
  misc_feature 1..30: note = Hypo
  source 1..30: mol_type = genomic DNA

SEQ ID NO: 110940 - DNA, 169 bp, Homo sapiens; identical to SEQ ID NO: 78032
  misc_feature 1..169: note = chr15:82042432-82042601
  misc_feature 1..169: note = Hypo
  source 1..169: mol_type = genomic DNA

SEQ ID NO: 110941 - DNA, 19 bp, Homo sapiens
  misc_feature 1..19: note = chr15:82097045-82097064
  misc_feature 1..19: note = Hypo
  source 1..19: mol_type = genomic DNA
ttttttttttttagacgga

SEQ ID NO: 110942 - DNA, 19 bp, Homo sapiens
  misc_feature 1..19: note = chr15:82097326-82097345
  misc_feature 1..19: note = Hypo
  source 1..19: mol_type = genomic DNA
cgcccggcctggcttttat

SEQ ID NO: 110943 - DNA, 60 bp, Homo sapiens; identical to SEQ ID NO: 78035
  misc_feature 1..60: note = chr15:82156125-82156185
  misc_feature 1..60: note = Hypo
  source 1..60: mol_type = genomic DNA

SEQ ID NO: 110944 - DNA, 219 bp, Homo sapiens; identical to SEQ ID NO: 78036
  misc_feature 1..219: note = chr15:82205602-82205821
  misc_feature 1..219: note = Hypo
  source 1..219: mol_type = genomic DNA

SEQ ID NO: 110945 - DNA, 23 bp, Homo sapiens
  misc_feature 1..23: note = chr15:82231172-82231195
  misc_feature 1..23: note = Hypo
  source 1..23: mol_type = genomic DNA
tcttcataaccttggcgtaggcc

SEQ ID NO: 110946 - DNA, 82 bp, Homo sapiens; identical to SEQ ID NO: 78038
  misc_feature 1..82: note = chr15:82231255-82231337
  misc_feature 1..82: note = Hypo
  source 1..82: mol_type = genomic DNA

SEQ ID NO: 110947 - DNA, 713 bp, Homo sapiens; identical to SEQ ID NO: 78039
  misc_feature 1..713: note = chr15:82336570-82337283
  misc_feature 1..713: note = Hyper
  source 1..713: mol_type = genomic DNA

SEQ ID NO: 110948 - DNA, 329 bp, Homo sapiens; identical to SEQ ID NO: 78040
  misc_feature 1..329: note = chr15:82339878-82340207
  misc_feature 1..329: note = Hyper
  source 1..329: mol_type = genomic DNA

SEQ ID NO: 110949 - DNA, 30 bp, Homo sapiens; identical to SEQ ID NO: 78041
  misc_feature 1..30: note = chr15:82396478-82396508
  misc_feature 1..30: note = Hypo
  source 1..30: mol_type = genomic DNA

SEQ ID NO: 110950 - DNA, 438 bp, Homo sapiens; identical to SEQ ID NO: 35864
  misc_feature 1..438: note = chr15:83314955-83315393
  misc_feature 1..438: note = Hyper
  source 1..438: mol_type = genomic DNA

SEQ ID NO: 110951 - DNA, 1093 bp, Homo sapiens
  misc_feature 1..1093: note = chr15:83315985-83317078
  misc_feature 1..1093: note = Hyper
  source 1..1093: mol_type = genomic DNA
ctctccggcgccaagcgaaggtgtgaagccacgtgacctgcccaggattgggaagccgcacgaggggcttgagccctccaccttaaaggtgccgcgaccgccgccgtcgtggggctctccacagagcacggggtctacgccgtcagcagccccgccccgtcccgcccgggcgcccccaccgcgcgccgggtgctaaagagacccgcagggggcgtgagcttccagcgccagcggcttcgggtctcccgtgcgacggcagtgtgagaaagaaacgttccgggcgccggtgctcctttatgtccggtcagctcccgtctggacagacgctcgaggccgcctggaggccgcagtgcggctcggaggccccaccggccgcccccgcagggctgcggcgcctttaagcccaaaggccctgagtcacgaggaggctccctgcccccctcgccctccacccctccacgaggccccacgcccgcgggcacgtgaccgcgccccgcccgggactcgcccgcacggggcgggggatgggggtaccgcggcgccggacccggctgcgcgcggaccgttagctactgcggccgggacgcggccccgcccaggcgagcggcgggtggctcttaccagcgggaacgccatggggccggtgtggccctgcggggctgacgggctgaccggccagccggcgggcgagagacgcgcacgcacgtgggcactatttttgcagcgggccgcgcgcagccccgcaccccggcagcttatgaagctcctacgagccgctcctcggagccgccccccggccggatgcggagcacctgtgtcggccccgcccgggccctcgcctccgccccctcgcgccccgcccctcctagcaggccgagccgaggagggctccgccgcccacccggaacccggcggggactgccgccgctgctagccacagctgccccctggggggccagagacctaagcctgagcgcgccatcacctaagtgacccttgccgagtcactgtctgccctgggcctcagtttccctcttaacgaaagagggcacgatttacaagcccctgcgagcggcggcgatcgcttcgtcag

SEQ ID NO: 110952 - DNA, 865 bp, Homo sapiens
  misc_feature 1..865: note = chr15:83348876-83349741
  misc_feature 1..865: note = Hyper
  source 1..865: mol_type = genomic DNA
cgcagaagcggccctcggacagcgaggacagcccgccgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcgcagcaggcgcaccagcgccttggcgatgacgcccacttccgccttgggcgccaggtggaagtagagctgcgccaccgccatcaccaccgcggcgctgcggctctgcagcaggggtttggtgttgcgcagcagcagccggtggtcggggtccatgacatagggctttcgggagggggcggccgcggcggccgtctcctcagaccccgcgcccttggcctcgtcctcctctgagccgtagaaggctttttccgcgttctcctctagtagggattcctggacggggagaccgacgggtctgtgggcgcctccccgggacacacttcggcccgctctgcctgggctgggcccacttacgttctgggtggggctcaggaactgcgtgcgggcgtagcgggtgagcatgctgatgatgaccacctggccccactcctccacgtcgatcagcaggttacagagtttccggtagtttttgtgaatcaggtcgatgcgctccgggcagacctcctc

SEQ ID NO: 110953 - DNA, 86 bp, Homo sapiens; identical to SEQ ID NO: 78048
  misc_feature 1..86: note = chr15:83378001-83378087
  misc_feature 1..86: note = Hyper
  source 1..86: mol_type = genomic DNA

SEQ ID NO: 110954 - DNA, 754 bp, Homo sapiens; identical to SEQ ID NO: 78049
  misc_feature 1..754: note = chr15:83378288-83379042
  misc_feature 1..754: note = Hyper
  source 1..754: mol_type = genomic DNA

SEQ ID NO: 110955 - DNA, 30 bp, Homo sapiens; identical to SEQ ID NO: 78050
  misc_feature 1..30: note = chr15:83390208-83390238
  misc_feature 1..30: note = Hypo
  source 1..30: mol_type = genomic DNA

SEQ ID NO: 110956 - DNA, 453 bp, Homo sapiens; identical to SEQ ID NO: 78051
  misc_feature 1..453: note = chr15:83620954-83621407
  misc_feature 1..453: note = Hyper
  source 1..453: mol_type = genomic DNA

SEQ ID NO: 110957 - DNA, 29 bp, Homo sapiens
  misc_feature 1..29: note = chr15:83622331-83622360
  misc_feature 1..29: note = Hypo
  source 1..29: mol_type = genomic DNA
agtcaagggacaggtcgggcgcggtggct

SEQ ID NO: 110958 - DNA, 76 bp, Homo sapiens; identical to SEQ ID NO: 78053
  misc_feature 1..76: note = chr15:83655953-83656029
  misc_feature 1..76: note = Hypo
  source 1..76: mol_type = genomic DNA

SEQ ID NO: 110959 - DNA, 1134 bp, Homo sapiens
  misc_feature 1..1134: note = chr15:83775821-83776955
  misc_feature 1..1134: note = Hyper
  source 1..1134: mol_type = genomic DNA
gccaggtttaaaaaccggatgccggctccgtgcagcagcccgccgatggctactggagcggagaggttccgaggtttcaggggcattttgtcctttcccacttctgggccgtgggctcccccatagacgatcccgcgggcccttcctcctctgacaccctcggatctggttccacctttcccggaccgcagctcagccccgcgcctctccagctcttcgatgaccggttcccggccgtgccccgggccctccctcggagcgcgcgccgccaggggcacctgtccctgcgcgggggtgtcgccgcccctcggcgccgccgggcgcttgccgctgagccgtggcgcccctggcaggagcactgcaaggacgcctcccgggactgcaccgcggccctgcgcacttggggcgacggggccaggcgcgggggacggctgcgggctgggagggcgcgcggaggagacaccgctgaggggacgccgctgagggcgccacgcggggggcgcggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgagtgagtgagccggcgcggcgggggtcgcgccgaggggcggcgggagttggctcgccgcgacgggagcctcgcaacttttccgagggggctgggaccgtccgccgcgggacagaggttcgtggccgcaggggctccccgcgcctggccagactaggggggcgccccaggggtcgcacgggccgggtcttggagccgggccctgaggtgcccaggctggcgcatttcgggatgttggtgccagcaccgcgccaggtgcccggggtcacaggcgtcaatacggccatgcccctgccctggaggggcccaggggccggtggggagcggaacaaacacggacactacgaacctggccgtgtcagctcgtttgtgccttgttctttttgcatctcacgggaacgtttccatgtatggactttcgcatacttatcatt

SEQ ID NO: 110960 - DNA, 1540 bp, Homo sapiens
  misc_feature 1..1540: note = chr15:83875670-83877210
  misc_feature 1..1540: note = Hyper
  source 1..1540: mol_type = genomic DNA
gacagccgctcaccccgctgccgtacctgccccgacgttcgcccgggacccagggtatccaccaatgaccctgcccggagccgaagcctccgtcgcaggcccgctgcccggcggcgtggcttcccggtcggcaccggctttccaggaggaaggcagcgtcgggcctgcgggggccggacccgccttcgaaagtgggcggaaggatggccgccctggcggagtgcgggcgaggccgggagcccttgcctcagccccggcccggtcttcttcgtgccgcgccgccctcagccctcaccacagccggccgcgagctgcgggctcggggctgaggcgatggggaaagggggcgggcgcgccatcatgaaggggaaaatggtgggcgggcgggcccgcgcgcggccgcggtactcacccgggccggccagtgcgggtagcccttcatcttggcgaagaccaggtcgcccgctttgtactcgcggggccgcggacgcgccatcccagccgctccccttcctggtagtccttggtcgccgcgaagatgccgggaggccgcccccccgcgggccgacgaattgcgccgcgctccccgcgggcctcaagccgggcggacgagcggccgctccgacgaggggaagcggcgaggcggcggctgaggcaaggggtgggcggggggcgcagcaggcccggcaaatcacggcccggcagcgggggaggggagcccccggccgttcggcgctcgcccgcgtccggccgcgccaaggtccccgccgccgccgccgccgccgccgcgcgcgctgctcaccagcgccgcgtcgcctgcctcatgccgccgctgccggtctccctcccgggctcccgggcgcggcgcgagcgccgggcctcgcgtctgctccgaattccttctcgggcagcgaccgcaaacacgatcttattattgttctcgcgcgcgctcagcatcccccccccgccccgcttcccgcttcccgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgctccaggcctgggggacggcggcgcgaggggaccctctgctgggcaccaagctgccggaaagagcaccgctccggagtcagcgaccttattggattcttgccccaggtctgcccttaacaatgcagtgtgacccacctagggcgagctatttaatcg

SEQ ID NO: 110961 - DNA, 1041 bp, Homo sapiens
  misc_feature 1..1041: note = chr15:83951781-83952822
  misc_feature 1..1041: note = Hyper
  source 1..1041: mol_type = genomic DNA
accaggggacgttaccgaacccccgagcgtctgatgccccccgccccccaaccacacacaacttcactcacacaattaaggctgggagatggcattccacttaactgtcagactcggagcggtggcagccccgcagccacaaagagatgccttaaatgagaagaacatgtttctacaccgcatttgtgaaagtttggctcggagctacgcgctgattaatatcagatctccttcactcgcctcgccacaatcttgtcacatctggctgacaaatcccgaggaactccggcaaagccaggcggcggcggggctccgggtctgggcggcggctccggaggagcagcgggagaccccgcagcggcctcctccttctccgcccgcggcccccagcctcgccgccgccgcccggctcccagcacggaaccgacggggcgctcccgagacgggcgagccacgcgctcgcaggtcccaaggccaggctgggcgggactgttaagggagctcgaagtcgggggccgggggcttcccgtcccggcgcttcccatgcaaacccctgaaggaagcggcaggcgcagccgcgggctccgcagcccaggcccacttcctgtcactccaggaaaacctcggagcggcggacgcggctcggcccggcttccagcccagagcccaagcgccttagccccgtcccagcgctttctgaaagacgggccacctcgcgcggagccgcgacaaggactccagggtccgcagtgaagctggtcaaatctgccccgcacacggtcaacgctcggtctgtgtcccggaagctttcggaccggacctgtctaaatagcgactttcagtcgtgggttttttgttcttgtgggtttgttttgttttttgttgttgttgttgctctacaaaagatttgtcccgcagtggacgggagcctcctcacggccgcccgcccgtctccgcagttctcctcagtgaccggaggctgccgcgcgccccgttctccagagaaacaatccccggagagaaagacggccagtgtgaaat

SEQ ID NO: 110962 - DNA, 918 bp, Homo sapiens
  misc_feature 1..918: note = chr15:83953076-83953994
  misc_feature 1..918: note = Hyper
  source 1..918: mol_type = genomic DNA
gagccccaacccccccgccgccgcctcccggccggagaccacggtccctcccgccgcgcctcggggccgcgctgccgcgcaggtagccagctggccctcgggaggtggccctcgggtacccacgggagccggagcccagcggcgtcccgggccgcctgctccgcgcacagagaatccccgcgcccgcggagggcgccgcgcttacctcggccatcctgcgaccgctgcggtgccggggctgccggcgcgtctcccgggcccgggccgccccgcgtccgccccggctcggcgggcgccgccgcatccacgctccggccgtcggggcgcgacccggcgaagtgggcggctccccaagcgcccaggctgcgcagcacgatggccgcccccgccgcgcaccgcgtgtgcccgcacgcccgccccctgcgccccggggacgcctctccgcccctccccctgcccctccgcccaccgcgcggtcgccccacgccgcgggcgctgcttcgccgcccgggaggccgcctcccgccccgggaccggataacgccctaaatcagcgcagctgaggcgaggccgtggcccccgcagaccgcggagacctcgccggcggccggcgcggaggtgtctgcccccgccgggcttgaaggcacttgttggtaaaagacacagacgtgtcggtgtttgcctctcccggggaagggcgaaacgctctgaagttctctggcgctcttctcaggagatgattcggcctcccctcctaccctggggcgccctcggggtctcactgccgcggaggaagaaggcagcgccgccctcgcctgcagaaacctcattcccgagaaagtgcgggacgagcgtcttgggatgtggaagaagggggtcgccaggaggttttcttaagaactcaaaacaagcgccccc

SEQ ID NO: 110963 - DNA, 34 bp, Homo sapiens; identical to SEQ ID NO: 35885
  misc_feature 1..34: note = chr15:84034378-84034412
  misc_feature 1..34: note = Hyper
  source 1..34: mol_type = genomic DNA

SEQ ID NO: 110964 - DNA, 30 bp, Homo sapiens; identical to SEQ ID NO: 78067
  misc_feature 1..30: note = chr15:84063249-84063279
  misc_feature 1..30: note = Hypo
  source 1..30: mol_type = genomic DNA

SEQ ID NO: 110965 - DNA, 1183 bp, Homo sapiens
  misc_feature 1..1183: note = chr15:84115713-84116896
  misc_feature 1..1183: note = Hyper
  source 1..1183: mol_type = genomic DNA
ttgtccctccctaggcgcatttctgagccttcctttcttaaacatacaccgagcgaaaatgcgccggagggaggcgatgttgcctgtgagccaaagccggttcggcaccaagacagaagcagagagaactgatctctctcccggtacccatgacaatctcagagctagatctatatcgtcccgcgcccagcaagaagcactgtgtgactgtactcccccgacccccaggacatccccacgcccagcttcccaggccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggaggcgcagaggagggaaggagggagggggacgcggaggctgcggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggccgttgtaaatcggagagattctgcggagcggagggcagaggtggcggccgcggggactcgggaggcggagacggagtgggcgtgggggggcccctacccgcgcgaggggaggacgaccacagggagtacgatgccggcagggcctcccccgagtctccagccgtttggttgggagagcctcgtggggggcccatcctccaccggccaccggcgcctccagagatgctgtgtatttggcgcttggctgtgtcccgctgagctccccgcgcgcgcatcgaaatggccccgtctggactgtgcccggctccccggctggggctctctaccgcggtccttcccctcc

SEQ ID NO: 110966 - DNA, 92 bp, Homo sapiens; identical to SEQ ID NO: 78074
  misc_feature 1..92: note = chr15:84225557-84225649
  misc_feature 1..92: note = Hypo
  source 1..92: mol_type = genomic DNA

SEQ ID NO: 110967 - DNA, 997 bp, Homo sapiens
  misc_feature 1..997: note = chr15:84322390-84323387
  misc_feature 1..997: note = Hyper
  source 1..997: mol_type = genomic DNA
acggcatccctgctccggctccggctgaggcggggcggccaggctggcttgcggcgcagcggccgcctttccccagtgcgcctgccggcggcggcggtggcggcgtcggcaatcccggctcttggcacaacgcctggcggccggcccagggcgaggagtggcttccaggaagcgggcggaggagcgttccagccgagtcccgccgtcgccgcggccccgcgcgctccgagcggcccgggcctggccccacacggcgtctcttcgcgcccccggcgcctccagctcaagccgagggcgcggtgccggcgcgcaggctgacgggcgcctgggcgcgccgtgcacttgccgggcggtgcaggtggcggcgcgcgccctccgcctctgggccggggccagcgcagcgctctgcgcgcccggagggggcgggagaggcggggcagcccccgtcccagccccatttaacttcgcggcggcggcggcgactgcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggtgggtgcaccgagctcggcgcagggcggcccctcaggggtcgggggaaggcgctccccagagggagtaagacttggagcagtggcctctctaagcaagttgggggtctccaagcagagtcggggcgtgccacgcgggccccagggggcctcaggactggggtgctcctcactgctgggcacctcgggtcgggcgcgcttcgtgccgtcccggaaggttcagggagagtctttcggcggcagttcgcgggctgaggggcgttcttgattatgggggaactccacagggttggagtttttcaggattgggagttactaagcagaaacctcgcgggtccgaaggtccggccggttgaccac

SEQ ID NO: 110968 - DNA, 36 bp, Homo sapiens; identical to SEQ ID NO: 78077
  misc_feature 1..36: note = chr15:84543445-84543481
  misc_feature 1..36: note = Hypo
  source 1..36: mol_type = genomic DNA

SEQ ID NO: 110969 - DNA, 49 bp, Homo sapiens; identical to SEQ ID NO: 78078
  misc_feature 1..49: note = chr15:84582058-84582107
  misc_feature 1..49: note = Hypo
  source 1..49: mol_type = genomic DNA

SEQ ID NO: 110970 - DNA, 935 bp, Homo sapiens
  misc_feature 1..935: note = chr15:84748531-84749466
  misc_feature 1..935: note = Hyper
  source 1..935: mol_type = genomic DNA
attatttacctggcccgggtggcattttactttgcatccttgattgggagtctcaggggctacgaacaaacgttttatccccgggtagccggcgggtgcggagcgagtattcgtggggcgggataagtgcggaagtcgctgcgccctcgtcccttcatctccgggggacggccactctcagggttcccgaggagcccgctccgtgcacctaggccctaggtcggctcccaagccctggcccgccgctacaccagcggtttcttacccgcaagtacaaatgtgacacagacaccagctcctcgtgctcttggctcccagggtttctttcaccgcgcctcagcacctgcagcttctccactcttacagcgcccgccgtcgtcaaggcaacagagggatgcccggtgacagactcggcgccggcttccggcgccgtaagagaagcgtccgcgcgggcgttctggacccgcagagttctcggcgtttccgaagctcttggtgtggccgggacccgggagaaggagcagggctggtggggctgctgcagccggtgagtgtgtgctggcgctgggggctggaacctcctaggccagtctctgggcggtgccgcaggaccctgctcgctgcggctctgaggcggaaacaggggctggggccgagcgcgggctggaagctttggtccctggagtgtcgcttccagtctggggccgaggcggtcgcctgtgtagacccgggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactttgttggggctctatgggcaggaataaagctgggtatttgacctcgcgcgaggacgagcgagaatgtca

SEQ ID NO: 110971 - DNA, 89 bp, Homo sapiens; identical to SEQ ID NO: 78081
  misc_feature 1..89: note = chr15:84950082-84950171
  misc_feature 1..89: note = Hypo
  source 1..89: mol_type = genomic DNA

SEQ ID NO: 110972 - DNA, 196 bp, Homo sapiens; identical to SEQ ID NO: 78082
  misc_feature 1..196: note = chr15:85143051-85143247
  misc_feature 1..196: note = Hypo
  source 1..196: mol_type = genomic DNA

SEQ ID NO: 110973 - DNA, 30 bp, Homo sapiens; identical to SEQ ID NO: 78083
  misc_feature 1..30: note = chr15:85200338-85200368
  misc_feature 1..30: note = Hypo
  source 1..30: mol_type = genomic DNA

SEQ ID NO: 110974 - DNA, 30 bp, Homo sapiens; identical to SEQ ID NO: 78084
  misc_feature 1..30: note = chr15:85681092-85681122
  misc_feature 1..30: note = Hypo
  source 1..30: mol_type = genomic DNA

SEQ ID NO: 110975 - DNA, 40 bp, Homo sapiens; identical to SEQ ID NO: 78085
  misc_feature 1..40: note = chr15:85728807-85728847
  misc_feature 1..40: note = Hypo
  source 1..40: mol_type = genomic DNA

SEQ ID NO: 110976 - DNA, 27 bp, Homo sapiens
  misc_feature 1..27: note = chr15:85886665-85886692
  misc_feature 1..27: note = Hypo
  source 1..27: mol_type = genomic DNA
gattttaacttgcgttagtgaactaat

SEQ ID NO: 110977 - DNA, 30 bp, Homo sapiens; identical to SEQ ID NO: 78087
  misc_feature 1..30: note = chr15:86251040-86251070
  misc_feature 1..30: note = Hyper
  source 1..30: mol_type = genomic DNA

SEQ ID NO: 110978 - DNA, 30 bp, Homo sapiens; identical to SEQ ID NO: 78088
  misc_feature 1..30: note = chr15:86606387-86606417
  misc_feature 1..30: note = Hypo
  source 1..30: mol_type = genomic DNA

SEQ ID NO: 110979 - DNA, 37 bp, Homo sapiens; identical to SEQ ID NO: 78089
  misc_feature 1..37: note = chr15:87115915-87115952
  misc_feature 1..37: note = Hypo
  source 1..37: mol_type = genomic DNA

SEQ ID NO: 110980 - DNA, 30 bp, Homo sapiens; identical to SEQ ID NO: 78090
  misc_feature 1..30: note = chr15:88649077-88649107
  misc_feature 1..30: note = Hypo
  source 1..30: mol_type = genomic DNA

SEQ ID NO: 110981 - DNA, 38 bp, Homo sapiens; identical to SEQ ID NO: 78091
  misc_feature 1..38: note = chr15:88783191-88783229
  misc_feature 1..38: note = Hypo
  source 1..38: mol_type = genomic DNA

SEQ ID NO: 110982 - DNA, 30 bp, Homo sapiens; identical to SEQ ID NO: 78092
  misc_feature 1..30: note = chr15:88798166-88798196
  misc_feature 1..30: note = Hyper
  source 1..30: mol_type = genomic DNA

SEQ ID NO: 110983 - DNA, 2676 bp, Homo sapiens
  misc_feature 1..2676: note = chr15:88798564-88801240
  misc_feature 1..2676: note = Hyper
  source 1..2676: mol_type = genomic DNA
cgtccaaagtctccccgcgagcagccagctcgcaacttgtttacttgtcagcatgttttgctgtttccaaatggaaatagttaaacacctcggctggatcgcgagcagtccctatctgtcaccttccctgccggctaagcgctgccgccgctgccaccgccgctgccgcctctgccaaagaatcgaacctcgtctactttattccacttgagcgtggccaaactgttgctatttagtggggagcaaaaaaaaacaatttgcaccatcgaaacgagccagcaactggttgggaggcgggcggtagctgggccccgcgtgccctcggcggccggggtcctctccggggagaggcacacacacgcatagccggatcgcgcctcgccagggccggagtcacctggaatgcgcagccggagagcatctcccgagccagagcgagcctgacgcgcgcccagcgggcggcgggcagcggcgagctggggcgggcggagggccggctcccggccgcgggtgggcaggagggagacgcagagcgcgggggaggcaggctggggagcggccgcctgacttacatggaagtgatattccttgagatgtccgtgatgttgatactggcgttcccattgctgttccctgaatcctgcccttccaggagggggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctgccgggcatggtggccggctcggcgatcgctgactcgccgggtccgggggctctggaagcgaggcgcgctctccgactccgagactttgcagggttgcaacagacggtggggaggcaaaaaaaaaaaaggaaaaggaaaaaatggtgctaaagtcaccaagtcccacctactgggcagaattaaaacggacacaccacgcacctgcaaaacacacacactcactctcacacatacacacacccggagcccgaggaaaggaagagaaggaagatgcagtaggagctgcagcagccgccgcgaatggctcgccgcgcggctgcagaaatgtacaagtgctccgagccttacgaaacgcacgggttatcggagcgtcttcctcggctccctccctcccttcctccctccctcctcccctccctcgtcgcggcctcctccccccgccccccgcccgggctgggagcggcaggagagcggaatctccccctccctcccctccccacacccgtctctctccccgcctgtcctctccctcctccccacccacccacccacccactcgccggctcgcggctgtagccggcaccgccacccgcagcctcgcggcagcccgcccgctccacgcctcgcagcgcggcgcccgctagccgcagcccgggggaaaccgagaccgaagggaaaaagttgcatttgagattgcgagggtcggggctggggagggagagttggcgagctggctgcacgacacggaaaggcgctctcctttccactttttggccctcgcgctacccggttttgctgcaatccggaccgcggtaggaagtgaaatgaacgtggcggaggtgattggggagtgctcccaagccttgggtggggggcgctcccaagcctgggtgggtggggggcgcaggctcacggacggcgacggggggtgccggagcgcacagacaccccagagaagcacccagagccggggaccgggaccgcagacgcgcagtccttggtctgaatgacactcatttccgtaatctagagtctggggctctggtcttggctgggaggggactgcgggacatggcacgctaggtgccccccgtgcccgctgcgctttcttggaggtgggttttgcattcggccttgagcaggcatggatcggggaaggaagaaacaggggtcgaaagggctgcgctggagagccgaggtggccccgggcgagctgtgcgtgcaagagaaatggccgggggaaattgagatgcaaggggcatattttggcaagcgccacgccagcaccgtcagaggccggcttctcgggctcagctctcgggtgagctgagctggctgccgggtgagggggcgggcgggctgctttctccggattcgggggcgcagaacctcctccttccctcccacacaagcaccccttcctggtagggacgcaaagcaggtgcagctttcgacgagagctcagatctcatccgggaaagaagtgtgtgtggggggggccccgcttttgcgctggtagggatttttttcttaataaaacataaagatgccaagtgtgagctgtttgctgaaaaaaaaaaaaacgagcattcgctgtgggaaagga

SEQ ID NO: 110984 - DNA, 30 bp, Homo sapiens; identical to SEQ ID NO: 35901
  misc_feature 1..30: note = chr15:88801449-88801479
  misc_feature 1..30: note = Hyper
  source 1..30: mol_type = genomic DNA

SEQ ID NO: 110985 - DNA, 38 bp, Homo sapiens; identical to SEQ ID NO: 44336
  misc_feature 1..38: note = chr15:89142361-89142399
  misc_feature 1..38: note = Hypo
  source 1..38: mol_type = genomic DNA

SEQ ID NO: 110986 - DNA, 30 bp, Homo sapiens; identical to SEQ ID NO: 44337
  misc_feature 1..30: note = chr15:89145873-89145903
  misc_feature 1..30: note = Hypo
  source 1..30: mol_type = genomic DNA

SEQ ID NO: 110987 - DNA, 1860 bp, Homo sapiens
  misc_feature 1..1860: note = chr15:89147588-89149448
  misc_feature 1..1860: note = Hyper
  source 1..1860: mol_type = genomic DNA
agcccggggaggggacgggactggctctggtgtctcttctggtccgggcacaactggattcagcactaatgacggactctaccccagcggagcgctggaccctggcaggagtcgcaggctgcccgctgctggcccgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcaggaggtgacacaggttcgcggaagaaagcgggactcatcttcctcatttctccagggatttaggtgtgggattctaggagagcattctctctcgctctggccacgaccagtggaaaaacttggcgccaaatttaggcagtggtgcggggagcagaggcacgattgcaggcggtgagcaaaggggcaagcgggacagaggatctactgtgagccccaggctctggtgttccgtgaaaaatcgccacatttaaatcctgcgctcccccgtgctccctctcgc

SEQ ID NO: 110988 - DNA, 69 bp, Homo sapiens; identical to SEQ ID NO: 78105
  misc_feature 1..69: note = chr15:89195448-89195517
  misc_feature 1..69: note = Hypo
  source 1..69: mol_type = genomic DNA

SEQ ID NO: 110989 - DNA, 606 bp, Homo sapiens; identical to SEQ ID NO: 78106
  misc_feature 1..606: note = chr15:89248377-89248983
  misc_feature 1..606: note = Hyper
  source 1..606: mol_type = genomic DNA

SEQ ID NO: 110990 - DNA, 113 bp, Homo sapiens
  misc_feature 1..113: note = chr15:89312771-89312884
  misc_feature 1..113: note = Hyper
  source 1..113: mol_type = genomic DNA
cgtccagcctggctccgcgcagccgggcctgtcccgagcctcctgtaagctgcttctgcgccctgaacgctgcctgttgtcccctccagagcgcctcgcggctcctcctcctc

SEQ ID NO: 110991 - DNA, 1300 bp, Homo sapiens
  misc_feature 1..1300: note = chr15:89346003-89347303
  misc_feature 1..1300: note = Hyper
  source 1..1300: mol_type = genomic DNA
gtccttggtctctcccggggaatttgaagacccagagactcgcagctccccgtgagcctccccgctgacgccttacctccccctctccaccatcccctgccatcccggtgtacgccacccccaaaaaaactttcagccagctcctcggtgagggtcgttccaaatcgtggccgacagtagcgggctgcaccctccttagatcgcgtcgtggccagcctcagctgcagaaccccgccgggcgcccgggagccctgtcccgccgcggcggcctcagagtccgggcacttggggattctctgagggtgcagccctcctgggcccctccgactgcggagctgccgaccgcaatgcagatgcgggccctccagcccttctcgcgccgccttcctcccgccagccccggagctgccgggtccgcgccgccccggggagcgctcctctcccgccctgagcgcaggccggcttccccatcggcgcgccggtccggagccagggtccagcgcgctccagacgcctctgccttcccctccccctgtcggccgcccctcggtccctgggggtggggtttccctttgcgctcgccccctcccgcccccacccctcacgggccctcccctcccccgcccgtccctatgtatgtgtcacagcgcgccatgcccgcccgcccgcccacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagcaaactttttggctgttgcagactcagtgaatggggcaaaggaacacgtgaggaggggcacttgtctcctagtccgccaggatgaagga

SEQ ID NO: 110992 - DNA, 30 bp, Homo sapiens; identical to SEQ ID NO: 78111
  misc_feature 1..30: note = chr15:89383259-89383289
  misc_feature 1..30: note = Hypo
  source 1..30: mol_type = genomic DNA

SEQ ID NO: 110993 - DNA, 57 bp, Homo sapiens; identical to SEQ ID NO: 78112
  misc_feature 1..57: note = chr15:89390579-89390636
  misc_feature 1..57: note = Hypo
  source 1..57: mol_type = genomic DNA

SEQ ID NO: 110994 - DNA, 208 bp, Homo sapiens; identical to SEQ ID NO: 78113
  misc_feature 1..208: note = chr15:89422160-89422368
  misc_feature 1..208: note = Hypo
  source 1..208: mol_type = genomic DNA

SEQ ID NO: 110995 - DNA, 218 bp, Homo sapiens; identical to SEQ ID NO: 78114
  misc_feature 1..218: note = chr15:89437619-89437837
  misc_feature 1..218: note = Hyper
  source 1..218: mol_type = genomic DNA

SEQ ID NO: 110996 - DNA, 91 bp, Homo sapiens; identical to SEQ ID NO: 78115
  misc_feature 1..91: note = chr15:89438330-89438421
  misc_feature 1..91: note = Hyper
  source 1..91: mol_type = genomic DNA

SEQ ID NO: 110997 - DNA, 84 bp, Homo sapiens; identical to SEQ ID NO: 78116
  misc_feature 1..84: note = chr15:89438779-89438863
  misc_feature 1..84: note = Hyper
  source 1..84: mol_type = genomic DNA

SEQ ID NO: 110998 - DNA, 20 bp, Homo sapiens
  misc_feature 1..20: note = chr15:89448511-89448531
  misc_feature 1..20: note = Hypo
  source 1..20: mol_type = genomic DNA
taataaatcattcatcgggg

SEQ ID NO: 110999 - DNA, 39 bp, Homo sapiens; identical to SEQ ID NO: 78118
  misc_feature 1..39: note = chr15:89651830-89651869
  misc_feature 1..39: note = Hypo
  source 1..39: mol_type = genomic DNA

SEQ ID NO: 111000 - DNA, 30 bp, Homo sapiens; identical to SEQ ID NO: 78119
  misc_feature 1..30: note = chr15:89760580-89760610
  misc_feature 1..30: note = Hypo
  source 1..30: mol_type = genomic DNA

SEQ ID NO: 111001 - DNA, 449 bp, Homo sapiens; identical to SEQ ID NO: 78120
  misc_feature 1..449: note = chr15:89876378-89876827
  misc_feature 1..449: note = Hypo
  source 1..449: mol_type = genomic DNA

SEQ ID NO: 111002 - DNA, 208 bp, Homo sapiens; identical to SEQ ID NO: 78121
  misc_feature 1..208: note = chr15:89876887-89877095
  misc_feature 1..208: note = Hypo
  source 1..208: mol_type = genomic DNA

SEQ ID NO: 111003 - DNA, 498 bp, Homo sapiens; identical to SEQ ID NO: 78122
  misc_feature 1..498: note = chr15:89903388-89903886
  misc_feature 1..498: note = Hyper
  source 1..498: mol_type = genomic DNA

SEQ ID NO: 111004 - DNA, 107 bp, Homo sapiens; identical to SEQ ID NO: 78123
  misc_feature 1..107: note = chr15:89904905-89905012
  misc_feature 1..107: note = Hyper
  source 1..107: mol_type = genomic DNA

SEQ ID NO: 111005 - DNA, 145 bp, Homo sapiens; identical to SEQ ID NO: 78124
  misc_feature 1..145: note = chr15:89905745-89905890
  misc_feature 1..145: note = Hyper
  source 1..145: mol_type = genomic DNA

SEQ ID NO: 111006 - DNA, 145 bp, Homo sapiens; identical to SEQ ID NO: 35911
  misc_feature 1..145: note = chr15:89906124-89906269
  misc_feature 1..145: note = Hyper
  source 1..145: mol_type = genomic DNA

SEQ ID NO: 111007 - DNA, 194 bp, Homo sapiens; identical to SEQ ID NO: 78126
  misc_feature 1..194: note = chr15:89908822-89909016
  misc_feature 1..194: note = Hyper
  source 1..194: mol_type = genomic DNA

SEQ ID NO: 111008 - DNA, 30 bp, Homo sapiens; identical to SEQ ID NO: 12296
  misc_feature 1..30: note = chr15:89909322-89909352
  misc_feature 1..30: note = Hyper
  source 1..30: mol_type = genomic DNA

SEQ ID NO: 111009 - DNA, 1800 bp, Homo sapiens; identical to SEQ ID NO: 78128
  misc_feature 1..1800: note = chr15:89910390-89912190
  misc_feature 1..1800: note = Hyper
  source 1..1800: mol_type = genomic DNA

SEQ ID NO: 111010 - DNA, 30 bp, Homo sapiens; identical to SEQ ID NO: 78129
  misc_feature 1..30: note = chr15:89912514-89912544
  misc_feature 1..30: note = Hyper
  source 1..30: mol_type = genomic DNA

SEQ ID NO: 111011 - DNA, 699 bp, Homo sapiens; identical to SEQ ID NO: 78130
  misc_feature 1..699: note = chr15:89913180-89913879
  misc_feature 1..699: note = Hyper
  source 1..699: mol_type = genomic DNA

SEQ ID NO: 111012 - DNA, 1365 bp, Homo sapiens
  misc_feature 1..1365: note = chr15:89914120-89915485
  misc_feature 1..1365: note = Hyper
  source 1..1365: mol_type = genomic DNA
gccactggctccccacgtttgggcttcatttttgtctccggtttgtgctactctttcttcatccaaaaaggcgttggagatcccgagaatctgctgcagcttggaagccagaatcttagagaatctcggatacttctcaccccattcctttcattttacacctagaaatggtgtaaaaaggcccagtggctcacggaaggtcgcacagaaggccactgacagggcagcgatcagtacagccaccgtggtgggcgaggcatccggggcttccttttctctggtccacgaactcccaactccgaacgctgtgggactgcatgggcctctgcccgggccaatgaaatgcgctgccgagaggaggctgcggcgcggcctgaggccggatctccacaggccggagagttctctgccggccgcggccggacctcccgggaaatgggaccagagcgcggagggagcctggccaggaggcctcctaggactcagccgcgacgctgaaaagcatgaagggtcggaattaggcactcatttagcgagcgttactaatccgaagttacagcgctaattccctgatccggccgctcccacacgcagcgccgggattagaggcgcggccgccgcccgccccgccctcataccccaaacgcgcccgccccgcgccctcgaggctgcgggctcagggctaatccgccgcgccgcgctcgcctggcccgagcgcgcggcgggtcgggctcggccagctggggcgagccggcctgttcgctggctcgggcgcccggttccgggctgggcaaggagcgcttggccatgagccgcgggacagcccaggcgggacggatgcgccctccagggcccaggcgaggccgcgcggtgcagaaccgccgggatttctccaacccgggtatgcgcacccacagcagcggcctttggaggccgcggcgccattttagtggccttccttcccccttggcatctgtcgtgtatggtgtggctgggtgtccccagctccccccatcccgctctgactttggctgccccctccgccagcctggatagagtgaccaatcagctctgacctagggtgggatgcgcgtcaccatggcgacggctagggcgccctggcagtgctgcccatcgcagagggcaagtcttcactccgcctagatgggtgtgaagggaaggtggggacaggtgggggggaggggcggatggagggaggccgtgatgcctcgtccgcattcccaccccattttgcctagggtcagttcagctgggtcaggcaggggacaaatggatggtgtggaaggggcctgggtaggggcctgggtttgtcctggggcggctcttccacgagtcctctcatcc

SEQ ID NO: 111013 - DNA, 132 bp, Homo sapiens; identical to SEQ ID NO: 78133
  misc_feature 1..132: note = chr15:89918751-89918883
  misc_feature 1..132: note = Hyper
  source 1..132: mol_type = genomic DNA

SEQ ID NO: 111014 - DNA, 829 bp, Homo sapiens
  misc_feature 1..829: note = chr15:89921939-89922768
  misc_feature 1..829: note = Hyper
  source 1..829: mol_type = genomic DNA
ccaagattcacacctcgtctacaccagggcaccgcctgggcctacggccttccgaacccgaagcgcccgcagcccagagctggcatcaggccatcaggccgggaaggtcgtcgcaggccccagagtgcgggcgcggggggcgcgcgcccacaggacgcccggggttgggtaggcaggagagaagggcgccagcaggcccgcggctgtttcccctcggtccgcacagcgggcccgggaggccattttgagagcgcgaagaggggcggcaagatggctgcgtgggcacccggaaggtcgccgcgccaagggcccgctgagcccctcctcccattcgtccagccgcgcggcccacagaagcggaacgcgcgtcgagagcgccctgtccgctcgccccagacagatgcccggttattcattaccgcgaggcctagaggaaagagtggctgccgtcttcctgcccacagcccgccggaccctccgtcgcggctgcccggtccccggagccgcagccgccgagcccggctgtgcgtgtcgtggctgctggggagaaagaggcttccggtaagagcccccctgactgggctgcccaccccgggcaggggcggaaacggccttccccgcgtggggaacaatggcgttattttggagtctgcaaccgcgagcgcttcaagctctttgattattttcgaggagtgttaggtgcgtggctaactcccgcgttttcttggaaccacgaagcccaaaatggcgagcgggccgtggccgccctcctggggctgagtgtggtccggagcgctgagagtggccagggagccgtgggcctccatcg

SEQ ID NO: 111015 - DNA, 1175 bp, Homo sapiens
  misc_feature 1..1175: note = chr15:89942626-89943801
  misc_feature 1..1175: note = Hyper
  source 1..1175: mol_type = genomic DNA
cgccccccagcagcccgggccgcgtttgaccactagtagggcagaaccactgaccggcaggcggcgctccccggggctcccggctcgagccccagggcaccgggaggagtaaggaccccgagcgggagggagacgactggggggcgcgcggcacaaagagctttttattcaaatttgtttagagtttcgcgaatttgcatgaaaaatgtgtgagaaaagccagctccggtgacctcatccgcacctgccattaacgttcaattagcggctgaatagcggccgccgacgcgacgtgcagagaatccggcctgccccgcgcagcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaagtacaagttcaagttcagggccaggcccgggggggggcgctgagccttacccggccgcctttgttctctggcataatcgctcccacgtccccctcccgggcggggcccagcagagacccccgccccgccccgccccgccgcgccccgcaggagcctcctcctcccgccggcgcggcgcctgtgccctggtcccggtgtccccgctcggtgccaccgaaggatctaggggctcgggccggggagggggtggaggggggagtggaggcgcgatacgaacccgtgggagcctccccaaccccgcagtcccagcggcaaactgtgcttggtcggacggatgcccgcgcggaggtaagagccctttgcgggattcgcccgtatccctgtgccccgccccccgcctgggactacgcgggccccaaggagcggggcggaggatggtgtgctgaaaaccggctgggcagccccgctgggcctccggtggggtggggggcgcactgtcgctccagggctctggggagtacgaggcctgggcggtgggtatggagg

SEQ ID NO: 111016 - DNA, 125 bp, Homo sapiens; identical to SEQ ID NO: 78137
  misc_feature 1..125: note = chr15:89945164-89945289
  misc_feature 1..125: note = Hyper
  source 1..125: mol_type = genomic DNA

SEQ ID NO: 111017 - DNA, 571 bp, Homo sapiens
  misc_feature 1..571: note = chr15:89949371-89949942
  misc_feature 1..571: note = Hyper
  source 1..571: mol_type = genomic DNA
ttcggggccccctaccgaggccggccatgatcttgagggcggcataggggaggccgcgctctgtccaccccagcctggtgatgccgttcgcttcttgtgcccggtattgtgggctacatgcctttccggcgtacggagctgagcgtccaggccagtgcccctcaacctctcagtaatgtttacccgaggccgtcgtgcaatgagactattcgcatggcattgtcaacgcggcggcgcgcgcgtctcggccctccgcggcttgccagactgtcctgcaaaccacctcacccgtctctttggcgcaggagactcaggctgtaaccggagaaaacacttcaccctggaaccctaactcaggtcctggcaaaagatgcgagaggaagacttgctctcttaataaatctcggccgcccgcacatctggcccctagacctgctcggtagaggactggctggtggatgcgcggtccaggccgtgggcactcgacccacctctattttccttcccgaggcgcccctggattaccactttcggtttgcgcttacatccgggatgtcgaatttcccaggga

SEQ ID NO: 111018 - DNA, 2894 bp, Homo sapiens
  misc_feature 1..2894: note = chr15:89950236-89953130
  misc_feature 1..2894: note = Hyper
  source 1..2894: mol_type = genomic DNA
gcaggcctgaggagtcgggctgaaggtgcgccagccattattgcctcagacctccggacgctacgtaccccaagcacctgagctactagtggtatatcagacaagatttctgggagcagccccaggagtccctccgcccgctcccagtccgcaagcgcagaggatcctgcgctctgtcccccaaggtcttggcgtttgctgagctctctccgcgcgcgtcgaggagaggccgcctctcgtgagcaaaagctgggagttgttagagattccgcagccgctctgagggcgagatcgggtttgtcccacgacctcggcgccaggaagctgtagaaagagacagaccccaattttctccccttggagttgaaacaaaacctgaaagcccgaggttgcccgcaccgccagaggtggcgcctaggcggcgggggcgaccagagccgcgtgcccgcgcggttcccaggcctgggttctgtttcttcctattttagttagttacttagccggttagctaatagacagctcacaggcagcatttatgcaaacgccaagcctggacccacgctgagtctccgcggccgccagacctatagttgcccggctgggctcccagaggagtgaagaagggaaattcctagtaattaaaggggaggttttcccggggcgccccttggtgaagtggccttggcttccagtgaggaacaaaggactaaggtgcctgcgcgcagcgcgccctcggggcccggcgcgaccagctttcacgcctctcccagctcccacgcctctcccagctccacggcggccgcgggctttgtgagctggggccgcgcgccgcgctgcacctgcccggatttaagtaccttggcgaggcagcgcaggcggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacacacacacacacacacacacacacacacacacacacactcgcaacacgaggctcctccaagctaagataaactcgcttttcttccggtaagtgcgcgattgagccgcgacaataggcggcgaggaggaggccgttgggtcaatagcctgcgtctctcccattgataggaaaagtcagtgcgcggaatgcagggccttaggaaagccctgtccggcgttccagccacaggggtcacacttgcatcaacatgcgggcacgctgccccttgggtaccccaaacattgagcaaaatattggaaaggtggaccgaggtgtctgtggtgcctgccagcattggtcgggtgggccccagctgtaccctgggttcccctactttcccccagttgggccccacatctgggtctggctcttaagtcttgggcatatgggatagagaatttaaggatccagatactttgcaatccccgggctagtaggaggaaaagtggctcctctgggaacccggatgggccgaacagcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctccgatgtggggaggcctgcgcggggactaggttctcgagaggcgagcgggcgcgccagagaacccgagactgctgcggggccggatgcgggatccctgggctgcggttctacgcagaaacgccaatggccatgcctccccagctcctcccagccccagtcactaggccggcgcctggcccggagatcctcccagagccctggcggtgccatcatgccggagaagacaagctcggccccgctggaattcgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatctcacaagcgccttcttctgcgccatctccccacc

SEQ ID NO: 111019 - DNA, 988 bp, Homo sapiens
  misc_feature 1..988: note = chr15:89954197-89955185
  misc_feature 1..988: note = Hyper
  source 1..988: mol_type = genomic DNA
gcttaactcccatgacgtcagatcaccacttagagcgtcttgatgcccaggctagaaggatctcggttgcaccagctttccccactgcagtttcaggttttgtcccgacagactttcagcaagcggcttagctcagccctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctggcacactttggctgccacatcacggatggaaacgctgaggccaatgggctcaggttcgctagcagcaggcagccggccctggtgtgcccgctgtggcctgggtgctctgcatacccccgcgcgcgcttgctctgtgtggggggctggcagataggggtgttcctaggggccacgcggggggaagggggtggcggggccggtcttgcgcttcccacgctccatctgttcagttcactctggtggtctctgttccagtctggcctagggatccctggctccccacggccaagccgagaactagcgggcgcaggttgcattgtgcagactcccggggtcaggtcgcagggtcacgtgcacgcgtcgggcctcctccgggcgctcctattccagatccgccgacagagggcgccgggggcccgagaggagcatgttcgggcgcctctcccgggtccctggcgccacgctgtggggcttggtggttcagagccacacctgacaccctcacgtcccaaaccgggatagtcgcaccgacaaaaatcacaggaaggagcgcgcagttgactgtgggcgggcgggacggcggagccacttacagcgggacctgcgagggtgtgggtacgggactccccaacggaccctctagtttgtaaccgtgcgaacactggagggattcattatgtgcaccgtggaggcgcggac

SEQ ID NO: 111020 - DNA, 273 bp, Homo sapiens
  misc_feature 1..273: note = chr15:89956300-89956573
  misc_feature 1..273: note = Hyper
  source 1..273: mol_type = genomic DNA
gtgcctgcaaagccacggctcctaatcagggtaatttaatatattttaagcccccggcggctttattttccctccttttcgagtttgttttaggcattcacagctctcaccccgtcattagacggccttatttgacggatggaaggagctgctatgagaccacagccctttgtgtcccccacataagctgggcttccccgtaattagaatggtattcccagccattgaggcttttcatgaggcagaacaaaaactccccgagatgaatatccc

SEQ ID NO: 111021 - DNA, 221 bp, Homo sapiens; identical to SEQ ID NO: 78148
  misc_feature 1..221: note = chr15:89959838-89960059
  misc_feature 1..221: note = Hyper
  source 1..221: mol_type = genomic DNA

SEQ ID NO: 111022 - DNA, 148 bp, Homo sapiens; identical to SEQ ID NO: 78149
  misc_feature 1..148: note = chr15:89962805-89962953
  misc_feature 1..148: note = Hyper
  source 1..148: mol_type = genomic DNA

SEQ ID NO: 111023 - DNA, 629 bp, Homo sapiens; identical to SEQ ID NO: 78150
  misc_feature 1..629: note = chr15:90039431-90040060
  misc_feature 1..629: note = Hyper
  source 1..629: mol_type = genomic DNA

SEQ ID NO: 111024 - DNA, 329 bp, Homo sapiens; identical to SEQ ID NO: 78151
  misc_feature 1..329: note = chr15:90109270-90109599
  misc_feature 1..329: note = Hypo
  source 1..329: mol_type = genomic DNA

SEQ ID NO: 111025 - DNA, 257 bp, Homo sapiens; identical to SEQ ID NO: 78152
  misc_feature 1..257: note = chr15:90198157-90198414
  misc_feature 1..257: note = Hyper
  source 1..257: mol_type = genomic DNA

SEQ ID NO: 111026 - DNA, 102 bp, Homo sapiens; identical to SEQ ID NO: 78153
  misc_feature 1..102: note = chr15:90293464-90293566
  misc_feature 1..102: note = Hyper
  source 1..102: mol_type = genomic DNA

SEQ ID NO: 111027 - DNA, 62 bp, Homo sapiens; identical to SEQ ID NO: 78154
  misc_feature 1..62: note = chr15:90304847-90304909
  misc_feature 1..62: note = Hypo
  source 1..62: mol_type = genomic DNA

SEQ ID NO: 111028 - DNA, 259 bp, Homo sapiens
  misc_feature 1..259: note = chr15:90319855-90320114
  misc_feature 1..259: note = Hyper
  source 1..259: mol_type = genomic DNA
gagaaactgcgcatgcgcacgctggcccgcgccctgcacgagttgcgccgctttctgcctccctccttggcgccggccggccagagcctgaccaagatcgagacgctgcgcctggccatccgctacatcggccacctatcggccgtgctgggtctcagcgaggagagtctgcagtgccggcgcaggcagcgcggggacgcggggtccccttggggctgcccgctgtgccccgaccgtggccccgcagaggcgcagacgc

SEQ ID NO: 111029 - DNA, 46 bp, Homo sapiens; identical to SEQ ID NO: 78157
  misc_feature 1..46: note = chr15:90349846-90349892
  misc_feature 1..46: note = Hypo
  source 1..46: mol_type = genomic DNA

SEQ ID NO: 111030 - DNA, 567 bp, Homo sapiens
  misc_feature 1..567: note = chr15:90357883-90358450
  misc_feature 1..567: note = Hyper
  source 1..567: mol_type = genomic DNA
gcagaagtccagctccgcacgcgccaagcgctgggtctgcagctccctcggttcccgcgcacccaactgccccacgacccctacccgcgcccgcagcccccgccctcccgccccacttgcctgggccgccgggcgctggaacctggaccctggaccctggcgggttccgagctgcgccgccgccgtccctgcccctccagcactggactcctcctttcccgtctttttaaagggaagtaaccggacccgaccactactccacccgattcacccctagcgggccgcccgcccgcagctccgcccgggctcctcccccgtccgcccgcggcttcccgggagccccccagggctcctccgctcctccgacggcccggccttccccccggggcctgggatgcaccagggctcctgctgcccccgacggggtccctgtcgccgcagcccgcgggacccgccggccacatctggacggcatctgccgcgggggaggggctcagagcctcgccctgagtgtcccgcagggagccttgtgcatccggggcaggaagccagcgcatcccgtgcaga

SEQ ID NO: 111031 - DNA, 157 bp, Homo sapiens; identical to SEQ ID NO: 78160
  misc_feature 1..157: note = chr15:90455810-90455967
  misc_feature 1..157: note = Hyper
  source 1..157: mol_type = genomic DNA

SEQ ID NO: 111032 - DNA, 30 bp, Homo sapiens; identical to SEQ ID NO: 44342
  misc_feature 1..30: note = chr15:90501049-90501079
  misc_feature 1..30: note = Hypo
  source 1..30: mol_type = genomic DNA

SEQ ID NO: 111033 - DNA, 149 bp, Homo sapiens; identical to SEQ ID NO: 78162
  misc_feature 1..149: note = chr15:90501280-90501429
  misc_feature 1..149: note = Hypo
  source 1..149: mol_type = genomic DNA

SEQ ID NO: 111034 - DNA, 218 bp, Homo sapiens; identical to SEQ ID NO: 78163
  misc_feature 1..218: note = chr15:90541900-90542118
  misc_feature 1..218: note = Hypo
  source 1..218: mol_type = genomic DNA

SEQ ID NO: 111035 - DNA, 58 bp, Homo sapiens; identical to SEQ ID NO: 78164
  misc_feature 1..58: note = chr15:90630550-90630608
  misc_feature 1..58: note = Hypo
  source 1..58: mol_type = genomic DNA

SEQ ID NO: 111036 - DNA, 43 bp, Homo sapiens; identical to SEQ ID NO: 44345
  misc_feature 1..43: note = chr15:90667422-90667465
  misc_feature 1..43: note = Hypo
  source 1..43: mol_type = genomic DNA

SEQ ID NO: 111037 - DNA, 82 bp, Homo sapiens; identical to SEQ ID NO: 15920
  misc_feature 1..82: note = chr15:90703242-90703324
  misc_feature 1..82: note = Hypo
  source 1..82: mol_type = genomic DNA

SEQ ID NO: 111038 - DNA, 29 bp, Homo sapiens
  misc_feature 1..29: note = chr15:90741425-90741454
  misc_feature 1..29: note = Hypo
  source 1..29: mol_type = genomic DNA
ggcgtgagccaccgcgcctggctggtaaa

SEQ ID NO: 111039 - DNA, 30 bp, Homo sapiens; identical to SEQ ID NO: 78168
  misc_feature 1..30: note = chr15:90747910-90747940
  misc_feature 1..30: note = Hypo
  source 1..30: mol_type = genomic DNA

SEQ ID NO: 111040 - DNA, 30 bp, Homo sapiens; identical to SEQ ID NO: 78169
  misc_feature 1..30: note = chr15:90753833-90753863
  misc_feature 1..30: note = Hypo
  source 1..30: mol_type = genomic DNA

SEQ ID NO: 111041 - DNA, 296 bp, Homo sapiens; identical to SEQ ID NO: 78170
  misc_feature 1..296: note = chr15:90755756-90756052
  misc_feature 1..296: note = Hypo
  source 1..296: mol_type = genomic DNA

SEQ ID NO: 111042 - DNA, 30 bp, Homo sapiens; identical to SEQ ID NO: 78171
  misc_feature 1..30: note = chr15:90835095-90835125
  misc_feature 1..30: note = Hypo
  source 1..30: mol_type = genomic DNA

SEQ ID NO: 111043 - DNA, 158 bp, Homo sapiens; identical to SEQ ID NO: 78172
  misc_feature 1..158: note = chr15:90859564-90859722
  misc_feature 1..158: note = Hypo
  source 1..158: mol_type = genomic DNA

SEQ ID NO: 111044 - DNA, 80 bp, Homo sapiens; identical to SEQ ID NO: 78173
  misc_feature 1..80: note = chr15:90866273-90866353
  misc_feature 1..80: note = Hypo
  source 1..80: mol_type = genomic DNA

SEQ ID NO: 111045 - DNA, 36 bp, Homo sapiens; identical to SEQ ID NO: 78174
  misc_feature 1..36: note = chr15:90891911-90891947
  misc_feature 1..36: note = Hypo
  source 1..36: mol_type = genomic DNA

SEQ ID NO: 111046 - DNA, 100 bp, Homo sapiens; identical to SEQ ID NO: 78175
  misc_feature 1..100: note = chr15:90896116-90896216
  misc_feature 1..100: note = Hypo
  source 1..100: mol_type = genomic DNA

SEQ ID NO: 111047 - DNA, 98 bp, Homo sapiens; identical to SEQ ID NO: 78176
  misc_feature 1..98: note = chr15:91185735-91185833
  misc_feature 1..98: note = Hypo
  source 1..98: mol_type = genomic DNA

SEQ ID NO: 111048 - DNA, 132 bp, Homo sapiens; identical to SEQ ID NO: 78177
  misc_feature 1..132: note = chr15:91189343-91189475
  misc_feature 1..132: note = Hypo
  source 1..132: mol_type = genomic DNA

SEQ ID NO: 111049 - DNA, 25 bp, Homo sapiens
  misc_feature 1..25: note = chr15:91313690-91313715
  misc_feature 1..25: note = Hypo
  source 1..25: mol_type = genomic DNA
ccaccgtgcccggccaatccccaca

SEQ ID NO: 111050 - DNA, 27 bp, Homo sapiens
  misc_feature 1..27: note = chr15:91366968-91366995
  misc_feature 1..27: note = Hypo
  source 1..27: mol_type = genomic DNA
atagaccctggccaacggatgaaatga

SEQ ID NO: 111051 - DNA, 214 bp, Homo sapiens; identical to SEQ ID NO: 78180
  misc_feature 1..214: note = chr15:91409404-91409618
  misc_feature 1..214: note = Hypo
  source 1..214: mol_type = genomic DNA

SEQ ID NO: 111052 - DNA, 472 bp, Homo sapiens
  misc_feature 1..472: note = chr15:91427507-91427979
  misc_feature 1..472: note = Hyper
  source 1..472: mol_type = genomic DNA
tgggccattctttcccggccccctcctcccttccgtttccgtggccgtgcggccggctagaggctgcggcccagcgcggagcaggggggctggcaggcgtcggggcggtcgggccggtcccgcccgccccttcccctccacaggcccgccccggggcctgggccaactgaaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccaggtgggggtaggggccgcggaagggcggggatggccgcaggggcagggctcaggctgtgggcgcctgaggcttcagctggggcaggcttggcctgtcgaggacctgggcaa

SEQ ID NO: 111053 - DNA, 61 bp, Homo sapiens; identical to SEQ ID NO: 78182
  misc_feature 1..61: note = chr15:91500770-91500831
  misc_feature 1..61: note = Hypo
  source 1..61: mol_type = genomic DNA

SEQ ID NO: 111054 - DNA, 30 bp, Homo sapiens; identical to SEQ ID NO: 78183
  misc_feature 1..30: note = chr15:91504803-91504833
  misc_feature 1..30: note = Hypo
  source 1..30: mol_type = genomic DNA

SEQ ID NO: 111055 - DNA, 863 bp, Homo sapiens; identical to SEQ ID NO: 78184
  misc_feature 1..863: note = chr15:91642936-91643799
  misc_feature 1..863: note = Hyper
  source 1..863: mol_type = genomic DNA

SEQ ID NO: 111056 - DNA, 201 bp, Homo sapiens; identical to SEQ ID NO: 78185
  misc_feature 1..201: note = chr15:92456345-92456546
  misc_feature 1..201: note = Hypo
  source 1..201: mol_type = genomic DNA

SEQ ID NO: 111057 - DNA, 361 bp, Homo sapiens; identical to SEQ ID NO: 78186
  misc_feature 1..361: note = chr15:92459330-92459691
  misc_feature 1..361: note = Hypo
  source 1..361: mol_type = genomic DNA

SEQ ID NO: 111058 - DNA, 30 bp, Homo sapiens; identical to SEQ ID NO: 78187
  misc_feature 1..30: note = chr15:92687159-92687189
  misc_feature 1..30: note = Hypo
  source 1..30: mol_type = genomic DNA

SEQ ID NO: 111059 - DNA, 221 bp, Homo sapiens; identical to SEQ ID NO: 78188
  misc_feature 1..221: note = chr15:92701704-92701925
  misc_feature 1..221: note = Hypo
  source 1..221: mol_type = genomic DNA

SEQ ID NO: 111060 - DNA, 30 bp, Homo sapiens; identical to SEQ ID NO: 78189
  misc_feature 1..30: note = chr15:92911893-92911923
  misc_feature 1..30: note = Hypo
  source 1..30: mol_type = genomic DNA

SEQ ID NO: 111061 - DNA, 80 bp, Homo sapiens; identical to SEQ ID NO: 78190
  misc_feature 1..80: note = chr15:92936360-92936440
  misc_feature 1..80: note = Hyper
  source 1..80: mol_type = genomic DNA

SEQ ID NO: 111062 - DNA, 1872 bp, Homo sapiens
  misc_feature 1..1872: note = chr15:92936662-92938534
  misc_feature 1..1872: note = Hyper
  source 1..1872: mol_type = genomic DNA
ctgcctggctgaaaccgccttctcgccgcgcgctgggggctgtccccaggtgttggtctttgtgtcgagaaaactttgcgaggaggcgagggagctggacaaagagcgggcgagggagggcgtttgccagcctgaggggtgcgccgggcggtgcgcgcacttccctgggctcagctccgtacccggtcgctcgcggtggccagagcccagtctctctaggccaggagtggcgtccggctgcatccccgcgccctcgggagctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggactcgcccaccctgcccccctgcctggcgtgtccaagcgcagtgtcgccggggtcgagggagggcgccggggagtgtctcgggcgggcggaggggccgagagtggagggaggcaggagtttctttgtctccagcacggccgctttctcgccttggcaaagtgggcagggggcgcgcagggatctctgagctgggggaggggttcctggggccggagcggagggcggggttctgcatgggctactgggaagcggaatgtcccctgcacacacagacaggcacacgcgcctcccgccggcccgggagcccggcgtaggagctggcaccactagagaagggctcgcatagctggactgagaccccccgccctcgcctggctttggacgttcagccaagccacggcaaccccggcgaccctgggttcctgtgcgctcgcagcgcggagacggagacatttcgggaaagtctgtaccgccgcccggtgggcttctgggccctcaggcgggcgatctggcgctttttttctcccgacctcgccagaggtagggtgggaccgcgagcccggatcctcccggctccggacttcctggagtgcgcacttgaggcgcgggacgcaccggctgtgtgtcccaggggctgagactcgcgccccgccccgcagccttcggctcgccgggccgggcccctctccggaacctccaaagggcggtagacgacaggtggggaggcagccggggttctgaggaggcccgaggagagcttcctggccctgggcaaggggaaggtgaggtctcaaagagggcagaaggtctcttcttctgtgggatttgtgctctgccaggcgctcttctcgagtcccgcgccgcgtgcgcccctcctttgtc

SEQ ID NO: 111063 - DNA, 193 bp, Homo sapiens; identical to SEQ ID NO: 78196
  misc_feature 1..193: note = chr15:93160460-93160653
  misc_feature 1..193: note = Hypo
  source 1..193: mol_type = genomic DNA

SEQ ID NO: 111064 - DNA, 649 bp, Homo sapiens; identical to SEQ ID NO: 78197
  misc_feature 1..649: note = chr15:93198390-93199039
  misc_feature 1..649: note = Hyper
  source 1..649: mol_type = genomic DNA

SEQ ID NO: 111065 - DNA, 346 bp, Homo sapiens; identical to SEQ ID NO: 78198
  misc_feature 1..346: note = chr15:93257518-93257864
  misc_feature 1..346: note = Hyper
  source 1..346: mol_type = genomic DNA

SEQ ID NO: 111066 - DNA, 160 bp, Homo sapiens; identical to SEQ ID NO: 78199
  misc_feature 1..160: note = chr15:93360190-93360350
  misc_feature 1..160: note = Hypo
  source 1..160: mol_type = genomic DNA

SEQ ID NO: 111067 - DNA, 141 bp, Homo sapiens; identical to SEQ ID NO: 78200
  misc_feature 1..141: note = chr15:93364648-93364789
  misc_feature 1..141: note = Hypo
  source 1..141: mol_type = genomic DNA

SEQ ID NO: 111068 - DNA, 340 bp, Homo sapiens; identical to SEQ ID NO: 78201
  misc_feature 1..340: note = chr15:93594841-93595181
  misc_feature 1..340: note = Hypo
  source 1..340: mol_type = genomic DNA

SEQ ID NO: 111069 - DNA, 98 bp, Homo sapiens; identical to SEQ ID NO: 78202
  misc_feature 1..98: note = chr15:93595410-93595508
  misc_feature 1..98: note = Hypo
  source 1..98: mol_type = genomic DNA

SEQ ID NO: 111070 - DNA, 589 bp, Homo sapiens; identical to SEQ ID NO: 78203
  misc_feature 1..589: note = chr15:93609289-93609878
  misc_feature 1..589: note = Hypo
  source 1..589: mol_type = genomic DNA

SEQ ID NO: 111071 - DNA, 84 bp, Homo sapiens; identical to SEQ ID NO: 78204
  misc_feature 1..84: note = chr15:93615607-93615691
  misc_feature 1..84: note = Hyper
  source 1..84: mol_type = genomic DNA

SEQ ID NO: 111072 - DNA, 852 bp, Homo sapiens
  misc_feature 1..852: note = chr15:93615901-93616753
  misc_feature 1..852: note = Hyper
  source 1..852: mol_type = genomic DNA
tgcgccctccccacacggctccatctcacggcaactcgggcagggtgcccctctccgggtccccaagggcaggcatcgcacccacgacggggtgcgggagaaacaaaagacccgtggaaataggaggcggggtccggaggaggtccggagaacttgagcccggactcactcgcgcacatctggcccagcattgaggggcggcccagggacccggccccgcgcgcccggccggcagtgccttacctgcggggaagctgcagagaaggaaggcgagggtcggccagaatcccagggctgaacgtcctgcccctctccccatacccatccatccagctcggcctgttaccactagcctctccctggaagaagagttcagaaaaaaagaagaaaataaatcacgctgcgaagaaagggcagcctcgctccgccggcgggagcagcgagccgggaggctccgtccacctcggccgcgggcgcccggcgcgctccccttcccgcgccgccccccgcgcgcccctccctcgccatccatcactcggttctccgccaatgtcgacgcggccccgcgccccagccgcctgcgcaccgccccctcgcgctcgggtttcagcgaggccggcgaggtagccggaggcggccgggcggggacccaggctgcccggccgcagcgctcgccgtgaggacctcggaaaaccacggccctagatcagagggcgcgccacgctccccgaccctcgcgccatctccagcccgcggctgtccttgcaaaccaggcccagcacccttgggaggccgcagggcatgaggcggggcaggacgcccccttaatcccctccacgaatatccaatcca

SEQ ID NO: 111073 - DNA, 1721 bp, Homo sapiens
  misc_feature 1..1721: note = chr15:93631545-93633266
  misc_feature 1..1721: note = Hyper
  source 1..1721: mol_type = genomic DNA
gtcgccgtgccctcccgtccacttaggaaagccggggcggcttggcaatgggcatcctcggccctcaatccaaggtccgcaccttcccgtacgccggcgcgccgaggcaaagggccgccgggacgcgagcccacgcggtgcactgcgccgacatccccgagggcaggagatggccaggcagctccgcagccgggcgtcgagcgggaggcgggggcccgggcggcgcgggccaatgggggttcacggcgggacagtcgggtggccggctccgtccggggctccgcgagccgggctgagggaaggagctcccagcccgcacacggtgtaagggacgtgtgccgggtctgcccaaccacgcgcgctggcggctgcccgggggagagtattttaggaaaaaagaacaaacaccaaaccacaaaaactttcctgctgccaacagctaaagcgatagaggcgcagcaaagctccaaatgtgggcaagatgggagcaagatgagacgcggggctaaggaagaccaaagcagcgccgtggccccggcatgtgtcggcggcgcctcggagatgtcagagccgggtctgcccggctcccgacccgcgcttaccttggcggctgcatgagcccctgcggcccgcggggggtggcgctggcggggctgcgggagaagagggggtgtcggggcgccgctcgtctgccccggggcaaggtgggaggggctccgctggcgctggtccccgccgccccggccggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagcaccggctgggtgggtgcggagtgcgccagcggccaagtcaagactccttgaatgctcaggttagggggcgcgggcggcaagtgcggcgactccccggggcgcctccaactttccgaatcgcccgcagggttgcggtggagcgcacggtgtccttcagttaggcggtggtcgaggggagttcctctgagatttctggagaaggcggttacatccaagacaaatgctgttgcgctctgcggagacgcacctttgttctatagagattttgttgttgtttaagaatcttcctgaaaaaactaatacatatgtattacatgctaacacacgcatacattcttgcgtagaattgtacataactcaggagtgtctagagtgaaaagaccgtatcgcactccctcccacggccgcggctctcccacggccgcggctcccccgcggtaaccttcggtcagggtgtgctctgccgcggttctttccagtctctgcgcttttacatgcacacgcacagattgcgagtggaatctcctgggcttttcaaaagaatgttttcaacattaagcgcatgcacacagtggcttgaacacggccacgtcgggagcagtaaatc

SEQ ID NO: 111074 - DNA, 30 bp, Homo sapiens; identical to SEQ ID NO: 78209
  misc_feature 1..30: note = chr15:93689707-93689737
  misc_feature 1..30: note = Hypo
  source 1..30: mol_type = genomic DNA

SEQ ID NO: 111075 - DNA, 39 bp, Homo sapiens; identical to SEQ ID NO: 78210
  misc_feature 1..39: note = chr15:93792256-93792295
  misc_feature 1..39: note = Hypo
  source 1..39: mol_type = genomic DNA

SEQ ID NO: 111076 - DNA, 156 bp, Homo sapiens; identical to SEQ ID NO: 78211
  misc_feature 1..156: note = chr15:93798049-93798205
  misc_feature 1..156: note = Hypo
  source 1..156: mol_type = genomic DNA

SEQ ID NO: 111077 - DNA, 185 bp, Homo sapiens; identical to SEQ ID NO: 78212
  misc_feature 1..185: note = chr15:93820319-93820504
  misc_feature 1..185: note = Hypo
  source 1..185: mol_type = genomic DNA

SEQ ID NO: 111078 - DNA, 33 bp, Homo sapiens; identical to SEQ ID NO: 44362
  misc_feature 1..33: note = chr15:93902389-93902422
  misc_feature 1..33: note = Hypo
  source 1..33: mol_type = genomic DNA

SEQ ID NO: 111079 - DNA, 30 bp, Homo sapiens; identical to SEQ ID NO: 15927
  misc_feature 1..30: note = chr15:94347602-94347632
  misc_feature 1..30: note = Hypo
  source 1..30: mol_type = genomic DNA

SEQ ID NO: 111080 - DNA, 30 bp, Homo sapiens; identical to SEQ ID NO: 78215
  misc_feature 1..30: note = chr15:94347911-94347941
  misc_feature 1..30: note = Hypo
  source 1..30: mol_type = genomic DNA

SEQ ID NO: 111081 - DNA, 157 bp, Homo sapiens; identical to SEQ ID NO: 78216
  misc_feature 1..157: note = chr15:94443196-94443353
  misc_feature 1..157: note = Hypo
  source 1..157: mol_type = genomic DNA

SEQ ID NO: 111082 - DNA, 40 bp, Homo sapiens; identical to SEQ ID NO: 44364
  misc_feature 1..40: note = chr15:94478454-94478494
  misc_feature 1..40: note = Hypo
  source 1..40: mol_type = genomic DNA

SEQ ID NO: 111083 - DNA, 197 bp, Homo sapiens; identical to SEQ ID NO: 78218
  misc_feature 1..197: note = chr15:94495950-94496147
  misc_feature 1..197: note = Hypo
  source 1..197: mol_type = genomic DNA

SEQ ID NO: 111084 - DNA, 19 bp, Homo sapiens
  misc_feature 1..19: note = chr15:94557099-94557118
  misc_feature 1..19: note = Hypo
  source 1..19: mol_type = genomic DNA
tttttttttttgagacgga

SEQ ID NO: 111085 - DNA, 30 bp, Homo sapiens; identical to SEQ ID NO: 78220
  misc_feature 1..30: note = chr15:94736260-94736290
  misc_feature 1..30: note = Hypo
  source 1..30: mol_type = genomic DNA

SEQ ID NO: 111086 - DNA, 33 bp, Homo sapiens; identical to SEQ ID NO: 78221
  misc_feature 1..33: note = chr15:94774077-94774110
  misc_feature 1..33: note = Hyper
  source 1..33: mol_type = genomic DNA

SEQ ID NO: 111087 - DNA, 23 bp, Homo sapiens
  misc_feature 1..23: note = chr15:94778186-94778209
  misc_feature 1..23: note = Hypo
  source 1..23: mol_type = genomic DNA
agccctggtggtggtcgggcaca

SEQ ID NO: 111088 - DNA, 30 bp, Homo sapiens; identical to SEQ ID NO: 44365
  misc_feature 1..30: note = chr15:94925846-94925876
  misc_feature 1..30: note = Hypo
  source 1..30: mol_type = genomic DNA

SEQ ID NO: 111089 - DNA, 30 bp, Homo sapiens
  misc_feature 1..30: note = chr15:95388121-95388151
  misc_feature 1..30: note = Hyper
  source 1..30: mol_type = genomic DNA
tggggctgcgcgccccgccgggcccggaga

SEQ ID NO: 111090 - DNA, 371 bp, Homo sapiens
  misc_feature 1..371: note = chr15:95388358-95388729
  misc_feature 1..371: note = Hyper
  source 1..371: mol_type = genomic DNA
ctcgcggcctcctggcgaggcgcggccggcggaaaagcttggtggggtggccgcggcagcgacacgcgcggccggccccgggaaaacaaaggggggatgtgtgtggccaagagtccggaaatggggcgccggtgggggccggggcggcgcagctctgcctcctggagcctattgtttgccgggtgcacatgcacacgcgcttaacaagaaattaacacatcctgccgccgcttatctatccatcgatggccaaacagacggcgcagtcactttgcacggagagggcttttaatgtaatgaccaggccggagaagaatatctcaagcccttcgtagaagttcctctttgtttccgtacggcccttgatacca

SEQ ID NO: 111091 - DNA, 22 bp, Homo sapiens
  misc_feature 1..22: note = chr15:95507939-95507961
  misc_feature 1..22: note = Hypo
  source 1..22: mol_type = genomic DNA
ccgcgcccggccaagttctggt

SEQ ID NO: 111092 - DNA, 125 bp, Homo sapiens; identical to SEQ ID NO: 78226
  misc_feature 1..125: note = chr15:95634811-95634936
  misc_feature 1..125: note = Hypo
  source 1..125: mol_type = genomic DNA

SEQ ID NO: 111093 - DNA, 30 bp, Homo sapiens; identical to SEQ ID NO: 78227
  misc_feature 1..30: note = chr15:96663096-96663126
  misc_feature 1..30: note = Hypo
  source 1..30: mol_type = genomic DNA

SEQ ID NO: 111094 - DNA, 30 bp, Homo sapiens
  misc_feature 1..30: note = chr15:96864245-96864275
  misc_feature 1..30: note = Hyper
  source 1..30: mol_type = genomic DNA
gaattggaggattaccggggaaggaatgcg

SEQ ID NO: 111095 - DNA, 105 bp, Homo sapiens; identical to SEQ ID NO: 78228
  misc_feature 1..105: note = chr15:96864500-96864605
  misc_feature 1..105: note = Hyper
  source 1..105: mol_type = genomic DNA

SEQ ID NO: 111096 - DNA, 268 bp, Homo sapiens; identical to SEQ ID NO: 78229
  misc_feature 1..268: note = chr15:96864954-96865222
  misc_feature 1..268: note = Hyper
  source 1..268: mol_type = genomic DNA

SEQ ID NO: 111097 - DNA, 30 bp, Homo sapiens; identical to SEQ ID NO: 78230
  misc_feature 1..30: note = chr15:96865796-96865826
  misc_feature 1..30: note = Hyper
  source 1..30: mol_type = genomic DNA

SEQ ID NO: 111098 - DNA, 75 bp, Homo sapiens; identical to SEQ ID NO: 78231
  misc_feature 1..75: note = chr15:96874258-96874333
  misc_feature 1..75: note = Hyper
  source 1..75: mol_type = genomic DNA

SEQ ID NO: 111099 - DNA, 84 bp, Homo sapiens; identical to SEQ ID NO: 78232
  misc_feature 1..84: note = chr15:96876537-96876621
  misc_feature 1..84: note = Hyper
  source 1..84: mol_type = genomic DNA

SEQ ID NO: 111100 - DNA, 30 bp, Homo sapiens; identical to SEQ ID NO: 78233
  misc_feature 1..30: note = chr15:96883798-96883828
  misc_feature 1..30: note = Hyper
  source 1..30: mol_type = genomic DNA

SEQ ID NO: 111101 - DNA, 74 bp, Homo sapiens; identical to SEQ ID NO: 35961
  misc_feature 1..74: note = chr15:96884425-96884499
  misc_feature 1..74: note = Hyper
  source 1..74: mol_type = genomic DNA

SEQ ID NO: 111102 - DNA, 30 bp, Homo sapiens; identical to SEQ ID NO: 78235
  misc_feature 1..30: note = chr15:96889448-96889478
  misc_feature 1..30: note = Hyper
  source 1..30: mol_type = genomic DNA

SEQ ID NO: 111103 - DNA, 295 bp, Homo sapiens; identical to SEQ ID NO: 78236
  misc_feature 1..295: note = chr15:96897310-96897605
  misc_feature 1..295: note = Hyper
  source 1..295: mol_type = genomic DNA

SEQ ID NO: 111104 - DNA, 240 bp, Homo sapiens; identical to SEQ ID NO: 78237
  misc_feature 1..240: note = chr15:96897853-96898093
  misc_feature 1..240: note = Hyper
  source 1..240: mol_type = genomic DNA

SEQ ID NO: 111105 - DNA, 43 bp, Homo sapiens; identical to SEQ ID NO: 78238
  misc_feature 1..43: note = chr15:96903332-96903375
  misc_feature 1..43: note = Hyper
  source 1..43: mol_type = genomic DNA

SEQ ID NO: 111106 - DNA, 638 bp, Homo sapiens
  misc_feature 1..638: note = chr15:96911366-96912004
  misc_feature 1..638: note = Hyper
  source 1..638: mol_type = genomic DNA
gctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctctctccgttgatttggacgctgggaagctgcccgccgtccttccccaccccctttgcccagccttggcaagacctctccggaaacatactcgcgttaaggaactgggaaagcttcctggcccggagctaggagcccgacgttggggctccttgctgagtgagacgctcagtcctgtgctccccgccccgccccaggcgcccagtcccgctgggatccatctcctcagccccggtttcccgctctgcgagcgggggaagaacctgggaactgcaggatccgccacctcggtttttcagacacagcctctggcctctttccttggcctgccaaacctttgttcacttctctcacccgttgtctgctctgctctatccctcagcagggttctcgtttggacaagagggcccaatcctttgctttgctactcctcgcgtcttgtagaccct

SEQ ID NO: 111107 - DNA, 680 bp, Homo sapiens
  misc_feature 1..680: note = chr15:96952609-96953289
  misc_feature 1..680: note = Hyper
  source 1..680: mol_type = genomic DNA
actttctcccgcaaccgcgccccggaccgcagtaatcccggcggggcagggccggggagctggggacggggtggtctttagggtggcggcttcccccgaccccggacccgggaaccggccgccggcgcggggcgcgatctgcactgccggtcccacaggagttaaaccccgaggcagacaaaagggaggccgccgcggctcctttgctcggctgtcagttgaaaagagaaccgccgccctctggacttcaactcccgacggaaaaggcattttattatgggttatgacaagttgcagagagacgcggacaactcagtaagaaggagcggcgagcggaatcaaaaatgctcgagatgtttgcaagacagagcgaacacggcttcaaatgacaggtgttagcaggactccagacgggatctgcgggatcggccgggtgggagccgcaccgcacggcgccgggtcggggagagaacccggcctggggaggccgcggggtgcccccgccgcgccgcccaccagccccgcgcggcccggagccgaccccgcctcctcttccgaaagtcctaagtcaggacagcggcagatcgtcccagaaaatcagcgccaactccctctgctcaaatttgctactttgtgttttagttccaggcgggaagtctacactgcgctccctcccagcc

SEQ ID NO: 111108 - DNA, 67 bp, Homo sapiens; identical to SEQ ID NO: 78243
  misc_feature 1..67: note = chr15:96959305-96959372
  misc_feature 1..67: note = Hyper
  source 1..67: mol_type = genomic DNA

SEQ ID NO: 111109 - DNA, 456 bp, Homo sapiens
  misc_feature 1..456: note = chr15:96959693-96960149
  misc_feature 1..456: note = Hyper
  source 1..456: mol_type = genomic DNA
aagcgcgtgtgttaacgaaccccaagcgaatttcggggcttgaaagcgctaccggggcagccagattactacctcccactctcacctccatccctccccgccccttgcccgtcccacgggcctcagatttgggcgtagggctgggtagggcgcctgggaggagccagagggggcggatcaggccgggatttggcgccaggtacccccacccgcccgcgtcccggggtcgccagctgactccatgtgagcccacttggcaccggccccccgagggatcctgcgacgcgaggggtgcccatttgcagtgatccgcggactctcgaaccctaaaccccggggcccagctctgccccggcgtggatcttcgggaaaccggagcggaggctcgtggagacctgggaggagctgcgctgactggggcaggggacgcccagattggatcggttccgagctctc

SEQ ID NO: 111110 - DNA, 318 bp, Homo sapiens; identical to SEQ ID NO: 78245
  misc_feature 1..318: note = chr15:96960508-96960826
  misc_feature 1..318: note = Hyper
  source 1..318: mol_type = genomic DNA

SEQ ID NO: 111111 - DNA, 180 bp, Homo sapiens; identical to SEQ ID NO: 44366
  misc_feature 1..180: note = chr15:97006353-97006533
  misc_feature 1..180: note = Hypo
  source 1..180: mol_type = genomic DNA

SEQ ID NO: 111112 - DNA, 30 bp, Homo sapiens; identical to SEQ ID NO: 78247
  misc_feature 1..30: note = chr15:97395096-97395126
  misc_feature 1..30: note = Hypo
  source 1..30: mol_type = genomic DNA

SEQ ID NO: 111113 - DNA, 30 bp, Homo sapiens; identical to SEQ ID NO: 78248
  misc_feature 1..30: note = chr15:97894937-97894967
  misc_feature 1..30: note = Hypo
  source 1..30: mol_type = genomic DNA

SEQ ID NO: 111114 - DNA, 30 bp, Homo sapiens; identical to SEQ ID NO: 44367
  misc_feature 1..30: note = chr15:98417575-98417605
  misc_feature 1..30: note = Hypo
  source 1..30: mol_type = genomic DNA

SEQ ID NO: 111115 - DNA, 24 bp, Homo sapiens
  misc_feature 1..24: note = chr15:98454971-98454995
  misc_feature 1..24: note = Hypo
  source 1..24: mol_type = genomic DNA
cacccggcccggcacatttatttt

SEQ ID NO: 111116 - DNA, 114 bp, Homo sapiens; identical to SEQ ID NO: 78251
  misc_feature 1..114: note = chr15:98504114-98504228
  misc_feature 1..114: note = Hyper
  source 1..114: mol_type = genomic DNA

SEQ ID NO: 111117 - DNA, 41 bp, Homo sapiens; identical to SEQ ID NO: 78252
  misc_feature 1..41: note = chr15:98776804-98776845
  misc_feature 1..41: note = Hypo
  source 1..41: mol_type = genomic DNA

SEQ ID NO: 111118 - DNA, 372 bp, Homo sapiens; identical to SEQ ID NO: 35973
  misc_feature 1..372: note = chr15:98836021-98836393
  misc_feature 1..372: note = Hyper
  source 1..372: mol_type = genomic DNA

SEQ ID NO: 111119 - DNA, 114 bp, Homo sapiens; identical to SEQ ID NO: 78254
  misc_feature 1..114: note = chr15:98961307-98961421
  misc_feature 1..114: note = Hypo
  source 1..114: mol_type = genomic DNA

SEQ ID NO: 111120 - DNA, 109 bp, Homo sapiens; identical to SEQ ID NO: 35974
  misc_feature 1..109: note = chr15:98965273-98965382
  misc_feature 1..109: note = Hyper
  source 1..109: mol_type = genomic DNA

SEQ ID NO: 111121 - DNA, 302 bp, Homo sapiens; identical to SEQ ID NO: 78256
  misc_feature 1..302: note = chr15:98971690-98971992
  misc_feature 1..302: note = Hyper
  source 1..302: mol_type = genomic DNA

SEQ ID NO: 111122 - DNA, 254 bp, Homo sapiens; identical to SEQ ID NO: 78257
  misc_feature 1..254: note = chr15:99091118-99091372
  misc_feature 1..254: note = Hyper
  source 1..254: mol_type = genomic DNA

SEQ ID NO: 111123 - DNA, 55 bp, Homo sapiens; identical to SEQ ID NO: 78258
  misc_feature 1..55: note = chr15:99091608-99091663
  misc_feature 1..55: note = Hyper
  source 1..55: mol_type = genomic DNA

SEQ ID NO: 111124 - DNA, 30 bp, Homo sapiens; identical to SEQ ID NO: 78259
  misc_feature 1..30: note = chr15:99168900-99168930
  misc_feature 1..30: note = Hypo
  source 1..30: mol_type = genomic DNA

SEQ ID NO: 111125 - DNA, 90 bp, Homo sapiens; identical to SEQ ID NO: 44371
  misc_feature 1..90: note = chr15:99183400-99183490
  misc_feature 1..90: note = Hypo
  source 1..90: mol_type = genomic DNA

SEQ ID NO: 111126 - DNA, 39 bp, Homo sapiens; identical to SEQ ID NO: 78261
  misc_feature 1..39: note = chr15:99192902-99192941
  misc_feature 1..39: note = Hyper
  source 1..39: mol_type = genomic DNA

SEQ ID NO: 111127 - DNA, 37 bp, Homo sapiens; identical to SEQ ID NO: 78262
  misc_feature 1..37: note = chr15:99193206-99193243
  misc_feature 1..37: note = Hyper
  source 1..37: mol_type = genomic DNA

SEQ ID NO: 111128 - DNA, 216 bp, Homo sapiens
  misc_feature 1..216: note = chr15:99193451-99193667
  misc_feature 1..216: note = Hyper
  source 1..216: mol_type = genomic DNA
gaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctca

SEQ ID NO: 111129 - DNA, 95 bp, Homo sapiens; identical to SEQ ID NO: 35977
  misc_feature 1..95: note = chr15:99193974-99194069
  misc_feature 1..95: note = Hyper
  source 1..95: mol_type = genomic DNA

SEQ ID NO: 111130 - DNA, 260 bp, Homo sapiens; identical to SEQ ID NO: 78265
  misc_feature 1..260: note = chr15:99250288-99250548
  misc_feature 1..260: note = Hypo
  source 1..260: mol_type = genomic DNA

SEQ ID NO: 111131 - DNA, 127 bp, Homo sapiens; identical to SEQ ID NO: 78266
  misc_feature 1..127: note = chr15:99254559-99254686
  misc_feature 1..127: note = Hypo
  source 1..127: mol_type = genomic DNA

SEQ ID NO: 111132 - DNA, 18 bp, Homo sapiens
  misc_feature 1..18: note = chr15:99295597-99295615
  misc_feature 1..18: note = Hypo
  source 1..18: mol_type = genomic DNA
tagagtgtttattaacga

SEQ ID NO: 111133 - DNA, 30 bp, Homo sapiens; identical to SEQ ID NO: 78268
  misc_feature 1..30: note = chr15:99347955-99347985
  misc_feature 1..30: note = Hypo
  source 1..30: mol_type = genomic DNA

SEQ ID NO: 111134 - DNA, 30 bp, Homo sapiens; identical to SEQ ID NO: 78269
  misc_feature 1..30: note = chr15:99428631-99428661
  misc_feature 1..30: note = Hypo
  source 1..30: mol_type = genomic DNA

SEQ ID NO: 111135 - DNA, 47 bp, Homo sapiens; identical to SEQ ID NO: 78270
  misc_feature 1..47: note = chr15:99454637-99454684
  misc_feature 1..47: note = Hypo
  source 1..47: mol_type = genomic DNA

SEQ ID NO: 111136 - DNA, 81 bp, Homo sapiens; identical to SEQ ID NO: 78271
  misc_feature 1..81: note = chr15:99456350-99456431
  misc_feature 1..81: note = Hypo
  source 1..81: mol_type = genomic DNA

SEQ ID NO: 111137 - DNA, 54 bp, Homo sapiens; identical to SEQ ID NO: 78272
  misc_feature 1..54: note = chr15:99460214-99460268
  misc_feature 1..54: note = Hypo
  source 1..54: mol_type = genomic DNA

SEQ ID NO: 111138 - DNA, 38 bp, Homo sapiens; identical to SEQ ID NO: 44377
  misc_feature 1..38: note = chr15:99484067-99484105
  misc_feature 1..38: note = Hypo
  source 1..38: mol_type = genomic DNA

SEQ ID NO: 111139 - DNA, 132 bp, Homo sapiens; identical to SEQ ID NO: 15933
  misc_feature 1..132: note = chr15:99484456-99484588
  misc_feature 1..132: note = Hypo
  source 1..132: mol_type = genomic DNA

SEQ ID NO: 111140 - DNA, 30 bp, Homo sapiens; identical to SEQ ID NO: 78275
  misc_feature 1..30: note = chr15:99501229-99501259
  misc_feature 1..30: note = Hypo
  source 1..30: mol_type = genomic DNA

SEQ ID NO: 111141 - DNA, 123 bp, Homo sapiens; identical to SEQ ID NO: 78276
  misc_feature 1..123: note = chr15:99503981-99504104
  misc_feature 1..123: note = Hypo
  source 1..123: mol_type = genomic DNA

SEQ ID NO: 111142 - DNA, 30 bp, Homo sapiens; identical to SEQ ID NO: 44379
  misc_feature 1..30: note = chr15:99506147-99506177
  misc_feature 1..30: note = Hypo
  source 1..30: mol_type = genomic DNA

SEQ ID NO: 111143 - DNA, 30 bp, Homo sapiens; identical to SEQ ID NO: 78278
  misc_feature 1..30: note = chr15:99507385-99507415
  misc_feature 1..30: note = Hypo
  source 1..30: mol_type = genomic DNA

SEQ ID NO: 111144 - DNA, 30 bp, Homo sapiens; identical to SEQ ID NO: 44380
  misc_feature 1..30: note = chr15:99974913-99974943
  misc_feature 1..30: note = Hypo
  source 1..30: mol_type = genomic DNA

SEQ ID NO: 111145 - DNA, 30 bp, Homo sapiens; identical to SEQ ID NO: 44381
  misc_feature 1..30: note = chr15:99981097-99981127
  misc_feature 1..30: note = Hypo
  source 1..30: mol_type = genomic DNA

SEQ ID NO: 111146 - DNA, 28 bp, Homo sapiens
  misc_feature 1..28: note = chr15:100274301-100274329
  misc_feature 1..28: note = Hypo
  source 1..28: mol_type = genomic DNA
gcggtggctcacgcccgtaatcccagca

SEQ ID NO: 111147 - DNA, 39 bp, Homo sapiens; identical to SEQ ID NO: 77344
  misc_feature 1..39: note = chr15:100346202-100346241
  misc_feature 1..39: note = Hyper
  source 1..39: mol_type = genomic DNA

SEQ ID NO: 111148 - DNA, 60 bp, Homo sapiens; identical to SEQ ID NO: 77345
  misc_feature 1..60: note = chr15:100378951-100379011
  misc_feature 1..60: note = Hypo
  source 1..60: mol_type = genomic DNA

SEQ ID NO: 111149 - DNA, 24 bp, Homo sapiens
  misc_feature 1..24: note = chr15:100426310-100426334
  misc_feature 1..24: note = Hypo
  source 1..24: mol_type = genomic DNA
aggcacggtggatcacgccggtaa

SEQ ID NO: 111150 - DNA, 834 bp, Homo sapiens
  misc_feature 1..834: note = chr15:100881258-100882092
  misc_feature 1..834: note = Hyper
  source 1..834: mol_type = genomic DNA
gccgcaggcgctgagcgagacgagggagccggggtggccgagcacacggcccgagtagaagcacagctcggcggggcggccgcggcgccgggccgcgcccgcctcctccacctcgaagcctcgggacaggaagcgcaggtcgcggcgcagctgaaggtacaggtcgcgcccgaaggccggcaggtgcagcagcagggcgcgctctccgggccgggcgcgcggggcggctgggggcgtgcgggggcgtcgccgccgtcggggcccgggggctgcgggcagcggcggcaggtgcacgtcgtcggggcgcacccgccacgggagcaccacctccacgtcggccgccgcgtcgccgacagctgcggggagagaggagacgcgtcagcgcggcggggcccgcccggacgcccgccctcccgctggccgccagccgcgccagcgcggggacagcgcgacccggagccggcgctgccttcccttccctcgcccggcacctccacgctggcccgcgccacccggggagggtctccggcgcagccgcgcgagcacctcccggaacggcgccgcgcatcggcgagcggagacccggcggcggcgcgcctgccacggagccacccgattcccgtactccggccgcggcccgcgcctcctccgctcgggcgccgtcagcggtcccgccgccgcccccgggccgccaggacgccgcgagaacgcagagggaaggtagccgcaggacgcggggtgaagagggctgtgggagggggcgctacctgtgcccgggtccagtccccaaaccagcagcagcagcacgggcaggacgagcggaggcagcagggc

SEQ ID NO: 111151 - DNA, 30 bp, Homo sapiens; identical to SEQ ID NO: 44383
  misc_feature 1..30: note = chr15:100888957-100888987
  misc_feature 1..30: note = Hypo
  source 1..30: mol_type = genomic DNA

SEQ ID NO: 111152 - DNA, 656 bp, Homo sapiens
  misc_feature 1..656: note = chr15:100913423-100914079
  misc_feature 1..656: note = Hyper
  source 1..656: mol_type = genomic DNA
cccagggcacccctccgacccccgctgcgaggggtttcccgcgggaggtggacgaagcgtgggccaggacaggcgcctggcactggggtttcagagccgcgagtaggccctgaaggccgggagggaccgccagtccccactggaagccgcttccgtgcagcccgggacaggtgcgcggcgcccctcgccttcgcctccgcttctgctcttcccctcgcggccccgcgcgcccgcgccctccgcccagaccccggtgcagcccggccaggcgcggcggcggcggcgtctccagcgagggaaggtcgtcctcacgcgctccggcctcagggcgcctctccgcccggcctcgcagccttcccgtcctgcccacggccgaggccgcggctgtcggggtggcctggacgggtgcagggctgggcgggggcggcaggacttgaaccggcgcctgctctcgcggaggcagcagcagagctcacccctttctcgggaaatggtttatcgtggataaaacgcagtccccaaagcgaaggtccgacgggcggccagacgcaccccggggaccttcaggtggacacacggggcctccgcgcgccgagccgcgagggaagaggggcggcgggagggagggagcagtgggcggccggggagcctggcag

SEQ ID NO: 111153 - DNA, 30 bp, Homo sapiens; identical to SEQ ID NO: 77352
  misc_feature 1..30: note = chr15:101089996-101090026
  misc_feature 1..30: note = Hypo
  source 1..30: mol_type = genomic DNA

SEQ ID NO: 111154 - DNA, 30 bp, Homo sapiens; identical to SEQ ID NO: 77353
  misc_feature 1..30: note = chr15:101417814-101417844
  misc_feature 1..30: note = Hypo
  source 1..30: mol_type = genomic DNA

SEQ ID NO: 111155 - DNA, 30 bp, Homo sapiens; identical to SEQ ID NO: 77354
  misc_feature 1..30: note = chr15:101419441-101419471
  misc_feature 1..30: note = Hyper
  source 1..30: mol_type = genomic DNA

SEQ ID NO: 111156 - DNA, 655 bp, Homo sapiens
  misc_feature 1..655: note = chr15:101420348-101421003
  misc_feature 1..655: note = Hyper
  source 1..655: mol_type = genomic DNA
cggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaa

SEQ ID NO: 111157 - DNA, 243 bp, Homo sapiens; identical to SEQ ID NO: 77359
  misc_feature 1..243: note = chr15:101459070-101459313
  misc_feature 1..243: note = Hyper
  source 1..243: mol_type = genomic DNA

SEQ ID NO: 111158 - DNA, 329 bp, Homo sapiens; identical to SEQ ID NO: 77360
  misc_feature 1..329: note = chr15:101460006-101460335
  misc_feature 1..329: note = Hyper
  source 1..329: mol_type = genomic DNA

SEQ ID NO: 111159 - DNA, 313 bp, Homo sapiens
  misc_feature 1..313: note = chr15:101513556-101513869
  misc_feature 1..313: note = Hyper
  source 1..313: mol_type = genomic DNA
gttttctgggcagggcgggaaagcgtctggatgtccacacccccgggaggtggcctgtctttcccccgtgggcaccgcagcgggacagcgtggctgagacccgcggctctctcgccaaagcccctgcgcctccgctgctgtcggcgaggtcggcccggccgctcccccgcgggccgctgtccccggtgccctggaagggctccaggtggcggtctcgctgcagaatcctccgagctgcgctcgccgcccggtgccttcgcagcggccccggttgggttgcgggtcgcggggcggcgagcgcagggagcgtcgc

SEQ ID NO: 111160 - DNA, 30 bp, Homo sapiens; identical to SEQ ID NO: 77362
  misc_feature 1..30: note = chr15:101535285-101535315
  misc_feature 1..30: note = Hypo
  source 1..30: mol_type = genomic DNA

SEQ ID NO: 111161 - DNA, 34 bp, Homo sapiens; identical to SEQ ID NO: 77363
  misc_feature 1..34: note = chr15:101558833-101558867
  misc_feature 1..34: note = Hypo
  source 1..34: mol_type = genomic DNA

SEQ ID NO: 111162 - DNA, 30 bp, Homo sapiens; identical to SEQ ID NO: 77364
  misc_feature 1..30: note = chr15:101633788-101633818
  misc_feature 1..30: note = Hypo
  source 1..30: mol_type = genomic DNA

SEQ ID NO: 111163 - DNA, 126 bp, Homo sapiens; identical to SEQ ID NO: 77365
  misc_feature 1..126: note = chr15:101785815-101785941
  misc_feature 1..126: note = Hypo
  source 1..126: mol_type = genomic DNA

SEQ ID NO: 111164 - DNA, 30 bp, Homo sapiens; identical to SEQ ID NO: 77366
  misc_feature 1..30: note = chr15:101889834-101889864
  misc_feature 1..30: note = Hypo
  source 1..30: mol_type = genomic DNA

SEQ ID NO: 111165 - DNA, 151 bp, Homo sapiens; identical to SEQ ID NO: 77367
  misc_feature 1..151: note = chr15:102028841-102028992
  misc_feature 1..151: note = Hyper
  source 1..151: mol_type = genomic DNA

SEQ ID NO: 111166 - DNA, 374 bp, Homo sapiens; identical to SEQ ID NO: 77368
  misc_feature 1..374: note = chr15:102042955-102043329
  misc_feature 1..374: note = Hypo
  source 1..374: mol_type = genomic DNA

SEQ ID NO: 111167 - DNA, 40 bp, Homo sapiens; identical to SEQ ID NO: 77369
  misc_feature 1..40: note = chr15:102043695-102043735
  misc_feature 1..40: note = Hypo
  source 1..40: mol_type = genomic DNA

SEQ ID NO: 111168 - DNA, 47 bp, Homo sapiens; identical to SEQ ID NO: 77370
  misc_feature 1..47: note = chr15:102096642-102096689
  misc_feature 1..47: note = Hypo
  source 1..47: mol_type = genomic DNA

SEQ ID NO: 111169 - DNA, 160 bp, Homo sapiens; identical to SEQ ID NO: 77371
  misc_feature 1..160: note = chr15:102154203-102154363
  misc_feature 1..160: note = Hypo
  source 1..160: mol_type = genomic DNA

SEQ ID NO: 111170 - DNA, 22 bp, Homo sapiens
  misc_feature 1..22: note = chr15:102193729-102193751
  misc_feature 1..22: note = Hypo
  source 1..22: mol_type = genomic DNA
gagactccgtctcaaaaaataa

SEQ ID NO: 111171 - DNA, 30 bp, Homo sapiens; identical to SEQ ID NO: 77373
  misc_feature 1..30: note = chr15:102270624-102270654
  misc_feature 1..30: note = Hypo
  source 1..30: mol_type = genomic DNA

SEQ ID NO: 111172 - DNA, 30 bp, Homo sapiens; identical to SEQ ID NO: 44386
  misc_feature 1..30: note = chr15:102276370-102276400
  misc_feature 1..30: note = Hypo
  source 1..30: mol_type = genomic DNA

SEQ ID NO: 111173 - DNA, 39 bp, Homo sapiens; identical to SEQ ID NO: 77375
  misc_feature 1..39: note = chr15:102306422-102306461
  misc_feature 1..39: note = Hypo
  source 1..39: mol_type = genomic DNA

SEQ ID NO: 111174 - DNA, 34 bp, Homo sapiens; identical to SEQ ID NO: 78343
  misc_feature 1..34: note = chr16:114441-114475
  misc_feature 1..34: note = Hypo
  source 1..34: mol_type = genomic DNA

SEQ ID NO: 111175 - DNA, 57 bp, Homo sapiens; identical to SEQ ID NO: 15935
  misc_feature 1..57: note = chr16:142626-142683
  misc_feature 1..57: note = Hypo
  source 1..57: mol_type = genomic DNA

SEQ ID NO: 111176 - DNA, 23 bp, Homo sapiens
  misc_feature 1..23: note = chr16:192028-192051
  misc_feature 1..23: note = Hypo
  source 1..23: mol_type = genomic DNA
accgtgcccggcctgcataacat

SEQ ID NO: 111177 - DNA, 106 bp, Homo sapiens
  misc_feature 1..106: note = chr16:204415-204521
  misc_feature 1..106: note = Hyper
  source 1..106: mol_type = genomic DNA
ccccaggacaggctgcggcccctcccccgtcctggaggttccccagccccacttaccgcgtaatgcgccaataaaccaatgaacgaagcagcgtccacctggtctc

SEQ ID NO: 111178 - DNA, 23 bp, Homo sapiens
  misc_feature 1..23: note = chr16:208745-208768
  misc_feature 1..23: note = Hypo
  source 1..23: mol_type = genomic DNA
ttttcttttttgagacggaatct

SEQ ID NO: 111179 - DNA, 1852 bp, Homo sapiens
  misc_feature 1..1852: note = chr16:215124-216976
  misc_feature 1..1852: note = Hyper
  source 1..1852: mol_type = genomic DNA
atcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccggcgcaggccgagggtccccgcgttcccgccgcgctcgggccgataaggacgggcggggtgcccggaggctctataaggaggccagggcggcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccggtgaggcctttccggccggggcaatggtgcagcgcgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttg

SEQ ID NO: 111180 - DNA, 214 bp, Homo sapiens; identical to SEQ ID NO: 78634
  misc_feature 1..214: note = chr16:223318-223532
  misc_feature 1..214: note = Hyper
  source 1..214: mol_type = genomic DNA

SEQ ID NO: 111181 - DNA, 856 bp, Homo sapiens
  misc_feature 1..856: note = chr16:230196-231052
  misc_feature 1..856: note = Hyper
  source 1..856: mol_type = genomic DNA
ggaatggcgccactgcactcaccgcacccggccaatttttgtgtttttagtagagactaaataccatatagtgaacacctaagacggggggccttggatccagggcgattcagagggccccggtcggagctgtcggagattgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtc

SEQ ID NO: 111182 - DNA, 99 bp, Homo sapiens; identical to SEQ ID NO: 78662
  misc_feature 1..99: note = chr16:233798-233897
  misc_feature 1..99: note = Hypo
  source 1..99: mol_type = genomic DNA

SEQ ID NO: 111183 - DNA, 32 bp, Homo sapiens; identical to SEQ ID NO: 78750
  misc_feature 1..32: note = chr16:280197-280229
  misc_feature 1..32: note = Hypo
  source 1..32: mol_type = genomic DNA

SEQ ID NO: 111184 - DNA, 34 bp, Homo sapiens; identical to SEQ ID NO: 78804
  misc_feature 1..34: note = chr16:299951-299985
  misc_feature 1..34: note = Hypo
  source 1..34: mol_type = genomic DNA

SEQ ID NO: 111185 - DNA, 154 bp, Homo sapiens; identical to SEQ ID NO: 78809
  misc_feature 1..154: note = chr16:300225-300379
  misc_feature 1..154: note = Hypo
  source 1..154: mol_type = genomic DNA

SEQ ID NO: 111186 - DNA, 197 bp, Homo sapiens; identical to SEQ ID NO: 78887
  misc_feature 1..197: note = chr16:318060-318257
  misc_feature 1..197: note = Hypo
  source 1..197: mol_type = genomic DNA

SEQ ID NO: 111187 - DNA, 309 bp, Homo sapiens
  misc_feature 1..309: note = chr16:318498-318807
  misc_feature 1..309: note = Hypo
  source 1..309: mol_type = genomic DNA
agcaaggccagctcacgaaggaagacttgggcagggaggatcagggacgcctggcaaggatccaccctatggaatcgggcctcgtcagtggggtgacaatgtcagagttgtctataaatcgggggggaggccgcggcctcgaggtgggaaagcaggtgccggcgcacctgtggacaaattctggaacgcgtttggcgagggaggaataggcgcagctccggaaggcagtgacctcgaggcagcctcagcacggcactctcttgggtcctcttccaggctcacactgggcgacagcggagaggctcttgg

SEQ ID NO: 111188 - DNA, 38 bp, Homo sapiens; identical to SEQ ID NO: 44391
  misc_feature 1..38: note = chr16:319924-319962
  misc_feature 1..38: note = Hypo
  source 1..38: mol_type = genomic DNA

SEQ ID NO: 111189 - DNA, 18 bp, Homo sapiens
  misc_feature 1..18: note = chr16:322126-322144
  misc_feature 1..18: note = Hypo
  source 1..18: mol_type = genomic DNA
gcccggcctaatatgtca

SEQ ID NO: 111190 - DNA, 181 bp, Homo sapiens; identical to SEQ ID NO: 78905
  misc_feature 1..181: note = chr16:323418-323599
  misc_feature 1..181: note = Hypo
  source 1..181: mol_type = genomic DNA

SEQ ID NO: 111191 - DNA, 30 bp, Homo sapiens; identical to SEQ ID NO: 78908
  misc_feature 1..30: note = chr16:323853-323883
  misc_feature 1..30: note = Hypo
  source 1..30: mol_type = genomic DNA

SEQ ID NO: 111192 - DNA, 57 bp, Homo sapiens; identical to SEQ ID NO: 78911
  misc_feature 1..57: note = chr16:324217-324274
  misc_feature 1..57: note = Hypo
  source 1..57: mol_type = genomic DNA

SEQ ID NO: 111193 - DNA, 48 bp, Homo sapiens; identical to SEQ ID NO: 78913
  misc_feature 1..48: note = chr16:325498-325546
  misc_feature 1..48: note = Hyper
  source 1..48: mol_type = genomic DNA

SEQ ID NO: 111194 - DNA, 285 bp, Homo sapiens; identical to SEQ ID NO: 78916
  misc_feature 1..285: note = chr16:330222-330507
  misc_feature 1..285: note = Hyper
  source 1..285: mol_type = genomic DNA

SEQ ID NO: 111195 - DNA, 57 bp, Homo sapiens; identical to SEQ ID NO: 78917
  misc_feature 1..57: note = chr16:330921-330978
  misc_feature 1..57: note = Hyper
  source 1..57: mol_type = genomic DNA

SEQ ID NO: 111196 - DNA, 153 bp, Homo sapiens; identical to SEQ ID NO: 78918
  misc_feature 1..153: note = chr16:332609-332762
  misc_feature 1..153: note = Hypo
  source 1..153: mol_type = genomic DNA

SEQ ID NO: 111197 - DNA, 256 bp, Homo sapiens; identical to SEQ ID NO: 78923
  misc_feature 1..256: note = chr16:337560-337816
  misc_feature 1..256: note = Hypo
  source 1..256: mol_type = genomic DNA

SEQ ID NO: 111198 - DNA, 30 bp, Homo sapiens; identical to SEQ ID NO: 78932
  misc_feature 1..30: note = chr16:351930-351960
  misc_feature 1..30: note = Hypo
  source 1..30: mol_type = genomic DNA

SEQ ID NO: 111199 - DNA, 30 bp, Homo sapiens; identical to SEQ ID NO: 78934
  misc_feature 1..30: note = chr16:356089-356119
  misc_feature 1..30: note = Hypo
  source 1..30: mol_type = genomic DNA

SEQ ID NO: 111200 - DNA, 519 bp, Homo sapiens; identical to SEQ ID NO: 78946
  misc_feature 1..519: note = chr16:410195-410714
  misc_feature 1..519: note = Hypo
  source 1..519: mol_type = genomic DNA

SEQ ID NO: 111201 - DNA, 611 bp, Homo sapiens; identical to SEQ ID NO: 78947
  misc_feature 1..611: note = chr16:410995-411606
  misc_feature 1..611: note = Hypo
  source 1..611: mol_type = genomic DNA

SEQ ID NO: 111202 - DNA, 309 bp, Homo sapiens; identical to SEQ ID NO: 44397
  misc_feature 1..309: note = chr16:412764-413073
  misc_feature 1..309: note = Hypo
  source 1..309: mol_type = genomic DNA

SEQ ID NO: 111203 - DNA, 143 bp, Homo sapiens; identical to SEQ ID NO: 78954
  misc_feature 1..143: note = chr16:428930-429073
  misc_feature 1..143: note = Hypo
  source 1..143: mol_type = genomic DNA

SEQ ID NO: 111204 - DNA, 23 bp, Homo sapiens
  misc_feature 1..23: note = chr16:440317-440340
  misc_feature 1..23: note = Hypo
  source 1..23: mol_type = genomic DNA
aatggggtccagggccgagggct

SEQ ID NO: 111205 - DNA, 30 bp, Homo sapiens; identical to SEQ ID NO: 78978
  misc_feature 1..30: note = chr16:468101-468131
  misc_feature 1..30: note = Hypo
  source 1..30: mol_type = genomic DNA

SEQ ID NO: 111206 - DNA, 37 bp, Homo sapiens; identical to SEQ ID NO: 79022
  misc_feature 1..37: note = chr16:501346-501383
  misc_feature 1..37: note = Hypo
  source 1..37: mol_type = genomic DNA

SEQ ID NO: 111207 - DNA, 24 bp, Homo sapiens
  misc_feature 1..24: note = chr16:505034-505058
  misc_feature 1..24: note = Hypo
  source 1..24: mol_type = genomic DNA
gcgaaactccgtctcaaaaaaaaa

SEQ ID NO: 111208 - DNA, 30 bp, Homo sapiens; identical to SEQ ID NO: 79040
  misc_feature 1..30: note = chr16:511064-511094
  misc_feature 1..30: note = Hypo
  source 1..30: mol_type = genomic DNA

SEQ ID NO: 111209 - DNA, 72 bp, Homo sapiens; identical to SEQ ID NO: 79041
  misc_feature 1..72: note = chr16:511477-511549
  misc_feature 1..72: note = Hypo
  source 1..72: mol_type = genomic DNA

SEQ ID NO: 111210 - DNA, 39 bp, Homo sapiens; identical to SEQ ID NO: 79175
  misc_feature 1..39: note = chr16:607668-607707
  misc_feature 1..39: note = Hypo
  source 1..39: mol_type = genomic DNA

SEQ ID NO: 111211 - DNA, 747 bp, Homo sapiens
  misc_feature 1..747: note = chr16:609865-610612
  misc_feature 1..747: note = Hyper
  source 1..747: mol_type = genomic DNA
gcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcccgccgcgagcgcggtcggaggtcgcagcgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgcc

SEQ ID NO: 111212 - DNA, 205 bp, Homo sapiens; identical to SEQ ID NO: 79178
  misc_feature 1..205: note = chr16:611376-611581
  misc_feature 1..205: note = Hypo
  source 1..205: mol_type = genomic DNA

SEQ ID NO: 111213 - DNA, 370 bp, Homo sapiens; identical to SEQ ID NO: 79179
  misc_feature 1..370: note = chr16:611950-612320
  misc_feature 1..370: note = Hypo
  source 1..370: mol_type = genomic DNA

SEQ ID NO: 111214 - DNA, 287 bp, Homo sapiens; identical to SEQ ID NO: 79180
  misc_feature 1..287: note = chr16:612869-613156
  misc_feature 1..287: note = Hypo
  source 1..287: mol_type = genomic DNA

SEQ ID NO: 111215 - DNA, 496 bp, Homo sapiens; identical to SEQ ID NO: 79181
  misc_feature 1..496: note = chr16:613552-614048
  misc_feature 1..496: note = Hypo
  source 1..496: mol_type = genomic DNA

SEQ ID NO: 111216 - DNA, 30 bp, Homo sapiens; identical to SEQ ID NO: 44404
  misc_feature 1..30: note = chr16:614353-614383
  misc_feature 1..30: note = Hypo
  source 1..30: mol_type = genomic DNA

SEQ ID NO: 111217 - DNA, 502 bp, Homo sapiens; identical to SEQ ID NO: 79183
  misc_feature 1..502: note = chr16:614755-615257
  misc_feature 1..502: note = Hypo
  source 1..502: mol_type = genomic DNA

SEQ ID NO: 111218 - DNA, 55 bp, Homo sapiens; identical to SEQ ID NO: 79192
  misc_feature 1..55: note = chr16:623234-623289
  misc_feature 1..55: note = Hypo
  source 1..55: mol_type = genomic DNA

SEQ ID NO: 111219 - DNA, 112 bp, Homo sapiens; identical to SEQ ID NO: 79195
  misc_feature 1..112: note = chr16:643882-643994
  misc_feature 1..112: note = Hypo
  source 1..112: mol_type = genomic DNA

SEQ ID NO: 111220 - DNA, 553 bp, Homo sapiens
  misc_feature 1..553: note = chr16:666712-667265
  misc_feature 1..553: note = Hypo
  source 1..553: mol_type = genomic DNA
acttggaaatacattcgccttggagaattcaacttcaaaatgcatacgaagtaggtcagggtggaaataaaggcactgccctttctccaggcacgctggagtccacgccctgcctttgcccaatgccctctgagggagaggccctgtgccttgcacccagcgcgggccacaggcggaggccccattccaggcaagccgtgcccatggagaggctggcctgctaggctgtggggcccgatggcctgacactgtatggaccacgctcctgccctgccctgccccgccctgcccgtggcccgtgtgcagaagtgggcaggcctgggttgctgggccagagccccgagatttccccctgccccactggctgagtgtgggggagctgcttctccacttccgcgtgggtcttggccctgggaggccagtggccgaggctggtctcgcgggcgctcgctccaggagtggcgcgtcccctcagcgccctgtgcttcctcgcagggatcgactacaagaccaccaccatcctgctggacggccggcgcgtgaagctggagct

SEQ ID NO: 111221 - DNA, 77 bp, Homo sapiens; identical to SEQ ID NO: 79208
  misc_feature 1..77: note = chr16:667484-667561
  misc_feature 1..77: note = Hypo
  source 1..77: mol_type = genomic DNA

SEQ ID NO: 111222 - DNA, 55 bp, Homo sapiens; identical to SEQ ID NO: 79214
  misc_feature 1..55: note = chr16:671371-671426
  misc_feature 1..55: note = Hypo
  source 1..55: mol_type = genomic DNA

SEQ ID NO: 111223 - DNA, 30 bp, Homo sapiens; identical to SEQ ID NO: 79241
  misc_feature 1..30: note = chr16:677437-677467
  misc_feature 1..30: note = Hypo
  source 1..30: mol_type = genomic DNA

SEQ ID NO: 111224 - DNA, 72 bp, Homo sapiens; identical to SEQ ID NO: 79242
  misc_feature 1..72: note = chr16:677837-677909
  misc_feature 1..72: note = Hypo
  source 1..72: mol_type = genomic DNA

SEQ ID NO: 111225 - DNA, 217 bp, Homo sapiens; identical to SEQ ID NO: 79248
  misc_feature 1..217: note = chr16:680959-681176
  misc_feature 1..217: note = Hyper
  source 1..217: mol_type = genomic DNA

SEQ ID NO: 111226 - DNA, 228 bp, Homo sapiens; identical to SEQ ID NO: 79285
  misc_feature 1..228: note = chr16:700101-700329
  misc_feature 1..228: note = Hypo
  source 1..228: mol_type = genomic DNA

SEQ ID NO: 111227 - DNA, 64 bp, Homo sapiens; identical to SEQ ID NO: 44412
  misc_feature 1..64: note = chr16:700572-700636
  misc_feature 1..64: note = Hypo
  source 1..64: mol_type = genomic DNA

SEQ ID NO: 111228 - DNA, 39 bp, Homo sapiens; identical to SEQ ID NO: 79312
  misc_feature 1..39: note = chr16:721687-721726
  misc_feature 1..39: note = Hypo
  source 1..39: mol_type = genomic DNA

SEQ ID NO: 111229 - DNA, 703 bp, Homo sapiens; identical to SEQ ID NO: 79315
  misc_feature 1..703: note = chr16:725275-725978
  misc_feature 1..703: note = Hyper
  source 1..703: mol_type = genomic DNA

SEQ ID NO: 111230 - DNA, 467 bp, Homo sapiens; identical to SEQ ID NO: 79316
  misc_feature 1..467: note = chr16:726580-727047
  misc_feature 1..467: note = Hypo
  source 1..467: mol_type = genomic DNA

SEQ ID NO: 111231 - DNA, 336 bp, Homo sapiens; identical to SEQ ID NO: 79327
  misc_feature 1..336: note = chr16:731331-731667
  misc_feature 1..336: note = Hypo
  source 1..336: mol_type = genomic DNA

SEQ ID NO: 111232 - DNA, 1210 bp, Homo sapiens; identical to SEQ ID NO: 44416
  misc_feature 1..1210: note = chr16:734741-735951
  misc_feature 1..1210: note = Hypo
  source 1..1210: mol_type = genomic DNA

SEQ ID NO: 111233 - DNA, 27 bp, Homo sapiens
  misc_feature 1..27: note = chr16:740887-740914
  misc_feature 1..27: note = Hypo
  source 1..27: mol_type = genomic DNA
tgtgagccaccgcgcctggcctgtttt

SEQ ID NO: 111234 - DNA, 338 bp, Homo sapiens; identical to SEQ ID NO: 79338
  misc_feature 1..338: note = chr16:741169-741507
  misc_feature 1..338: note = Hypo
  source 1..338: mol_type = genomic DNA

SEQ ID NO: 111235 - DNA, 49 bp, Homo sapiens
  misc_feature 1..49: note = chr16:745495-745544
  misc_feature 1..49: note = Hyper
  source 1..49: mol_type = genomic DNA
gagaggtcaaggctgcgcagcttgcgcaggttctcggccacgagctcca

SEQ ID NO: 111236 - DNA, 1062 bp, Homo sapiens; identical to SEQ ID NO: 79346
  misc_feature 1..1062: note = chr16:750349-751411
  misc_feature 1..1062: note = Hyper
  source 1..1062: mol_type = genomic DNA

SEQ ID NO: 111237 - DNA, 166 bp, Homo sapiens; identical to SEQ ID NO: 79360
  misc_feature 1..166: note = chr16:755523-755689
  misc_feature 1..166: note = Hyper
  source 1..166: mol_type = genomic DNA

SEQ ID NO: 111238 - DNA, 144 bp, Homo sapiens; identical to SEQ ID NO: 79361
  misc_feature 1..144: note = chr16:756288-756432
  misc_feature 1..144: note = Hyper
  source 1..144: mol_type = genomic DNA

SEQ ID NO: 111239 - DNA, 30 bp, Homo sapiens; identical to SEQ ID NO: 44418
  misc_feature 1..30: note = chr16:760916-760946
  misc_feature 1..30: note = Hypo
  source 1..30: mol_type = genomic DNA

SEQ ID NO: 111240 - DNA, 36 bp, Homo sapiens; identical to SEQ ID NO: 79371
  misc_feature 1..36: note = chr16:766969-767005
  misc_feature 1..36: note = Hypo
  source 1..36: mol_type = genomic DNA

SEQ ID NO: 111241 - DNA, 273 bp, Homo sapiens; identical to SEQ ID NO: 79378
  misc_feature 1..273: note = chr16:775524-775797
  misc_feature 1..273: note = Hypo
  source 1..273: mol_type = genomic DNA

SEQ ID NO: 111242 - DNA, 126 bp, Homo sapiens; identical to SEQ ID NO: 44420
  misc_feature 1..126: note = chr16:798233-798359
  misc_feature 1..126: note = Hypo
  source 1..126: mol_type = genomic DNA

SEQ ID NO: 111243 - DNA, 665 bp, Homo sapiens; identical to SEQ ID NO: 79410
  misc_feature 1..665: note = chr16:809389-810054
  misc_feature 1..665: note = Hypo
  source 1..665: mol_type = genomic DNA

SEQ ID NO: 111244 - DNA, 66 bp, Homo sapiens; identical to SEQ ID NO: 79421
  misc_feature 1..66: note = chr16:815699-815765
  misc_feature 1..66: note = Hypo
  source 1..66: mol_type = genomic DNA

SEQ ID NO: 111245 - DNA, 223 bp, Homo sapiens; identical to SEQ ID NO: 79423
  misc_feature 1..223: note = chr16:816004-816227
  misc_feature 1..223: note = Hypo
  source 1..223: mol_type = genomic DNA

SEQ ID NO: 111246 - DNA, 102 bp, Homo sapiens; identical to SEQ ID NO: 79434
  misc_feature 1..102: note = chr16:821742-821844
  misc_feature 1..102: note = Hypo
  source 1..102: mol_type = genomic DNA

SEQ ID NO: 111247 - DNA, 16 bp, Homo sapiens
  misc_feature 1..16: note = chr16:822480-822496
  misc_feature 1..16: note = Hypo
  source 1..16: mol_type = genomic DNA
ccgtctcaaaaaatga

SEQ ID NO: 111248 - DNA, 213 bp, Homo sapiens; identical to SEQ ID NO: 79437
  misc_feature 1..213: note = chr16:822897-823110
  misc_feature 1..213: note = Hypo
  source 1..213: mol_type = genomic DNA

SEQ ID NO: 111249 - DNA, 145 bp, Homo sapiens; identical to SEQ ID NO: 79440
  misc_feature 1..145: note = chr16:824015-824160
  misc_feature 1..145: note = Hypo
  source 1..145: mol_type = genomic DNA

SEQ ID NO: 111250 - DNA, 480 bp, Homo sapiens; identical to SEQ ID NO: 79441
  misc_feature 1..480: note = chr16:824923-825403
  misc_feature 1..480: note = Hypo
  source 1..480: mol_type = genomic DNA

SEQ ID NO: 111251 - DNA, 250 bp, Homo sapiens; identical to SEQ ID NO: 44427
  misc_feature 1..250: note = chr16:837308-837558
  misc_feature 1..250: note = Hypo
  source 1..250: mol_type = genomic DNA

SEQ ID NO: 111252 - DNA, 654 bp, Homo sapiens; identical to SEQ ID NO: 79470
  misc_feature 1..654: note = chr16:845850-846504
  misc_feature 1..654: note = Hypo
  source 1..654: mol_type = genomic DNA

SEQ ID NO: 111253 - DNA, 78 bp, Homo sapiens; identical to SEQ ID NO: 79474
  misc_feature 1..78: note = chr16:847008-847086
  misc_feature 1..78: note = Hypo
  source 1..78: mol_type = genomic DNA

SEQ ID NO: 111254 - DNA, 145 bp, Homo sapiens; identical to SEQ ID NO: 79547
  misc_feature 1..145: note = chr16:858656-858801
  misc_feature 1..145: note = Hypo
  source 1..145: mol_type = genomic DNA

SEQ ID NO: 111255 - DNA, 130 bp, Homo sapiens; identical to SEQ ID NO: 79571
  misc_feature 1..130: note = chr16:863747-863877
  misc_feature 1..130: note = Hyper
  source 1..130: mol_type = genomic DNA

SEQ ID NO: 111256 - DNA, 207 bp, Homo sapiens; identical to SEQ ID NO: 79610
  misc_feature 1..207: note = chr16:870938-871145
  misc_feature 1..207: note = Hypo
  source 1..207: mol_type = genomic DNA

SEQ ID NO: 111257 - DNA, 70 bp, Homo sapiens; identical to SEQ ID NO: 79658
  misc_feature 1..70: note = chr16:877732-877802
  misc_feature 1..70: note = Hypo
  source 1..70: mol_type = genomic DNA

SEQ ID NO: 111258 - DNA, 30 bp, Homo sapiens; identical to SEQ ID NO: 79661
  misc_feature 1..30: note = chr16:878827-878857
  misc_feature 1..30: note = Hypo
  source 1..30: mol_type = genomic DNA

SEQ ID NO: 111259 - DNA, 79 bp, Homo sapiens; identical to SEQ ID NO: 44432
  misc_feature 1..79: note = chr16:882403-882482
  misc_feature 1..79: note = Hypo
  source 1..79: mol_type = genomic DNA

SEQ ID NO: 111260 - DNA, 139 bp, Homo sapiens; identical to SEQ ID NO: 44433
  misc_feature 1..139: note = chr16:882542-882681
  misc_feature 1..139: note = Hypo
  source 1..139: mol_type = genomic DNA

SEQ ID NO: 111261 - DNA, 71 bp, Homo sapiens; identical to SEQ ID NO: 79685
  misc_feature 1..71: note = chr16:883188-883259
  misc_feature 1..71: note = Hypo
  source 1..71: mol_type = genomic DNA

SEQ ID NO: 111262 - DNA, 128 bp, Homo sapiens; identical to SEQ ID NO: 79688
  misc_feature 1..128: note = chr16:883606-883734
  misc_feature 1..128: note = Hypo
  source 1..128: mol_type = genomic DNA

SEQ ID NO: 111263 - DNA, 187 bp, Homo sapiens; identical to SEQ ID NO: 79760
  misc_feature 1..187: note = chr16:888838-889025
  misc_feature 1..187: note = Hypo
  source 1..187: mol_type = genomic DNA

SEQ ID NO: 111264 - DNA, 194 bp, Homo sapiens; identical to SEQ ID NO: 79850
  misc_feature 1..194: note = chr16:891650-891844
  misc_feature 1..194: note = Hypo
  source 1..194: mol_type = genomic DNA

SEQ ID NO: 111265 - DNA, 37 bp, Homo sapiens; identical to SEQ ID NO: 79877
  misc_feature 1..37: note = chr16:894468-894505
  misc_feature 1..37: note = Hypo
  source 1..37: mol_type = genomic DNA

SEQ ID NO: 111266 - DNA, 334 bp, Homo sapiens; identical to SEQ ID NO: 79878
  misc_feature 1..334: note = chr16:894865-895199
  misc_feature 1..334: note = Hypo
  source 1..334: mol_type = genomic DNA

SEQ ID NO: 111267 - DNA, 30 bp, Homo sapiens; identical to SEQ ID NO: 79915
  misc_feature 1..30: note = chr16:899159-899189
  misc_feature 1..30: note = Hypo
  source 1..30: mol_type = genomic DNA

SEQ ID NO: 111268 - DNA, 65 bp, Homo sapiens; identical to SEQ ID NO: 79927
  misc_feature 1..65: note = chr16:901765-901830
  misc_feature 1..65: note = Hypo
  source 1..65: mol_type = genomic DNA

SEQ ID NO: 111269 - DNA, 42 bp, Homo sapiens; identical to SEQ ID NO: 79928
  misc_feature 1..42: note = chr16:904733-904775
  misc_feature 1..42: note = Hypo
  source 1..42: mol_type = genomic DNA

SEQ ID NO: 111270 - DNA, 300 bp, Homo sapiens; identical to SEQ ID NO: 79934
  misc_feature 1..300: note = chr16:924548-924848
  misc_feature 1..300: note = Hypo
  source 1..300: mol_type = genomic DNA

SEQ ID NO: 111271 - DNA, 30 bp, Homo sapiens; identical to SEQ ID NO: 79935
  misc_feature 1..30: note = chr16:925813-925843
  misc_feature 1..30: note = Hypo
  source 1..30: mol_type = genomic DNA

SEQ ID NO: 111272 - DNA, 66 bp, Homo sapiens; identical to SEQ ID NO: 79936
  misc_feature 1..66: note = chr16:928296-928362
  misc_feature 1..66: note = Hypo
  source 1..66: mol_type = genomic DNA

SEQ ID NO: 111273 - DNA, 30 bp, Homo sapiens; identical to SEQ ID NO: 79937
  misc_feature 1..30: note = chr16:929536-929566
  misc_feature 1..30: note = Hypo
  source 1..30: mol_type = genomic DNA

SEQ ID NO: 111274 - DNA, 30 bp, Homo sapiens; identical to SEQ ID NO: 79939
  misc_feature 1..30: note = chr16:939019-939049
  misc_feature 1..30: note = Hypo
  source 1..30: mol_type = genomic DNA

SEQ ID NO: 111275 - DNA, 30 bp, Homo sapiens; identical to SEQ ID NO: 79940
  misc_feature 1..30: note = chr16:942296-942326
  misc_feature 1..30: note = Hypo
  source 1..30: mol_type = genomic DNA

SEQ ID NO: 111276 - DNA, 39 bp, Homo sapiens; identical to SEQ ID NO: 79941
  misc_feature 1..39: note = chr16:943022-943061
  misc_feature 1..39: note = Hypo
  source 1..39: mol_type = genomic DNA

SEQ ID NO: 111277 - DNA, 187 bp, Homo sapiens; identical to SEQ ID NO: 79942
  misc_feature 1..187: note = chr16:943459-943646
  misc_feature 1..187: note = Hypo
  source 1..187: mol_type = genomic DNA

SEQ ID NO: 111278 - DNA, 58 bp, Homo sapiens; identical to SEQ ID NO: 79943
  misc_feature 1..58: note = chr16:945674-945732
  misc_feature 1..58: note = Hypo
  source 1..58: mol_type = genomic DNA

SEQ ID NO: 111279 - DNA, 82 bp, Homo sapiens; identical to SEQ ID NO: 79944
  misc_feature 1..82: note = chr16:946275-946357
  misc_feature 1..82: note = Hypo
  source 1..82: mol_type = genomic DNA

SEQ ID NO: 111280 - DNA, 30 bp, Homo sapiens; identical to SEQ ID NO: 79945
  misc_feature 1..30: note = chr16:949510-949540
  misc_feature 1..30: note = Hypo
  source 1..30: mol_type = genomic DNA

SEQ ID NO: 111281 - DNA, 565 bp, Homo sapiens; identical to SEQ ID NO: 79946
  misc_feature 1..565: note = chr16:962833-963398
  misc_feature 1..565: note = Hypo
  source 1..565: mol_type = genomic DNA

SEQ ID NO: 111282 - DNA, 83 bp, Homo sapiens; identical to SEQ ID NO: 79947
  misc_feature 1..83: note = chr16:965804-965887
  misc_feature 1..83: note = Hypo
  source 1..83: mol_type = genomic DNA

SEQ ID NO: 111283 - DNA, 30 bp, Homo sapiens; identical to SEQ ID NO: 44442
  misc_feature 1..30: note = chr16:968262-968292
  misc_feature 1..30: note = Hypo
  source 1..30: mol_type = genomic DNA

SEQ ID NO: 111284 - DNA, 90 bp, Homo sapiens; identical to SEQ ID NO: 79949
  misc_feature 1..90: note = chr16:968556-968646
  misc_feature 1..90: note = Hypo
  source 1..90: mol_type = genomic DNA

SEQ ID NO: 111285 - DNA, 30 bp, Homo sapiens; identical to SEQ ID NO: 79950
  misc_feature 1..30: note = chr16:969209-969239
  misc_feature 1..30: note = Hypo
  source 1..30: mol_type = genomic DNA

SEQ ID NO: 111286 - DNA, 30 bp, Homo sapiens; identical to SEQ ID NO: 79951
  misc_feature 1..30: note = chr16:977343-977373
  misc_feature 1..30: note = Hypo
  source 1..30: mol_type = genomic DNA

SEQ ID NO: 111287 - DNA, 114 bp, Homo sapiens; identical to SEQ ID NO: 79952
  misc_feature 1..114: note = chr16:981729-981843
  misc_feature 1..114: note = Hypo
  source 1..114: mol_type = genomic DNA

SEQ ID NO: 111288 - DNA, 30 bp, Homo sapiens; identical to SEQ ID NO: 79953
  misc_feature 1..30: note = chr16:982069-982099
  misc_feature 1..30: note = Hypo
  source 1..30: mol_type = genomic DNA

SEQ ID NO: 111289 - DNA, 30 bp, Homo sapiens; identical to SEQ ID NO: 79954
  misc_feature 1..30: note = chr16:983721-983751
  misc_feature 1..30: note = Hypo
  source 1..30: mol_type = genomic DNA

SEQ ID NO: 111290 - DNA, 34 bp, Homo sapiens; identical to SEQ ID NO: 78281
  misc_feature 1..34: note = chr16:1009722-1009756
  misc_feature 1..34: note = Hypo
  source 1..34: mol_type = genomic DNA

SEQ ID NO: 111291 - DNA, 132 bp, Homo sapiens; identical to SEQ ID NO: 78284
  misc_feature 1..132: note = chr16:1018120-1018252
  misc_feature 1..132: note = Hypo
  source 1..132: mol_type = genomic DNA

SEQ ID NO: 111292 - DNA, 42 bp, Homo sapiens; identical to SEQ ID NO: 78285
  misc_feature 1..42: note = chr16:1022772-1022814
  misc_feature 1..42: note = Hypo
  source 1..42: mol_type = genomic DNA

SEQ ID NO: 111293 - DNA, 582 bp, Homo sapiens
  misc_feature 1..582: note = chr16:1030275-1030857
  misc_feature 1..582: note = Hyper
  source 1..582: mol_type = genomic DNA
gtctgcggacgggggcgggcggccgctgggggcaccagctctcggccgggccagaacagggggtaggaggcgcgtcctgtgcggtcggtggcggccccaggtgggtgcggtgcgctggcaggaagcggcagcacgacccccgactttgcatctggacttttctagtaacggaccagctccttctgccgaccgggccggggagaccgcgtggctcagtggctgcagcggccaccggcccgggcgtgggggctttgagggcaccggcgcggtaggtcacccgggtttcgcgggccgcaagctcggagacgcgcgtgtcccgcgttggctgcctgacccggaatggcgcagccccttcgcctccagcgcgctggttgaaaggatccgagccaccctcggggacggccgggccgaggccacctcgcggggcggccttgggcggggacccggacccgcggttggacgttcgcctcggggggggcaatgtcccctctccgaccccgcggtccccaccagggcggcacaccccgccctctccccgcctccgcaggcgcccagggctcacaggctcggagcggcctccgc

SEQ ID NO: 111294 - DNA, 199 bp, Homo sapiens; identical to SEQ ID NO: 78290
  misc_feature 1..199: note = chr16:1031067-1031266
  misc_feature 1..199: note = Hyper
  source 1..199: mol_type = genomic DNA

SEQ ID NO: 111295 - DNA, 138 bp, Homo sapiens; identical to SEQ ID NO: 78291
  misc_feature 1..138: note = chr16:1031386-1031524
  misc_feature 1..138: note = Hyper
  source 1..138: mol_type = genomic DNA

SEQ ID NO: 111296 - DNA, 706 bp, Homo sapiens; identical to SEQ ID NO: 78292
  misc_feature 1..706: note = chr16:1031741-1032447
  misc_feature 1..706: note = Hyper
  source 1..706: mol_type = genomic DNA

SEQ ID NO: 111297 - DNA, 30 bp, Homo sapiens; identical to SEQ ID NO: 78293
  misc_feature 1..30: note = chr16:1034635-1034665
  misc_feature 1..30: note = Hypo
  source 1..30: mol_type = genomic DNA

SEQ ID NO: 111298 - DNA, 182 bp, Homo sapiens
  misc_feature 1..182: note = chr16:1035292-1035474
  misc_feature 1..182: note = Hypo
  source 1..182: mol_type = genomic DNA
ctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccag

SEQ ID NO: 111299 - DNA, 30 bp, Homo sapiens; identical to SEQ ID NO: 78295
  misc_feature 1..30: note = chr16:1039445-1039475
  misc_feature 1..30: note = Hypo
  source 1..30: mol_type = genomic DNA

SEQ ID NO: 111300 - DNA, 168 bp, Homo sapiens; identical to SEQ ID NO: 78296
  misc_feature 1..168: note = chr16:1040337-1040505
  misc_feature 1..168: note = Hypo
  source 1..168: mol_type = genomic DNA

SEQ ID NO: 111301 - DNA, 30 bp, Homo sapiens; identical to SEQ ID NO: 78299
  misc_feature 1..30: note = chr16:1050321-1050351
  misc_feature 1..30: note = Hypo
  source 1..30: mol_type = genomic DNA

SEQ ID NO: 111302 - DNA, 30 bp, Homo sapiens; identical to SEQ ID NO: 78300
  misc_feature 1..30: note = chr16:1052148-1052178
  misc_feature 1..30: note = Hypo
  source 1..30: mol_type = genomic DNA

SEQ ID NO: 111303 - DNA, 372 bp, Homo sapiens; identical to SEQ ID NO: 78301
  misc_feature 1..372: note = chr16:1052442-1052814
  misc_feature 1..372: note = Hypo
  source 1..372: mol_type = genomic DNA

SEQ ID NO: 111304 - DNA, 30 bp, Homo sapiens; identical to SEQ ID NO: 78302
  misc_feature 1..30: note = chr16:1053812-1053842
  misc_feature 1..30: note = Hypo
  source 1..30: mol_type = genomic DNA

SEQ ID NO: 111305 - DNA, 94 bp, Homo sapiens; identical to SEQ ID NO: 78303
  misc_feature 1..94: note = chr16:1061426-1061520
  misc_feature 1..94: note = Hypo
  source 1..94: mol_type = genomic DNA

SEQ ID NO: 111306 - DNA, 32 bp, Homo sapiens; identical to SEQ ID NO: 44449
  misc_feature 1..32: note = chr16:1062412-1062444
  misc_feature 1..32: note = Hypo
  source 1..32: mol_type = genomic DNA

SEQ ID NO: 111307 - DNA, 30 bp, Homo sapiens; identical to SEQ ID NO: 78305
  misc_feature 1..30: note = chr16:1062655-1062685
  misc_feature 1..30: note = Hypo
  source 1..30: mol_type = genomic DNA

SEQ ID NO: 111308 - DNA, 30 bp, Homo sapiens; identical to SEQ ID NO: 78306
  misc_feature 1..30: note = chr16:1067752-1067782
  misc_feature 1..30: note = Hypo
  source 1..30: mol_type = genomic DNA

SEQ ID NO: 111309 - DNA, 112 bp, Homo sapiens; identical to SEQ ID NO: 78307
  misc_feature 1..112: note = chr16:1071854-1071966
  misc_feature 1..112: note = Hypo
  source 1..112: mol_type = genomic DNA

SEQ ID NO: 111310 - DNA, 136 bp, Homo sapiens; identical to SEQ ID NO: 78309
  misc_feature 1..136: note = chr16:1072992-1073128
  misc_feature 1..136: note = Hypo
  source 1..136: mol_type = genomic DNA

SEQ ID NO: 111311 - DNA, 42 bp, Homo sapiens; identical to SEQ ID NO: 44451
  misc_feature 1..42: note = chr16:1073516-1073558
  misc_feature 1..42: note = Hypo
  source 1..42: mol_type = genomic DNA

SEQ ID NO: 111312 - DNA, 30 bp, Homo sapiens; identical to SEQ ID NO: 78311
  misc_feature 1..30: note = chr16:1075075-1075105
  misc_feature 1..30: note = Hypo
  source 1..30: mol_type = genomic DNA

SEQ ID NO: 111313 - DNA, 51 bp, Homo sapiens; identical to SEQ ID NO: 44452
  misc_feature 1..51: note = chr16:1076434-1076485
  misc_feature 1..51: note = Hypo
  source 1..51: mol_type = genomic DNA

SEQ ID NO: 111314 - DNA, 104 bp, Homo sapiens; identical to SEQ ID NO: 78313
  misc_feature 1..104: note = chr16:1077555-1077659
  misc_feature 1..104: note = Hypo
  source 1..104: mol_type = genomic DNA

SEQ ID NO: 111315 - DNA, 63 bp, Homo sapiens; identical to SEQ ID NO: 78314
  misc_feature 1..63: note = chr16:1077886-1077949
  misc_feature 1..63: note = Hypo
  source 1..63: mol_type = genomic DNA

SEQ ID NO: 111316 - DNA, 217 bp, Homo sapiens; identical to SEQ ID NO: 15968
  misc_feature 1..217: note = chr16:1081773-1081990
  misc_feature 1..217: note = Hypo
  source 1..217: mol_type = genomic DNA

SEQ ID NO: 111317 - DNA, 42 bp, Homo sapiens; identical to SEQ ID NO: 78317
  misc_feature 1..42: note = chr16:1089124-1089166
  misc_feature 1..42: note = Hypo
  source 1..42: mol_type = genomic DNA

SEQ ID NO: 111318 - DNA, 30 bp, Homo sapiens; identical to SEQ ID NO: 44455
  misc_feature 1..30: note = chr16:1089739-1089769
  misc_feature 1..30: note = Hypo
  source 1..30: mol_type = genomic DNA

SEQ ID NO: 111319 - DNA, 30 bp, Homo sapiens; identical to SEQ ID NO: 78319
  misc_feature 1..30: note = chr16:1090322-1090352
  misc_feature 1..30: note = Hypo
  source 1..30: mol_type = genomic DNA

SEQ ID NO: 111320 - DNA, 103 bp, Homo sapiens; identical to SEQ ID NO: 78320
  misc_feature 1..103: note = chr16:1090678-1090781
  misc_feature 1..103: note = Hypo
  source 1..103: mol_type = genomic DNA

SEQ ID NO: 111321 - DNA, 30 bp, Homo sapiens; identical to SEQ ID NO: 44456
  misc_feature 1..30: note = chr16:1092742-1092772
  misc_feature 1..30: note = Hypo
  source 1..30: mol_type = genomic DNA

SEQ ID NO: 111322 - DNA, 53 bp, Homo sapiens; identical to SEQ ID NO: 78322
  misc_feature 1..53: note = chr16:1096684-1096737
  misc_feature 1..53: note = Hypo
  source 1..53: mol_type = genomic DNA

SEQ ID NO: 111323 - DNA, 89 bp, Homo sapiens; identical to SEQ ID NO: 78323
  misc_feature 1..89: note = chr16:1101018-1101107
  misc_feature 1..89: note = Hypo
  source 1..89: mol_type = genomic DNA

SEQ ID NO: 111324 - DNA, 81 bp, Homo sapiens; identical to SEQ ID NO: 78324
  misc_feature 1..81: note = chr16:1103110-1103191
  misc_feature 1..81: note = Hypo
  source 1..81: mol_type = genomic DNA

SEQ ID NO: 111325 - DNA, 30 bp, Homo sapiens; identical to SEQ ID NO: 78326
  misc_feature 1..30: note = chr16:1111359-1111389
  misc_feature 1..30: note = Hypo
  source 1..30: mol_type = genomic DNA

SEQ ID NO: 111326 - DNA, 46 bp, Homo sapiens; identical to SEQ ID NO: 78328
  misc_feature 1..46: note = chr16:1111971-1112017
  misc_feature 1..46: note = Hypo
  source 1..46: mol_type = genomic DNA

SEQ ID NO: 111327 - DNA, 72 bp, Homo sapiens; identical to SEQ ID NO: 78329
  misc_feature 1..72: note = chr16:1113889-1113961
  misc_feature 1..72: note = Hypo
  source 1..72: mol_type = genomic DNA

SEQ ID NO: 111328 - DNA, 39 bp, Homo sapiens; identical to SEQ ID NO: 78332
  misc_feature 1..39: note = chr16:1116820-1116859
  misc_feature 1..39: note = Hypo
  source 1..39: mol_type = genomic DNA

SEQ ID NO: 111329 - DNA, 30 bp, Homo sapiens; identical to SEQ ID NO: 78334
  misc_feature 1..30: note = chr16:1118971-1119001
  misc_feature 1..30: note = Hypo
  source 1..30: mol_type = genomic DNA

SEQ ID NO: 111330 - DNA, 30 bp, Homo sapiens; identical to SEQ ID NO: 78337
  misc_feature 1..30: note = chr16:1125274-1125304
  misc_feature 1..30: note = Hypo
  source 1..30: mol_type = genomic DNA

SEQ ID NO: 111331 - DNA, 420 bp, Homo sapiens; identical to SEQ ID NO: 78339
  misc_feature 1..420: note = chr16:1128947-1129367
  misc_feature 1..420: note = Hypo
  source 1..420: mol_type = genomic DNA

SEQ ID NO: 111332 - DNA, 65 bp, Homo sapiens; identical to SEQ ID NO: 78342
  misc_feature 1..65: note = chr16:1142015-1142080
  misc_feature 1..65: note = Hypo
  source 1..65: mol_type = genomic DNA

SEQ ID NO: 111333 - DNA, 30 bp, Homo sapiens; identical to SEQ ID NO: 78344
  misc_feature 1..30: note = chr16:1148193-1148223
  misc_feature 1..30: note = Hypo
  source 1..30: mol_type = genomic DNA

SEQ ID NO: 111334 - DNA, 198 bp, Homo sapiens; identical to SEQ ID NO: 78346
  misc_feature 1..198: note = chr16:1155071-1155269
  misc_feature 1..198: note = Hypo
  source 1..198: mol_type = genomic DNA

SEQ ID NO: 111335 - DNA, 232 bp, Homo sapiens; identical to SEQ ID NO: 78348
  misc_feature 1..232: note = chr16:1157293-1157525
  misc_feature 1..232: note = Hypo
  source 1..232: mol_type = genomic DNA

SEQ ID NO: 111336 - DNA, 46 bp, Homo sapiens; identical to SEQ ID NO: 78349
  misc_feature 1..46: note = chr16:1164458-1164504
  misc_feature 1..46: note = Hypo
  source 1..46: mol_type = genomic DNA

SEQ ID NO: 111337 - DNA, 225 bp, Homo sapiens; identical to SEQ ID NO: 78350
  misc_feature 1..225: note = chr16:1166553-1166778
  misc_feature 1..225: note = Hypo
  source 1..225: mol_type = genomic DNA

SEQ ID NO: 111338 - DNA, 169 bp, Homo sapiens; identical to SEQ ID NO: 78352
  misc_feature 1..169: note = chr16:1171138-1171307
  misc_feature 1..169: note = Hypo
  source 1..169: mol_type = genomic DNA

SEQ ID NO: 111339 - DNA, 155 bp, Homo sapiens; identical to SEQ ID NO: 78354
  misc_feature 1..155: note = chr16:1173250-1173405
  misc_feature 1..155: note = Hypo
  source 1..155: mol_type = genomic DNA

SEQ ID NO: 111340 - DNA, 25 bp, Homo sapiens
  misc_feature 1..25: note = chr16:1186732-1186757
  misc_feature 1..25: note = Hypo
  source 1..25: mol_type = genomic DNA
gggtgcggtggctcacgcctgtcat

SEQ ID NO: 111341 - DNA, 30 bp, Homo sapiens; identical to SEQ ID NO: 78360
  misc_feature 1..30: note = chr16:1187602-1187632
  misc_feature 1..30: note = Hypo
  source 1..30: mol_type = genomic DNA

SEQ ID NO: 111342 - DNA, 36 bp, Homo sapiens; identical to SEQ ID NO: 78362
  misc_feature 1..36: note = chr16:1188922-1188958
  misc_feature 1..36: note = Hypo
  source 1..36: mol_type = genomic DNA

SEQ ID NO: 111343 - DNA, 179 bp, Homo sapiens; identical to SEQ ID NO: 78363
  misc_feature 1..179: note = chr16:1195670-1195849
  misc_feature 1..179: note = Hypo
  source 1..179: mol_type = genomic DNA

SEQ ID NO: 111344 - DNA, 34 bp, Homo sapiens; identical to SEQ ID NO: 78364
  misc_feature 1..34: note = chr16:1196701-1196735
  misc_feature 1..34: note = Hypo
  source 1..34: mol_type = genomic DNA

SEQ ID NO: 111345 - DNA, 30 bp, Homo sapiens; identical to SEQ ID NO: 78365
  misc_feature 1..30: note = chr16:1198450-1198480
  misc_feature 1..30: note = Hypo
  source 1..30: mol_type = genomic DNA

SEQ ID NO: 111346 - DNA, 30 bp, Homo sapiens; identical to SEQ ID NO: 78366
  misc_feature 1..30: note = chr16:1199021-1199051
  misc_feature 1..30: note = Hypo
  source 1..30: mol_type = genomic DNA

SEQ ID NO: 111347 - DNA, 48 bp, Homo sapiens
  misc_feature 1..48: note = chr16:1202525-1202573
  misc_feature 1..48: note = Hyper
  source 1..48: mol_type = genomic DNA
gcgccccatcacacacgcgcgcgcgggcacacccgggacacacacgcg

SEQ ID NO: 111348 - DNA, 1107 bp, Homo sapiens
  misc_feature 1..1107: note = chr16:1203201-1204308
  misc_feature 1..1107: note = Hyper
  source 1..1107: mol_type = genomic DNA
ccggcctcacccgtccgctcagcggcctccacgccgcgccgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgagacgcggcgaggacgcgcgcccgggaccctcttcaacttgcgcgaagcgggccggggagcccctcggggtgggggtggggccgctggagggagggagggggcgggcgggggcggggggcgcgtttgtctctaataagaaaagacaaagacatcccggcggccgcggctgttcccgcagctccgcgccgcgggaggcagggcgggggcgtcgccaccggccccgggtcaccccctgtcctctgcaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatatccttcccggccggcggggggcggggggcggggggcgtggggagggtgggggcccggggcgcgggactccctcggcatgcgcccccgcgcgcccctgttggtgggacctggcgtgggccgggcgcgcgggggtgcagggcaggggctggaggaccgcgctctaatttctgagagtggcgggcttggggggccaccgggcgcctccggactcccttccccagggccggctccggacggagaaggtggaagcgaagcggtgaggcccccgc

SEQ ID NO: 111349 - DNA, 30 bp, Homo sapiens; identical to SEQ ID NO: 78373
  misc_feature 1..30: note = chr16:1207059-1207089
  misc_feature 1..30: note = Hypo
  source 1..30: mol_type = genomic DNA

SEQ ID NO: 111350 - DNA, 38 bp, Homo sapiens; identical to SEQ ID NO: 78374
  misc_feature 1..38: note = chr16:1207490-1207528
  misc_feature 1..38: note = Hypo
  source 1..38: mol_type = genomic DNA

SEQ ID NO: 111351 - DNA, 55 bp, Homo sapiens; identical to SEQ ID NO: 78375
  misc_feature 1..55: note = chr16:1209218-1209273
  misc_feature 1..55: note = Hypo
  source 1..55: mol_type = genomic DNA

SEQ ID NO: 111352 - DNA, 41 bp, Homo sapiens; identical to SEQ ID NO: 78378
  misc_feature 1..41: note = chr16:1213983-1214024
  misc_feature 1..41: note = Hypo
  source 1..41: mol_type = genomic DNA

SEQ ID NO: 111353 - DNA, 30 bp, Homo sapiens; identical to SEQ ID NO: 78379
  misc_feature 1..30: note = chr16:1214993-1215023
  misc_feature 1..30: note = Hypo
  source 1..30: mol_type = genomic DNA

SEQ ID NO: 111354 - DNA, 155 bp, Homo sapiens; identical to SEQ ID NO: 78380
  misc_feature 1..155: note = chr16:1216382-1216537
  misc_feature 1..155: note = Hypo
  source 1..155: mol_type = genomic DNA

SEQ ID NO: 111355 - DNA, 30 bp, Homo sapiens; identical to SEQ ID NO: 78381
  misc_feature 1..30: note = chr16:1216945-1216975
  misc_feature 1..30: note = Hypo
  source 1..30: mol_type = genomic DNA

SEQ ID NO: 111356 - DNA, 321 bp, Homo sapiens; identical to SEQ ID NO: 78382
  misc_feature 1..321: note = chr16:1217182-1217503
  misc_feature 1..321: note = Hypo
  source 1..321: mol_type = genomic DNA

SEQ ID NO: 111357 - DNA, 307 bp, Homo sapiens; identical to SEQ ID NO: 78384
  misc_feature 1..307: note = chr16:1217833-1218140
  misc_feature 1..307: note = Hypo
  source 1..307: mol_type = genomic DNA

SEQ ID NO: 111358 - DNA, 30 bp, Homo sapiens; identical to SEQ ID NO: 78385
  misc_feature 1..30: note = chr16:1218638-1218668
  misc_feature 1..30: note = Hypo
  source 1..30: mol_type = genomic DNA

SEQ ID NO: 111359 - DNA, 215 bp, Homo sapiens; identical to SEQ ID NO: 78386
  misc_feature 1..215: note = chr16:1220501-1220716
  misc_feature 1..215: note = Hypo
  source 1..215: mol_type = genomic DNA

SEQ ID NO: 111360 - DNA, 30 bp, Homo sapiens; identical to SEQ ID NO: 44469
  misc_feature 1..30: note = chr16:1222610-1222640
  misc_feature 1..30: note = Hypo
  source 1..30: mol_type = genomic DNA

SEQ ID NO: 111361 - DNA, 30 bp, Homo sapiens; identical to SEQ ID NO: 78388
  misc_feature 1..30: note = chr16:1227328-1227358
  misc_feature 1..30: note = Hypo
  source 1..30: mol_type = genomic DNA

SEQ ID NO: 111362 - DNA, 151 bp, Homo sapiens; identical to SEQ ID NO: 15975
  misc_feature 1..151: note = chr16:1228780-1228931
  misc_feature 1..151: note = Hypo
  source 1..151: mol_type = genomic DNA

SEQ ID NO: 111363 - DNA, 342 bp, Homo sapiens; identical to SEQ ID NO: 78390
  misc_feature 1..342: note = chr16:1230012-1230354
  misc_feature 1..342: note = Hypo
  source 1..342: mol_type = genomic DNA

SEQ ID NO: 111364 - DNA, 656 bp, Homo sapiens; identical to SEQ ID NO: 78391
  misc_feature 1..656: note = chr16:1236485-1237141
  misc_feature 1..656: note = Hypo
  source 1..656: mol_type = genomic DNA

SEQ ID NO: 111365 - DNA, 39 bp, Homo sapiens; identical to SEQ ID NO: 78392
  misc_feature 1..39: note = chr16:1245806-1245845
  misc_feature 1..39: note = Hypo
  source 1..39: mol_type = genomic DNA

SEQ ID NO: 111366 - DNA, 36 bp, Homo sapiens; identical to SEQ ID NO: 78393
  misc_feature 1..36: note = chr16:1247968-1248004
  misc_feature 1..36: note = Hypo
  source 1..36: mol_type = genomic DNA

SEQ ID NO: 111367 - DNA, 570 bp, Homo sapiens; identical to SEQ ID NO: 78394
  misc_feature 1..570: note = chr16:1248352-1248922
  misc_feature 1..570: note = Hypo
  source 1..570: mol_type = genomic DNA

SEQ ID NO: 111368 - DNA, 272 bp, Homo sapiens; identical to SEQ ID NO: 78395
  misc_feature 1..272: note = chr16:1250262-1250534
  misc_feature 1..272: note = Hypo
  source 1..272: mol_type = genomic DNA

SEQ ID NO: 111369 - DNA, 142 bp, Homo sapiens; identical to SEQ ID NO: 78396
  misc_feature 1..142: note = chr16:1251693-1251835
  misc_feature 1..142: note = Hypo
  source 1..142: mol_type = genomic DNA

SEQ ID NO: 111370 - DNA, 51 bp, Homo sapiens; identical to SEQ ID NO: 44477
  misc_feature 1..51: note = chr16:1253065-1253116
  misc_feature 1..51: note = Hypo
  source 1..51: mol_type = genomic DNA

SEQ ID NO: 111371 - DNA, 119 bp, Homo sapiens; identical to SEQ ID NO: 78398
  misc_feature 1..119: note = chr16:1255901-1256020
  misc_feature 1..119: note = Hypo
  source 1..119: mol_type = genomic DNA

SEQ ID NO: 111372 - DNA, 359 bp, Homo sapiens; identical to SEQ ID NO: 78399
  misc_feature 1..359: note = chr16:1259060-1259419
  misc_feature 1..359: note = Hypo
  source 1..359: mol_type = genomic DNA

SEQ ID NO: 111373 - DNA, 102 bp, Homo sapiens; identical to SEQ ID NO: 78400
  misc_feature 1..102: note = chr16:1259773-1259875
  misc_feature 1..102: note = Hypo
  source 1..102: mol_type = genomic DNA

SEQ ID NO: 111374 - DNA, 221 bp, Homo sapiens; identical to SEQ ID NO: 78401
  misc_feature 1..221: note = chr16:1260220-1260441
  misc_feature 1..221: note = Hypo
  source 1..221: mol_type = genomic DNA

SEQ ID NO: 111375 - DNA, 67 bp, Homo sapiens; identical to SEQ ID NO: 78402
  misc_feature 1..67: note = chr16:1260766-1260833
  misc_feature 1..67: note = Hypo
  source 1..67: mol_type = genomic DNA

SEQ ID NO: 111376 - DNA, 30 bp, Homo sapiens; identical to SEQ ID NO: 78403
  misc_feature 1..30: note = chr16:1261095-1261125
  misc_feature 1..30: note = Hypo
  source 1..30: mol_type = genomic DNA

SEQ ID NO: 111377 - DNA, 582 bp, Homo sapiens; identical to SEQ ID NO: 78404
  misc_feature 1..582: note = chr16:1261601-1262183
  misc_feature 1..582: note = Hypo
  source 1..582: mol_type = genomic DNA

SEQ ID NO: 111378 - DNA, 47 bp, Homo sapiens; identical to SEQ ID NO: 44481
  misc_feature 1..47: note = chr16:1262447-1262494
  misc_feature 1..47: note = Hypo
  source 1..47: mol_type = genomic DNA

SEQ ID NO: 111379 - DNA, 38 bp, Homo sapiens; identical to SEQ ID NO: 78406
  misc_feature 1..38: note = chr16:1262762-1262800
  misc_feature 1..38: note = Hypo
  source 1..38: mol_type = genomic DNA

SEQ ID NO: 111380 - DNA, 33 bp, Homo sapiens; identical to SEQ ID NO: 78407
  misc_feature 1..33: note = chr16:1263717-1263750
  misc_feature 1..33: note = Hypo
  source 1..33: mol_type = genomic DNA

SEQ ID NO: 111381 - DNA, 30 bp, Homo sapiens; identical to SEQ ID NO: 78408
  misc_feature 1..30: note = chr16:1264397-1264427
  misc_feature 1..30: note = Hypo
  source 1..30: mol_type = genomic DNA

SEQ ID NO: 111382 - DNA, 183 bp, Homo sapiens; identical to SEQ ID NO: 78409
  misc_feature 1..183: note = chr16:1265150-1265333
  misc_feature 1..183: note = Hypo
  source 1..183: mol_type = genomic DNA

SEQ ID NO: 111383 - DNA, 97 bp, Homo sapiens; identical to SEQ ID NO: 78410
  misc_feature 1..97: note = chr16:1265614-1265711
  misc_feature 1..97: note = Hypo
  source 1..97: mol_type = genomic DNA

SEQ ID NO: 111384 - DNA, 40 bp, Homo sapiens; identical to SEQ ID NO: 78411
  misc_feature 1..40: note = chr16:1266380-1266420
  misc_feature 1..40: note = Hypo
  source 1..40: mol_type = genomic DNA

SEQ ID NO: 111385 - DNA, 30 bp, Homo sapiens; identical to SEQ ID NO: 44483
  misc_feature 1..30: note = chr16:1267184-1267214
  misc_feature 1..30: note = Hypo
  source 1..30: mol_type = genomic DNA

SEQ ID NO: 111386 - DNA, 869 bp, Homo sapiens; identical to SEQ ID NO: 78413
  misc_feature 1..869: note = chr16:1267696-1268565
  misc_feature 1..869: note = Hypo
  source 1..869: mol_type = genomic DNA

SEQ ID NO: 111387 - DNA, 252 bp, Homo sapiens; identical to SEQ ID NO: 78414
  misc_feature 1..252: note = chr16:1270197-1270449
  misc_feature 1..252: note = Hypo
  source 1..252: mol_type = genomic DNA

SEQ ID NO: 111388 - DNA, 517 bp, Homo sapiens; identical to SEQ ID NO: 78415
  misc_feature 1..517: note = chr16:1271155-1271672
  misc_feature 1..517: note = Hypo
  source 1..517: mol_type = genomic DNA

SEQ ID NO: 111389 - DNA, 38 bp, Homo sapiens; identical to SEQ ID NO: 44487
  misc_feature 1..38: note = chr16:1272194-1272232
  misc_feature 1..38: note = Hypo
  source 1..38: mol_type = genomic DNA

SEQ ID NO: 111390 - DNA, 30 bp, Homo sapiens; identical to SEQ ID NO: 44488
  misc_feature 1..30: note = chr16:1288468-1288498
  misc_feature 1..30: note = Hypo
  source 1..30: mol_type = genomic DNA

SEQ ID NO: 111391 - DNA, 30 bp, Homo sapiens; identical to SEQ ID NO: 78423
  misc_feature 1..30: note = chr16:1297961-1297991
  misc_feature 1..30: note = Hypo
  source 1..30: mol_type = genomic DNA

SEQ ID NO: 111392 - DNA, 64 bp, Homo sapiens; identical to SEQ ID NO: 78427
  misc_feature 1..64: note = chr16:1307000-1307064
  misc_feature 1..64: note = Hypo
  source 1..64: mol_type = genomic DNA

SEQ ID NO: 111393 - DNA, 30 bp, Homo sapiens; identical to SEQ ID NO: 78428
  misc_feature 1..30: note = chr16:1307785-1307815
  misc_feature 1..30: note = Hypo
  source 1..30: mol_type = genomic DNA

SEQ ID NO: 111394 - DNA, 318 bp, Homo sapiens; identical to SEQ ID NO: 78429
  misc_feature 1..318: note = chr16:1312397-1312715
  misc_feature 1..318: note = Hypo
  source 1..318: mol_type = genomic DNA

SEQ ID NO: 111395 - DNA, 133 bp, Homo sapiens; identical to SEQ ID NO: 44491
  misc_feature 1..133: note = chr16:1315371-1315504
  misc_feature 1..133: note = Hypo
  source 1..133: mol_type = genomic DNA

SEQ ID NO: 111396 - DNA, 30 bp, Homo sapiens; identical to SEQ ID NO: 78431
  misc_feature 1..30: note = chr16:1316065-1316095
  misc_feature 1..30: note = Hypo
  source 1..30: mol_type = genomic DNA

SEQ ID NO: 111397 - DNA, 33 bp, Homo sapiens; identical to SEQ ID NO: 78432
  misc_feature 1..33: note = chr16:1321465-1321498
  misc_feature 1..33: note = Hypo
  source 1..33: mol_type = genomic DNA

SEQ ID NO: 111398 - DNA, 432 bp, Homo sapiens; identical to SEQ ID NO: 78433
  misc_feature 1..432: note = chr16:1323678-1324110
  misc_feature 1..432: note = Hypo
  source 1..432: mol_type = genomic DNA

SEQ ID NO: 111399 - DNA, 51 bp, Homo sapiens; identical to SEQ ID NO: 78435
  misc_feature 1..51: note = chr16:1329677-1329728
  misc_feature 1..51: note = Hypo
  source 1..51: mol_type = genomic DNA

SEQ ID NO: 111400 - DNA, 36 bp, Homo sapiens; identical to SEQ ID NO: 78436
  misc_feature 1..36: note = chr16:1330337-1330373
  misc_feature 1..36: note = Hypo
  source 1..36: mol_type = genomic DNA

SEQ ID NO: 111401 - DNA, 280 bp, Homo sapiens; identical to SEQ ID NO: 78437
  misc_feature 1..280: note = chr16:1330636-1330916
  misc_feature 1..280: note = Hypo
  source 1..280: mol_type = genomic DNA

SEQ ID NO: 111402 - DNA, 324 bp, Homo sapiens; identical to SEQ ID NO: 36012
  misc_feature 1..324: note = chr16:1382374-1382698
  misc_feature 1..324: note = Hyper
  source 1..324: mol_type = genomic DNA

SEQ ID NO: 111403 - DNA, 324 bp, Homo sapiens; identical to SEQ ID NO: 36013
  misc_feature 1..324: note = chr16:1382818-1383142
  misc_feature 1..324: note = Hyper
  source 1..324: mol_type = genomic DNA

SEQ ID NO: 111404 - DNA, 420 bp, Homo sapiens
  misc_feature 1..420: note = chr16:1383678-1384098
  misc_feature 1..420: note = Hyper
  source 1..420: mol_type = genomic DNA
gtgcctcggcgtccccgagctggtgccgagcgcagcgccccaggagcccccccatccccgcgccggcccacggtaagtgccgcgggctgcggccagtgctgttgggccgccgtctgggctcggccccgcgccccaacccggacggaccgacggccgccgcccccttggtccgggtcccccaggaggcacgggggtggcctccgaggcggggggcggtgggaaggtctcgacgtcccctcggccctggggaaactgaggccgcgcatgcttggaggggcggggtctcgggggcatttcccctccgaacgcgcaggagagggtgcggcggtggggtccgcactgcggagcggacggggagggtatccgggcgctggcgacggcctcccccgcacttgagccgccaagcgaggcttcgacccc

SEQ ID NO: 111405 - DNA, 312 bp, Homo sapiens; identical to SEQ ID NO: 78444
  misc_feature 1..312: note = chr16:1384458-1384770
  misc_feature 1..312: note = Hyper
  source 1..312: mol_type = genomic DNA

SEQ ID NO: 111406 - DNA, 30 bp, Homo sapiens; identical to SEQ ID NO: 78445
  misc_feature 1..30: note = chr16:1390516-1390546
  misc_feature 1..30: note = Hypo
  source 1..30: mol_type = genomic DNA

SEQ ID NO: 111407 - DNA, 527 bp, Homo sapiens; identical to SEQ ID NO: 78446
  misc_feature 1..527: note = chr16:1391705-1392232
  misc_feature 1..527: note = Hypo
  source 1..527: mol_type = genomic DNA

SEQ ID NO: 111408 - DNA, 30 bp, Homo sapiens; identical to SEQ ID NO: 78447
  misc_feature 1..30: note = chr16:1394474-1394504
  misc_feature 1..30: note = Hypo
  source 1..30: mol_type = genomic DNA

SEQ ID NO: 111409 - DNA, 30 bp, Homo sapiens; identical to SEQ ID NO: 44496
  misc_feature 1..30: note = chr16:1397121-1397151
  misc_feature 1..30: note = Hypo
  source 1..30: mol_type = genomic DNA

SEQ ID NO: 111410 - DNA, 437 bp, Homo sapiens; identical to SEQ ID NO: 78449
  misc_feature 1..437: note = chr16:1397422-1397859
  misc_feature 1..437: note = Hypo
  source 1..437: mol_type = genomic DNA

SEQ ID NO: 111411 - DNA, 112 bp, Homo sapiens; identical to SEQ ID NO: 78451
  misc_feature 1..112: note = chr16:1400845-1400957
  misc_feature 1..112: note = Hypo
  source 1..112: mol_type = genomic DNA

SEQ ID NO: 111412 - DNA, 30 bp, Homo sapiens; identical to SEQ ID NO: 78452
  misc_feature 1..30: note = chr16:1404083-1404113
  misc_feature 1..30: note = Hypo
  source 1..30: mol_type = genomic DNA

SEQ ID NO: 111413 - DNA, 32 bp, Homo sapiens; identical to SEQ ID NO: 78453
  misc_feature 1..32: note = chr16:1407453-1407485
  misc_feature 1..32: note = Hypo
  source 1..32: mol_type = genomic DNA

SEQ ID NO: 111414 - DNA, 151 bp, Homo sapiens; identical to SEQ ID NO: 78454
  misc_feature 1..151: note = chr16:1407785-1407936
  misc_feature 1..151: note = Hypo
  source 1..151: mol_type = genomic DNA

SEQ ID NO: 111415 - DNA, 364 bp, Homo sapiens; identical to SEQ ID NO: 78455
  misc_feature 1..364: note = chr16:1417076-1417440
  misc_feature 1..364: note = Hypo
  source 1..364: mol_type = genomic DNA

SEQ ID NO: 111416 - DNA, 431 bp, Homo sapiens; identical to SEQ ID NO: 78456
  misc_feature 1..431: note = chr16:1417675-1418106
  misc_feature 1..431: note = Hypo
  source 1..431: mol_type = genomic DNA

SEQ ID NO: 111417 - DNA, 30 bp, Homo sapiens; identical to SEQ ID NO: 78457
  misc_feature 1..30: note = chr16:1424439-1424469
  misc_feature 1..30: note = Hypo
  source 1..30: mol_type = genomic DNA

SEQ ID NO: 111418 - DNA, 284 bp, Homo sapiens; identical to SEQ ID NO: 78458
  misc_feature 1..284: note = chr16:1425400-1425684
  misc_feature 1..284: note = Hypo
  source 1..284: mol_type = genomic DNA

SEQ ID NO: 111419 - DNA, 794 bp, Homo sapiens; identical to SEQ ID NO: 44503
  misc_feature 1..794: note = chr16:1428113-1428907
  misc_feature 1..794: note = Hypo
  source 1..794: mol_type = genomic DNA

SEQ ID NO: 111420 - DNA, 266 bp, Homo sapiens; identical to SEQ ID NO: 78461
  misc_feature 1..266: note = chr16:1430200-1430466
  misc_feature 1..266: note = Hypo
  source 1..266: mol_type = genomic DNA

SEQ ID NO: 111421 - DNA, 39 bp, Homo sapiens; identical to SEQ ID NO: 78465
  misc_feature 1..39: note = chr16:1469293-1469332
  misc_feature 1..39: note = Hypo
  source 1..39: mol_type = genomic DNA

SEQ ID NO: 111422 - DNA, 98 bp, Homo sapiens; identical to SEQ ID NO: 78466
  misc_feature 1..98: note = chr16:1469572-1469670
  misc_feature 1..98: note = Hypo
  source 1..98: mol_type = genomic DNA

SEQ ID NO: 111423 - DNA, 91 bp, Homo sapiens; identical to SEQ ID NO: 78472
  misc_feature 1..91: note = chr16:1477599-1477690
  misc_feature 1..91: note = Hypo
  source 1..91: mol_type = genomic DNA

SEQ ID NO: 111424 - DNA, 367 bp, Homo sapiens; identical to SEQ ID NO: 78473
  misc_feature 1..367: note = chr16:1486290-1486657
  misc_feature 1..367: note = Hypo
  source 1..367: mol_type = genomic DNA

SEQ ID NO: 111425 - DNA, 129 bp, Homo sapiens; identical to SEQ ID NO: 78474
  misc_feature 1..129: note = chr16:1487040-1487169
  misc_feature 1..129: note = Hypo
  source 1..129: mol_type = genomic DNA

SEQ ID NO: 111426 - DNA, 49 bp, Homo sapiens; identical to SEQ ID NO: 78475
  misc_feature 1..49: note = chr16:1487580-1487629
  misc_feature 1..49: note = Hypo
  source 1..49: mol_type = genomic DNA

SEQ ID NO: 111427 - DNA, 150 bp, Homo sapiens; identical to SEQ ID NO: 78476
  misc_feature 1..150: note = chr16:1487901-1488051
  misc_feature 1..150: note = Hypo
  source 1..150: mol_type = genomic DNA

SEQ ID NO: 111428 - DNA, 30 bp, Homo sapiens; identical to SEQ ID NO: 44506
  misc_feature 1..30: note = chr16:1488680-1488710
  misc_feature 1..30: note = Hypo
  source 1..30: mol_type = genomic DNA

SEQ ID NO: 111429 - DNA, 498 bp, Homo sapiens; identical to SEQ ID NO: 78478
  misc_feature 1..498: note = chr16:1491115-1491613
  misc_feature 1..498: note = Hypo
  source 1..498: mol_type = genomic DNA

SEQ ID NO: 111430 - DNA, 117 bp, Homo sapiens; identical to SEQ ID NO: 78479
  misc_feature 1..117: note = chr16:1493574-1493691
  misc_feature 1..117: note = Hypo
  source 1..117: mol_type = genomic DNA

SEQ ID NO: 111431 - DNA, 24 bp, Homo sapiens
  misc_feature 1..24: note = chr16:1524070-1524094
  misc_feature 1..24: note = Hypo
  source 1..24: mol_type = genomic DNA
gtgaaactccgtctcaaaaaaaaa

SEQ ID NO: 111432 - DNA, 24 bp, Homo sapiens
  misc_feature 1..24: note = chr16:1523806-1523830
  misc_feature 1..24: note = Hypo
  source 1..24: mol_type = genomic DNA
aggcgcagtggctcacgcctgtaa

SEQ ID NO: 111433 - DNA, 86 bp, Homo sapiens; identical to SEQ ID NO: 78485
  misc_feature 1..86: note = chr16:1541511-1541597
  misc_feature 1..86: note = Hypo
  source 1..86: mol_type = genomic DNA

SEQ ID NO: 111434 - DNA, 30 bp, Homo sapiens; identical to SEQ ID NO: 78501
  misc_feature 1..30: note = chr16:1576652-1576682
  misc_feature 1..30: note = Hypo
  source 1..30: mol_type = genomic DNA

SEQ ID NO: 111435 - DNA, 30 bp, Homo sapiens; identical to SEQ ID NO: 78503
  misc_feature 1..30: note = chr16:1580669-1580699
  misc_feature 1..30: note = Hypo
  source 1..30: mol_type = genomic DNA

SEQ ID NO: 111436 - DNA, 119 bp, Homo sapiens; identical to SEQ ID NO: 78510
  misc_feature 1..119: note = chr16:1642740-1642859
  misc_feature 1..119: note = Hypo
  source 1..119: mol_type = genomic DNA

SEQ ID NO: 111437 - DNA, 30 bp, Homo sapiens; identical to SEQ ID NO: 78512
  misc_feature 1..30: note = chr16:1682337-1682367
  misc_feature 1..30: note = Hypo
  source 1..30: mol_type = genomic DNA

SEQ ID NO: 111438 - DNA, 30 bp, Homo sapiens; identical to SEQ ID NO: 78517
  misc_feature 1..30: note = chr16:1725008-1725038
  misc_feature 1..30: note = Hypo
  source 1..30: mol_type = genomic DNA

SEQ ID NO: 111439 - DNA, 120 bp, Homo sapiens; identical to SEQ ID NO: 78519
  misc_feature 1..120: note = chr16:1729679-1729799
  misc_feature 1..120: note = Hypo
  source 1..120: mol_type = genomic DNA

SEQ ID NO: 111440 - DNA, 455 bp, Homo sapiens; identical to SEQ ID NO: 44511
  misc_feature 1..455: note = chr16:1730306-1730761
  misc_feature 1..455: note = Hypo
  source 1..455: mol_type = genomic DNA

SEQ ID NO: 111441 - DNA, 30 bp, Homo sapiens; identical to SEQ ID NO: 44512
  misc_feature 1..30: note = chr16:1734955-1734985
  misc_feature 1..30: note = Hypo
  source 1..30: mol_type = genomic DNA

SEQ ID NO: 111442 - DNA, 30 bp, Homo sapiens; identical to SEQ ID NO: 78525
  misc_feature 1..30: note = chr16:1738302-1738332
  misc_feature 1..30: note = Hypo
  source 1..30: mol_type = genomic DNA

SEQ ID NO: 111443 - DNA, 42 bp, Homo sapiens; identical to SEQ ID NO: 78526
  misc_feature 1..42: note = chr16:1738667-1738709
  misc_feature 1..42: note = Hypo
  source 1..42: mol_type = genomic DNA

SEQ ID NO: 111444 - DNA, 54 bp, Homo sapiens; identical to SEQ ID NO: 78527
  misc_feature 1..54: note = chr16:1740152-1740206
  misc_feature 1..54: note = Hypo
  source 1..54: mol_type = genomic DNA

SEQ ID NO: 111445 - DNA, 386 bp, Homo sapiens; identical to SEQ ID NO: 78528
  misc_feature 1..386: note = chr16:1741726-1742112
  misc_feature 1..386: note = Hypo
  source 1..386: mol_type = genomic DNA

SEQ ID NO: 111446 - DNA, 30 bp, Homo sapiens; identical to SEQ ID NO: 78532
  misc_feature 1..30: note = chr16:1782670-1782700
  misc_feature 1..30: note = Hypo
  source 1..30: mol_type = genomic DNA

SEQ ID NO: 111447 - DNA, 30 bp, Homo sapiens; identical to SEQ ID NO: 78535
  misc_feature 1..30: note = chr16:1793857-1793887
  misc_feature 1..30: note = Hypo
  source 1..30: mol_type = genomic DNA

SEQ ID NO: 111448 - DNA, 119 bp, Homo sapiens; identical to SEQ ID NO: 78536
  misc_feature 1..119: note = chr16:1807880-1807999
  misc_feature 1..119: note = Hypo
  source 1..119: mol_type = genomic DNA

SEQ ID NO: 111449 - DNA, 555 bp, Homo sapiens; identical to SEQ ID NO: 78537
  misc_feature 1..555: note = chr16:1813482-1814037
  misc_feature 1..555: note = Hypo
  source 1..555: mol_type = genomic DNA

SEQ ID NO: 111450 - DNA, 116 bp, Homo sapiens; identical to SEQ ID NO: 78538
  misc_feature 1..116: note = chr16:1814253-1814369
  misc_feature 1..116: note = Hypo
  source 1..116: mol_type = genomic DNA

SEQ ID NO: 111451 - DNA, 68 bp, Homo sapiens; identical to SEQ ID NO: 78539
  misc_feature 1..68: note = chr16:1831357-1831425
  misc_feature 1..68: note = Hypo
  source 1..68: mol_type = genomic DNA

SEQ ID NO: 111452 - DNA, 77 bp, Homo sapiens; identical to SEQ ID NO: 78540
  misc_feature 1..77: note = chr16:1833990-1834067
  misc_feature 1..77: note = Hypo
  source 1..77: mol_type = genomic DNA

SEQ ID NO: 111453 - DNA, 36 bp, Homo sapiens; identical to SEQ ID NO: 78541
  misc_feature 1..36: note = chr16:1839644-1839680
  misc_feature 1..36: note = Hypo
  source 1..36: mol_type = genomic DNA

SEQ ID NO: 111454 - DNA, 30 bp, Homo sapiens; identical to SEQ ID NO: 78542
  misc_feature 1..30: note = chr16:1844136-1844166
  misc_feature 1..30: note = Hypo
  source 1..30: mol_type = genomic DNA

SEQ ID NO: 111455 - DNA, 30 bp, Homo sapiens; identical to SEQ ID NO: 78543
  misc_feature 1..30: note = chr16:1854152-1854182
  misc_feature 1..30: note = Hypo
  source 1..30: mol_type = genomic DNA

SEQ ID NO: 111456 - DNA, 30 bp, Homo sapiens; identical to SEQ ID NO: 78546
  misc_feature 1..30: note = chr16:1889598-1889628
  misc_feature 1..30: note = Hypo
  source 1..30: mol_type = genomic DNA

SEQ ID NO: 111457 - DNA, 17 bp, Homo sapiens
  misc_feature 1..17: note = chr16:1900285-1900302
  misc_feature 1..17: note = Hypo
  source 1..17: mol_type = genomic DNA
gtaaaaataacaggccg

SEQ ID NO: 111458 - DNA, 212 bp, Homo sapiens
  misc_feature 1..212: note = chr16:1922108-1922320
  misc_feature 1..212: note = Hyper
  source 1..212: mol_type = genomic DNA
ctcgggccacagcctcgtgcaggtgcgacggccgcgcgaccgttagcgcgaggccccgccccgtcctcagcgactccgcccccaccgctcactgactccgcccccaccgctcactggctccgcccccaccgctcactggctccgcccccaacgcgctcagactcagccctcgggggaggggaggggagcccggttcccgtttcctccttctt

SEQ ID NO: 111459 - DNA, 30 bp, Homo sapiens; identical to SEQ ID NO: 78556
  misc_feature 1..30: note = chr16:1946488-1946518
  misc_feature 1..30: note = Hypo
  source 1..30: mol_type = genomic DNA

SEQ ID NO: 111460 - DNA, 30 bp, Homo sapiens; identical to SEQ ID NO: 44519
  misc_feature 1..30: note = chr16:1946973-1947003
  misc_feature 1..30: note = Hypo
  source 1..30: mol_type = genomic DNA

SEQ ID NO: 111461 - DNA, 30 bp, Homo sapiens; identical to SEQ ID NO: 78565
  misc_feature 1..30: note = chr16:1960214-1960244
  misc_feature 1..30: note = Hypo
  source 1..30: mol_type = genomic DNA

SEQ ID NO: 111462 - DNA, 36 bp, Homo sapiens; identical to SEQ ID NO: 78566
  misc_feature 1..36: note = chr16:1962525-1962561
  misc_feature 1..36: note = Hypo
  source 1..36: mol_type = genomic DNA

SEQ ID NO: 111463 - DNA, 90 bp, Homo sapiens; identical to SEQ ID NO: 78567
  misc_feature 1..90: note = chr16:1967819-1967909
  misc_feature 1..90: note = Hyper
  source 1..90: mol_type = genomic DNA

SEQ ID NO: 111464 - DNA, 898 bp, Homo sapiens; identical to SEQ ID NO: 78568
  misc_feature 1..898: note = chr16:1968132-1969030
  misc_feature 1..898: note = Hyper
  source 1..898: mol_type = genomic DNA

SEQ ID NO: 111465 - DNA, 30 bp, Homo sapiens; identical to SEQ ID NO: 78576
  misc_feature 1..30: note = chr16:2020979-2021009
  misc_feature 1..30: note = Hypo
  source 1..30: mol_type = genomic DNA

SEQ ID NO: 111466 - DNA, 668 bp, Homo sapiens; identical to SEQ ID NO: 78577
  misc_feature 1..668: note = chr16:2028539-2029207
  misc_feature 1..668: note = Hypo
  source 1..668: mol_type = genomic DNA

SEQ ID NO: 111467 - DNA, 32 bp, Homo sapiens; identical to SEQ ID NO: 78579
  misc_feature 1..32: note = chr16:2033521-2033553
  misc_feature 1..32: note = Hyper
  source 1..32: mol_type = genomic DNA

SEQ ID NO: 111468 - DNA, 1656 bp, Homo sapiens
  misc_feature 1..1656: note = chr16:2040847-2042503
  misc_feature 1..1656: note = Hyper
  source 1..1656: mol_type = genomic DNA
aacctctgggccagccgcacctcggcgcctgtcttggaggagggcggtgcccacggtggggcaggggctttggcctcccctgcggagtggctctgaccagaccgggaggcaggacgctgcgttttggtccgagcgcacgtcccgacttgtggcccactcttggggacaagtgcatgtcccggcttcccccttggctccactctcggagctggagcgggaaaggagcgaagggatgaggttgaggctggaggtcgtttcttggaaacacagggctgccccgtgcagcgctggttaaaatgactgcggtccccctcatgcctgtctcccggaactggtgggcaggaggcattgaggtttgacggaacctcagaggtcaacggtgtcatcttttcagcccaaacacttacaggtgatattaataatcagtcacgtgggggctgtcatccctcgggtacccaccacgtgcaggaagctgggtggacatgtctgtcccagcactgcatgagctgtgcccgtcaccctatttgcatgctagaaaacaggccagacagttcccaaccgcgcaggaagcaacagctccgctgcctccataccctccctcccgccccgctctgcctgctgcactctcacctccccttcgccgttccggctccagcctgggaatcgcgggcccaggtgaaggctcctgttcccacactcttgagtgggctctgaggggactccacgggcccacgcggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggtgggcggggccggggcggtgagcgcggagagccttccgggtgggcggggagggggcggggcctgggcggggaacaccgctggagtttccagctgggcgtggccgtgacgaggggcggggactgaggcagggagtgtcaatgggcctcccgggtgggcggggagggggcggagcctggacggggagcgccgcgggactttctaggtaggcggggcccgggtctgggcggagcctgggcgcggaacgggtctggcgctcccgggtgggcggggtcagcgcaggagagggagg

SEQ ID NO: 111469 - DNA, 36 bp, Homo sapiens; identical to SEQ ID NO: 78587
  misc_feature 1..36: note = chr16:2048205-2048241
  misc_feature 1..36: note = Hypo
  source 1..36: mol_type = genomic DNA

SEQ ID NO: 111470 - DNA, 92 bp, Homo sapiens; identical to SEQ ID NO: 78588
  misc_feature 1..92: note = chr16:2068929-2069021
  misc_feature 1..92: note = Hypo
  source 1..92: mol_type = genomic DNA

SEQ ID NO: 111471 - DNA, 653 bp, Homo sapiens
  misc_feature 1..653: note = chr16:2069769-2070422
  misc_feature 1..653: note = Hyper
  source 1..653: mol_type = genomic DNA
cctgcaggggacccacggctcgcctccagcctcctgcgctccggtacctgggcgtcccaactccactgcgcgcccaaacccagccgagccggttcgtggcccgccccgccgggcggccgtcgacgcgagcgccctggcgtggcgcccaggggagcggggggctcccgcgagccggccgcggctggcactgctgctgcttctgctcctgctgccgctgccctccggcgcgtggtacaagcacgtggcgagtccccgctaccacacggtgggccgcgccgctggcctgctcatggggctgcgtcgctcaccctatctgtggcgccgcgcgctgcgcgcggccgccgggcccctggccagggacaccctctcccccgaacccgcagcccgcgaggctcctctcctgctgccctcgtgggttcaggagctgtgggagacgcgacgcaggagctcccaggcagggatccccgtccgtgcgccccggagcccgcgcgccccagagcctgcgctggaaccggagtccctggacttcagcggagctggccaggtacgtgagaggggagaggcctggaccgccgcgggcaagggggtctcgggaggtctgagccggagcacggagccgcgcgttcagggggcaccctcgggcccttccattc

SEQ ID NO: 111472 - DNA, 51 bp, Homo sapiens; identical to SEQ ID NO: 78591
  misc_feature 1..51: note = chr16:2083370-2083421
  misc_feature 1..51: note = Hyper
  source 1..51: mol_type = genomic DNA

SEQ ID NO: 111473 - DNA, 622 bp, Homo sapiens; identical to SEQ ID NO: 78593
  misc_feature 1..622: note = chr16:2104762-2105384
  misc_feature 1..622: note = Hypo
  source 1..622: mol_type = genomic DNA

SEQ ID NO: 111474 - DNA, 41 bp, Homo sapiens; identical to SEQ ID NO: 78594
  misc_feature 1..41: note = chr16:2106600-2106641
  misc_feature 1..41: note = Hypo
  source 1..41: mol_type = genomic DNA

SEQ ID NO: 111475 - DNA, 42 bp, Homo sapiens; identical to SEQ ID NO: 78595
  misc_feature 1..42: note = chr16:2107015-2107057
  misc_feature 1..42: note = Hypo
  source 1..42: mol_type = genomic DNA

SEQ ID NO: 111476 - DNA, 30 bp, Homo sapiens; identical to SEQ ID NO: 78596
  misc_feature 1..30: note = chr16:2128577-2128607
  misc_feature 1..30: note = Hypo
  source 1..30: mol_type = genomic DNA

SEQ ID NO: 111477 - DNA, 127 bp, Homo sapiens; identical to SEQ ID NO: 78598
  misc_feature 1..127: note = chr16:2129118-2129245
  misc_feature 1..127: note = Hypo
  source 1..127: mol_type = genomic DNA

SEQ ID NO: 111478 - DNA, 98 bp, Homo sapiens; identical to SEQ ID NO: 78601
  misc_feature 1..98: note = chr16:2131668-2131766
  misc_feature 1..98: note = Hypo
  source 1..98: mol_type = genomic DNA

SEQ ID NO: 111479 - DNA, 30 bp, Homo sapiens; identical to SEQ ID NO: 78603
  misc_feature 1..30: note = chr16:2141909-2141939
  misc_feature 1..30: note = Hypo
  source 1..30: mol_type = genomic DNA

SEQ ID NO: 111480 - DNA, 82 bp, Homo sapiens; identical to SEQ ID NO: 78604
  misc_feature 1..82: note = chr16:2142546-2142628
  misc_feature 1..82: note = Hypo
  source 1..82: mol_type = genomic DNA

SEQ ID NO: 111481 - DNA, 102 bp, Homo sapiens; identical to SEQ ID NO: 44525
  misc_feature 1..102: note = chr16:2145625-2145727
  misc_feature 1..102: note = Hypo
  source 1..102: mol_type = genomic DNA

SEQ ID NO: 111482 - DNA, 99 bp, Homo sapiens; identical to SEQ ID NO: 78606
  misc_feature 1..99: note = chr16:2146363-2146462
  misc_feature 1..99: note = Hypo
  source 1..99: mol_type = genomic DNA

SEQ ID NO: 111483 - DNA, 32 bp, Homo sapiens; identical to SEQ ID NO: 78608
  misc_feature 1..32: note = chr16:2151266-2151298
  misc_feature 1..32: note = Hypo
  source 1..32: mol_type = genomic DNA

SEQ ID NO: 111484 - DNA, 135 bp, Homo sapiens; identical to SEQ ID NO: 78621
  misc_feature 1..135: note = chr16:2193270-2193405
  misc_feature 1..135: note = Hypo
  source 1..135: mol_type = genomic DNA

SEQ ID NO: 111485 - DNA, 142 bp, Homo sapiens; identical to SEQ ID NO: 44529
  misc_feature 1..142: note = chr16:2212716-2212858
  misc_feature 1..142: note = Hypo
  source 1..142: mol_type = genomic DNA

SEQ ID NO: 111486 - DNA, 72 bp, Homo sapiens; identical to SEQ ID NO: 78623
  misc_feature 1..72: note = chr16:2213240-2213312
  misc_feature 1..72: note = Hypo
  source 1..72: mol_type = genomic DNA

SEQ ID NO: 111487 - DNA, 78 bp, Homo sapiens; identical to SEQ ID NO: 78624
  misc_feature 1..78: note = chr16:2213645-2213723
  misc_feature 1..78: note = Hypo
  source 1..78: mol_type = genomic DNA

SEQ ID NO: 111488 - DNA, 533 bp, Homo sapiens; identical to SEQ ID NO: 78630
  misc_feature 1..533: note = chr16:2229690-2230223
  misc_feature 1..533: note = Hypo
  source 1..533: mol_type = genomic DNA

SEQ ID NO: 111489 - DNA, 695 bp, Homo sapiens; identical to SEQ ID NO: 78631
  misc_feature 1..695: note = chr16:2230488-2231183
  misc_feature 1..695: note = Hypo
  source 1..695: mol_type = genomic DNA

SEQ ID NO: 111490 - DNA, 81 bp, Homo sapiens; identical to SEQ ID NO: 44534
  misc_feature 1..81: note = chr16:2232745-2232826
  misc_feature 1..81: note = Hypo
  source 1..81: mol_type = genomic DNA

SEQ ID NO: 111491 - DNA, 141 bp, Homo sapiens; identical to SEQ ID NO: 44535
  misc_feature 1..141: note = chr16:2233066-2233207
  misc_feature 1..141: note = Hypo
  source 1..141: mol_type = genomic DNA

SEQ ID NO: 111492 - DNA, 57 bp, Homo sapiens; identical to SEQ ID NO: 78635
  misc_feature 1..57: note = chr16:2233791-2233848
  misc_feature 1..57: note = Hypo
  source 1..57: mol_type = genomic DNA

SEQ ID NO: 111493 - DNA, 735 bp, Homo sapiens; identical to SEQ ID NO: 78636
  misc_feature 1..735: note = chr16:2234304-2235039
  misc_feature 1..735: note = Hypo
  source 1..735: mol_type = genomic DNA

SEQ ID NO: 111494 - DNA, 267 bp, Homo sapiens; identical to SEQ ID NO: 78637
  misc_feature 1..267: note = chr16:2237256-2237523
  misc_feature 1..267: note = Hypo
  source 1..267: mol_type = genomic DNA

SEQ ID NO: 111495 - DNA, 108 bp, Homo sapiens; identical to SEQ ID NO: 78638
  misc_feature 1..108: note = chr16:2246993-2247101
  misc_feature 1..108: note = Hyper
  source 1..108: mol_type = genomic DNA

SEQ ID NO: 111496 - DNA, 183 bp, Homo sapiens; identical to SEQ ID NO: 78639
  misc_feature 1..183: note = chr16:2256439-2256622
  misc_feature 1..183: note = Hypo
  source 1..183: mol_type = genomic DNA

SEQ ID NO: 111497 - DNA, 402 bp, Homo sapiens; identical to SEQ ID NO: 78640
  misc_feature 1..402: note = chr16:2278383-2278785
  misc_feature 1..402: note = Hypo
  source 1..402: mol_type = genomic DNA

SEQ ID NO: 111498 - DNA, 199 bp, Homo sapiens; identical to SEQ ID NO: 78641
  misc_feature 1..199: note = chr16:2281203-2281402
  misc_feature 1..199: note = Hypo
  source 1..199: mol_type = genomic DNA

SEQ ID NO: 111499 - DNA, 63 bp, Homo sapiens; identical to SEQ ID NO: 78642
  misc_feature 1..63: note = chr16:2281639-2281702
  misc_feature 1..63: note = Hypo
  source 1..63: mol_type = genomic DNA

SEQ ID NO: 111500 - DNA, 30 bp, Homo sapiens; identical to SEQ ID NO: 78646
  misc_feature 1..30: note = chr16:2285581-2285611
  misc_feature 1..30: note = Hypo
  source 1..30: mol_type = genomic DNA

SEQ ID NO: 111501 - DNA, 95 bp, Homo sapiens; identical to SEQ ID NO: 78647
  misc_feature 1..95: note = chr16:2286027-2286122
  misc_feature 1..95: note = Hypo
  source 1..95: mol_type = genomic DNA

SEQ ID NO: 111502 - DNA, 442 bp, Homo sapiens
  misc_feature 1..442: note = chr16:2287079-2287521
  misc_feature 1..442: note = Hyper
  source 1..442: mol_type = genomic DNA
agacccagacctcagcgccgtgtccgcgctcatggagcagatcaacaggtgtggtgggcagggcccctcgtcgcgaccccccgccgggatctcgccccggcgcggcgccccgaccctgagcgggcccctgtctccgcagcgtgtccgagcacgagtacagctttgtgagcagccagcccctgggccgggaccagtacaaggagatgtacctgttcgtgtacaggtgaggggcgggccgcagggaggggcgcgcggggccgcaggtcgggggctcagcgggtcctccccatctcctaggaaagacgcggtgtcggtcgtggacacctacctgtacccagaccccgaggacgtcttcagccgcgagcccttcgtggtcaagttctcggcccccggcaccggtgagcgggccccgcccctcccctcccgccgagctctgacgccc

SEQ ID NO: 111503 - DNA, 225 bp, Homo sapiens; identical to SEQ ID NO: 78650
  misc_feature 1..225: note = chr16:2294431-2294656
  misc_feature 1..225: note = Hypo
  source 1..225: mol_type = genomic DNA

SEQ ID NO: 111504 - DNA, 41 bp, Homo sapiens; identical to SEQ ID NO: 78654
  misc_feature 1..41: note = chr16:2310480-2310521
  misc_feature 1..41: note = Hypo
  source 1..41: mol_type = genomic DNA

SEQ ID NO: 111505 - DNA, 59 bp, Homo sapiens; identical to SEQ ID NO: 78656
  misc_feature 1..59: note = chr16:2324166-2324225
  misc_feature 1..59: note = Hypo
  source 1..59: mol_type = genomic DNA

SEQ ID NO: 111506 - DNA, 66 bp, Homo sapiens; identical to SEQ ID NO: 78657
  misc_feature 1..66: note = chr16:2327703-2327769
  misc_feature 1..66: note = Hypo
  source 1..66: mol_type = genomic DNA

SEQ ID NO: 111507 - DNA, 166 bp, Homo sapiens; identical to SEQ ID NO: 78661
  misc_feature 1..166: note = chr16:2334314-2334480
  misc_feature 1..166: note = Hypo
  source 1..166: mol_type = genomic DNA

SEQ ID NO: 111508 - DNA, 30 bp, Homo sapiens; identical to SEQ ID NO: 44542
  misc_feature 1..30: note = chr16:2436229-2436259
  misc_feature 1..30: note = Hypo
  source 1..30: mol_type = genomic DNA

SEQ ID NO: 111509 - DNA, 24 bp, Homo sapiens
  misc_feature 1..24: note = chr16:2466346-2466370
  misc_feature 1..24: note = Hypo
  source 1..24: mol_type = genomic DNA
gcgagactccgcctcaaaaaaaaa

SEQ ID NO: 111510 - DNA, 62 bp, Homo sapiens; identical to SEQ ID NO: 78700
  misc_feature 1..62: note = chr16:2474253-2474315
  misc_feature 1..62: note = Hypo
  source 1..62: mol_type = genomic DNA

SEQ ID NO: 111511 - DNA, 112 bp, Homo sapiens; identical to SEQ ID NO: 78702
  misc_feature 1..112: note = chr16:2493315-2493427
  misc_feature 1..112: note = Hypo
  source 1..112: mol_type = genomic DNA

SEQ ID NO: 111512 - DNA, 30 bp, Homo sapiens; identical to SEQ ID NO: 78703
  misc_feature 1..30: note = chr16:2493886-2493916
  misc_feature 1..30: note = Hypo
  source 1..30: mol_type = genomic DNA

SEQ ID NO: 111513 - DNA, 174 bp, Homo sapiens; identical to SEQ ID NO: 44545
  misc_feature 1..174: note = chr16:2497879-2498053
  misc_feature 1..174: note = Hypo
  source 1..174: mol_type = genomic DNA

SEQ ID NO: 111514 - DNA, 16 bp, Homo sapiens
  misc_feature 1..16: note = chr16:2508540-2508556
  misc_feature 1..16: note = Hypo
  source 1..16: mol_type = genomic DNA
gcgcctggcccccaaa

SEQ ID NO: 111515 - DNA, 115 bp, Homo sapiens; identical to SEQ ID NO: 78709
  misc_feature 1..115: note = chr16:2510869-2510984
  misc_feature 1..115: note = Hypo
  source 1..115: mol_type = genomic DNA

SEQ ID NO: 111516 - DNA, 30 bp, Homo sapiens; identical to SEQ ID NO: 78711
  misc_feature 1..30: note = chr16:2516812-2516842
  misc_feature 1..30: note = Hypo
  source 1..30: mol_type = genomic DNA

SEQ ID NO: 111517 - DNA, 130 bp, Homo sapiens; identical to SEQ ID NO: 78712
  misc_feature 1..130: note = chr16:2521727-2521857
  misc_feature 1..130: note = Hyper
  source 1..130: mol_type = genomic DNA

SEQ ID NO: 111518 - DNA, 30 bp, Homo sapiens; identical to SEQ ID NO: 78714
  misc_feature 1..30: note = chr16:2531210-2531240
  misc_feature 1..30: note = Hypo
  source 1..30: mol_type = genomic DNA

SEQ ID NO: 111519 - DNA, 149 bp, Homo sapiens; identical to SEQ ID NO: 78715
  misc_feature 1..149: note = chr16:2531804-2531953
  misc_feature 1..149: note = Hypo
  source 1..149: mol_type = genomic DNA

SEQ ID NO: 111520 - DNA, 44 bp, Homo sapiens; identical to SEQ ID NO: 78716
  misc_feature 1..44: note = chr16:2539796-2539840
  misc_feature 1..44: note = Hypo
  source 1..44: mol_type = genomic DNA

SEQ ID NO: 111521 - DNA, 105 bp, Homo sapiens; identical to SEQ ID NO: 78717
  misc_feature 1..105: note = chr16:2540828-2540933
  misc_feature 1..105: note = Hypo
  source 1..105: mol_type = genomic DNA

SEQ ID NO: 111522 - DNA, 101 bp, Homo sapiens; identical to SEQ ID NO: 78718
  misc_feature 1..101: note = chr16:2546405-2546506
  misc_feature 1..101: note = Hypo
  source 1..101: mol_type = genomic DNA

SEQ ID NO: 111523 - DNA, 30 bp, Homo sapiens; identical to SEQ ID NO: 78719
  misc_feature 1..30: note = chr16:2548427-2548457
  misc_feature 1..30: note = Hypo
  source 1..30: mol_type = genomic DNA

SEQ ID NO: 111524 - DNA, 87 bp, Homo sapiens; identical to SEQ ID NO: 78727
  misc_feature 1..87: note = chr16:2589044-2589131
  misc_feature 1..87: note = Hypo
  source 1..87: mol_type = genomic DNA

SEQ ID NO: 111525 - DNA, 30 bp, Homo sapiens; identical to SEQ ID NO: 78739
  misc_feature 1..30: note = chr16:2712995-2713025
  misc_feature 1..30: note = Hypo
  source 1..30: mol_type = genomic DNA

SEQ ID NO: 111526 - DNA, 120 bp, Homo sapiens; identical to SEQ ID NO: 78742
  misc_feature 1..120: note = chr16:2731636-2731756
  misc_feature 1..120: note = Hypo
  source 1..120: mol_type = genomic DNA

SEQ ID NO: 111527 - DNA, 94 bp, Homo sapiens; identical to SEQ ID NO: 78744
  misc_feature 1..94: note = chr16:2762746-2762840
  misc_feature 1..94: note = Hypo
  source 1..94: mol_type = genomic DNA

SEQ ID NO: 111528 - DNA, 613 bp, Homo sapiens; identical to SEQ ID NO: 78745
  misc_feature 1..613: note = chr16:2764096-2764709
  misc_feature 1..613: note = Hypo
  source 1..613: mol_type = genomic DNA

SEQ ID NO: 111529 - DNA, 86 bp, Homo sapiens; identical to SEQ ID NO: 78746
  misc_feature 1..86: note = chr16:2765717-2765803
  misc_feature 1..86: note = Hyper
  source 1..86: mol_type = genomic DNA

SEQ ID NO: 111530 - DNA, 444 bp, Homo sapiens; identical to SEQ ID NO: 78748
  misc_feature 1..444: note = chr16:2770092-2770536
  misc_feature 1..444: note = Hypo
  source 1..444: mol_type = genomic DNA

SEQ ID NO: 111531 - DNA, 210 bp, Homo sapiens; identical to SEQ ID NO: 78752
  misc_feature 1..210: note = chr16:2806195-2806405
  misc_feature 1..210: note = Hypo
  source 1..210: mol_type = genomic DNA

SEQ ID NO: 111532 - DNA, 39 bp, Homo sapiens; identical to SEQ ID NO: 78758
  misc_feature 1..39: note = chr16:2818117-2818156
  misc_feature 1..39: note = Hypo
  source 1..39: mol_type = genomic DNA

SEQ ID NO: 111533 - DNA, 39 bp, Homo sapiens; identical to SEQ ID NO: 78759
  misc_feature 1..39: note = chr16:2819758-2819797
  misc_feature 1..39: note = Hypo
  source 1..39: mol_type = genomic DNA

SEQ ID NO: 111534 - DNA, 57 bp, Homo sapiens
  misc_feature 1..57: note = chr16:2835423-2835480
  misc_feature 1..57: note = Hyper
  source 1..57: mol_type = genomic DNA
gcggcgggcgggcgccgggcacgggcaggcagacgggttggacgcgagcgctcaggg

SEQ ID NO: 111535 - DNA, 267 bp, Homo sapiens; identical to SEQ ID NO: 78761
  misc_feature 1..267: note = chr16:2849356-2849623
  misc_feature 1..267: note = Hypo
  source 1..267: mol_type = genomic DNA

SEQ ID NO: 111536 - DNA, 30 bp, Homo sapiens; identical to SEQ ID NO: 78763
  misc_feature 1..30: note = chr16:2868686-2868716
  misc_feature 1..30: note = Hypo
  source 1..30: mol_type = genomic DNA

SEQ ID NO: 111537 - DNA, 52 bp, Homo sapiens; identical to SEQ ID NO: 78764
  misc_feature 1..52: note = chr16:2877484-2877536
  misc_feature 1..52: note = Hypo
  source 1..52: mol_type = genomic DNA

SEQ ID NO: 111538 - DNA, 30 bp, Homo sapiens; identical to SEQ ID NO: 78765
  misc_feature 1..30: note = chr16:2879766-2879796
  misc_feature 1..30: note = Hypo
  source 1..30: mol_type = genomic DNA

SEQ ID NO: 111539 - DNA, 242 bp, Homo sapiens
  misc_feature 1..242: note = chr16:2892487-2892729
  misc_feature 1..242: note = Hyper
  source 1..242: mol_type = genomic DNA
gaagttggcctgacccgagaagcccaggatcgctgaggaagctccccactgttgtcgcctctcagccccacgcccactcatccacaggcagccgggatgctcacgcagccacgtcacggacctcatctcggcctcgctacgactctgccaacagggggcgctgcaggaggctacgcggtcgcagggactcctttctgtccgtttccgacaaacttcccgcgctcttccggaggttgagggtg

SEQ ID NO: 111540 - DNA, 171 bp, Homo sapiens; identical to SEQ ID NO: 78797
  misc_feature 1..171: note = chr16:2975829-2976000
  misc_feature 1..171: note = Hypo
  source 1..171: mol_type = genomic DNA

SEQ ID NO: 111541 - DNA, 861 bp, Homo sapiens
  misc_feature 1..861: note = chr16:3016793-3017654
  misc_feature 1..861: note = Hyper
  source 1..861: mol_type = genomic DNA
aaggtgaggagtgggcggggaccaggggcctgggcgggcctcgaggtggggcctggccgggcaggggagccgccgtgtcctggtcctcaggatgctgactgccggccccgcccgcagtgtcggtgggctcctgccaggggaactggacagcgcctcagggcgtcatctactccccggacttcccggacgagtacgggccggaccggaactgcagctgggccctgggcccgccaggcgccgcgctggagctcaccttccgcctcttcgagctggccgacccgcgcgaccggctggagctgcgcgacgcggcttcgggcagcctgctccgcgccttcgatggcgcccgcccaccgccgtccgggccgctgcgcctgggcactgccgcgctgctgctcaccttccgaagcgacgcgcgcggccacgcgcaaggcttcgcgctcacctaccgcggtgagcctcagctcggcgcgccctgcccgctgttcccaccccgctctccccaccccgcctcacgcccctctccgcagggctgcaggacgccgctgaggacccagaggcccccgagggctcggcccagacccccgcggcgcccctcgacggggccaacgtgagctgcagccccaggcctggggctccgccggccgcgattgggggtgaggcgggcgcgcgggacgggagtgagtcagggagccgccccctcgcgcccatcctcaccgcagccgtgtgcccgcagcccgggtcttctcgacggtgacggctgtctcggtgctgctgctgctgctcctggggctgctgcgtccgctgcgccgacggtgcggggcgctggggcagggcctgagggcggaccggtggtggggagct

SEQ ID NO: 111542 - DNA, 34 bp, Homo sapiens; identical to SEQ ID NO: 44559
  misc_feature 1..34: note = chr16:3021547-3021581
  misc_feature 1..34: note = Hypo
  source 1..34: mol_type = genomic DNA

SEQ ID NO: 111543 - DNA, 45 bp, Homo sapiens; identical to SEQ ID NO: 78824
  misc_feature 1..45: note = chr16:3026818-3026863
  misc_feature 1..45: note = Hypo
  source 1..45: mol_type = genomic DNA

SEQ ID NO: 111544 - DNA, 280 bp, Homo sapiens; identical to SEQ ID NO: 78834
  misc_feature 1..280: note = chr16:3068171-3068451
  misc_feature 1..280: note = Hyper
  source 1..280: mol_type = genomic DNA

SEQ ID NO: 111545 - DNA, 30 bp, Homo sapiens; identical to SEQ ID NO: 78836
  misc_feature 1..30: note = chr16:3078354-3078384
  misc_feature 1..30: note = Hyper
  source 1..30: mol_type = genomic DNA

SEQ ID NO: 111546 - DNA, 319 bp, Homo sapiens
  misc_feature 1..319: note = chr16:3096690-3097009
  misc_feature 1..319: note = Hyper
  source 1..319: mol_type = genomic DNA
gcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcc

SEQ ID NO: 111547 - DNA, 282 bp, Homo sapiens; identical to SEQ ID NO: 78865
  misc_feature 1..282: note = chr16:3139085-3139367
  misc_feature 1..282: note = Hypo
  source 1..282: mol_type = genomic DNA

SEQ ID NO: 111548 - DNA, 30 bp, Homo sapiens; identical to SEQ ID NO: 78866
  misc_feature 1..30: note = chr16:3142360-3142390
  misc_feature 1..30: note = Hypo
  source 1..30: mol_type = genomic DNA

SEQ ID NO: 111549 - DNA, 30 bp, Homo sapiens; identical to SEQ ID NO: 44561
  misc_feature 1..30: note = chr16:3142599-3142629
  misc_feature 1..30: note = Hypo
  source 1..30: mol_type = genomic DNA

SEQ ID NO: 111550 - DNA, 144 bp, Homo sapiens; identical to SEQ ID NO: 78876
  misc_feature 1..144: note = chr16:3151042-3151186
  misc_feature 1..144: note = Hypo
  source 1..144: mol_type = genomic DNA

SEQ ID NO: 111551 - DNA, 22 bp, Homo sapiens
  misc_feature 1..22: note = chr16:3158301-3158323
  misc_feature 1..22: note = Hypo
  source 1..22: mol_type = genomic DNA
ccgcgcccggcctatagtcagt

SEQ ID NO: 111552 - DNA, 60 bp, Homo sapiens; identical to SEQ ID NO: 78886
  misc_feature 1..60: note = chr16:3177923-3177983
  misc_feature 1..60: note = Hypo
  source 1..60: mol_type = genomic DNA

SEQ ID NO: 111553 - DNA, 29 bp, Homo sapiens
  misc_feature 1..29: note = chr16:3183420-3183449
  misc_feature 1..29: note = Hypo
  source 1..29: mol_type = genomic DNA
aaaatatgaaaattccgccaggcacggtg

SEQ ID NO: 111554 - DNA, 310 bp, Homo sapiens
  misc_feature 1..310: note = chr16:3209099-3209409
  misc_feature 1..310: note = Hyper
  source 1..310: mol_type = genomic DNA
gcgccggggccgatccgacttcccgcttccgtccggcttgcggcccctcgccttgcccggctacaggaaggactcgcctgcgcctcctgactggagccttccacctgggagttctgagtgcgcctaaggcctggcgctgaggcagtggaccccagatccgggacccgaaaggagggcaaacacctccaccgccgcgtctgcctctgcggacgtggccctagatcccgggtggccatggaacttggtctgggcgtgtagttttcctttgagtgggtcggttctaagtttaaatttccgacgagcccagggt

SEQ ID NO: 111555 - DNA, 99 bp, Homo sapiens; identical to SEQ ID NO: 78891
  misc_feature 1..99: note = chr16:3211643-3211742
  misc_feature 1..99: note = Hypo
  source 1..99: mol_type = genomic DNA

SEQ ID NO: 111556 - DNA, 180 bp, Homo sapiens; identical to SEQ ID NO: 78892
  misc_feature 1..180: note = chr16:3211802-3211982
  misc_feature 1..180: note = Hypo
  source 1..180: mol_type = genomic DNA

SEQ ID NO: 111557 - DNA, 1868 bp, Homo sapiens
  misc_feature 1..1868: note = chr16:3220371-3222239
  misc_feature 1..1868: note = Hyper
  source 1..1868: mol_type = genomic DNA
ttcagttcagatccccgcgagggaaggggattaaagagagaaggaagttgagcctctgagcccattgcgccccggaatctgggaggcggcgtgaccaggtgcccgggttccatccgctggggctgggcagcccccctgcccccgcccagtacagaggctcctgccgggggaggcgtccatcgcgttcgcttacttctctagaccaacaagcgagggacgcggagactgagttggctgcggccaccgggtccccggacaccgtcttcattcactcccaccctcagtcaagcacctgtacccgcagtcctttcctaaaagaagaaaaacggccggtcgcgcgctgtccagagtactcagtcctggatccaggaggtggctggcggtgagctgatttccgggttcttaaacccgggcccggggcccaaggccccgcctggtggggtctcatcctgcagtttgagaaaccgaagaaggtaggagagggaggaagcgccggctttgcctgtgaaagattctttcattcgctccattcttgttcttgcgcgctggatttaccaggctaacaaacaacagctgatcacggcaggctgggctcctctgggactcgcaccggggcctctcgcacccaaagcgagaatcatacctctagaccaacaggcctcggtggcgggaagcaccatctttgctcctccactccctcacccccctcccgccccgcgccttatctttctggaacccaagacttcgtattctccgctctccataaacgtcgatgccagctctaggagcgtggccgggagcccacgatcgcggcagcgagaagcccaaccagaggggaggagggagtccccggagtgggacagcgctcaggtctggggtggggttgatctagggcaaaatagggcgggcggcctgtggcgatgggcaggaccctctcgcccaccacacgcggaactcgctggatcctctccacatccaggccgcgtccactggctttccaacctgctcaggtccttaaagaaggattcaaaaggtgttgcggtattggcccaacaggatttgaccctgaggcccactctcaccctaatcataaccgcaaaaccacagcgcctggagagagagtgagagagaaacagaaacggagcgagtgtgtgtcgctgtgatgccctttgccgtcgctgctcatccccagtgacctcctggaactttttcagctcttgctgacagaggaagacacgggggcagagctaacgtctgagtcagggcagaggcgctgggctccatccgagggaggctatgggggcgcctctgggatggagccaaccaccggcgcagtcggatgaaaggtgggctggccgctcagccatcctcctagggcaaggccttgggtatgagtcagcagccccaggtgtgagcgcagacccggtaaccccggcgcaggggaaaatacagcggggagccccaggctgcaggcctgaccctgagcatcccctaccaagcccagtgtggatgggctctgtctccaaggggctggttcaccagggtctccccgcagcgaccccagaattctgccaatcacttggggacggcgatgagctctatccacttcggaatcagccgatttgtgccggattggtggcaggtgtctgaaatgtcagcggaaatacacgcacgggaggctcgttggtctaggggtatgattctcgcttcgggtgcgagaggtcccgggttcaaatcccggacgagccctagaagtggttacttttcccttgtcattttagagaatatagagctagaaaatcggggaccgagcctgaagcctcaactaccagtcgcgttgctccgcttcaggtcggtccaggtctgtg

SEQ ID NO: 111558 - DNA, 254 bp, Homo sapiens; identical to SEQ ID NO: 78899
  misc_feature 1..254: note = chr16:3224942-3225196
  misc_feature 1..254: note = Hyper
  source 1..254: mol_type = genomic DNA

SEQ ID NO: 111559 - DNA, 177 bp, Homo sapiens; identical to SEQ ID NO: 78900
  misc_feature 1..177: note = chr16:3225459-3225636
  misc_feature 1..177: note = Hyper
  source 1..177: mol_type = genomic DNA

SEQ ID NO: 111560 - DNA, 1592 bp, Homo sapiens
  misc_feature 1..1592: note = chr16:3232529-3234121
  misc_feature 1..1592: note = Hyper
  source 1..1592: mol_type = genomic DNA
taacttcgaaggactcgggctgcgctgacctgtcagagctgtctggatctctgatcttcatctaaagtaggaaagggtagaaaccgatattttggaccaaaaaccgggctcgtccgggatttgaacccgggacctctcgcaccctaagcgagaatcatacccctagaccaacgagccacacgccccgtagcctccggcttgtctttgtggccttcgtggagtcctcgtggccagaggtggggacccagcagagcagagctaggaggagactccgatttcctgaagtctggaagagacaagttcaagcgcgggtggacgcggagggagccctgagcccccgcttctccctgcgccgcacaaaatggggagcatcccctgtgcccccacaatccggggccccccgggccctcgcccgcctccgcctctcagccctgggctggggatccgcgcgtcacgccgcgtcgcgtagtgaggagctccagctccggcgggacatgggaacctctcaagagctggcagcggctgcgcggagggtccgcgaaccgcgaccactggacgcccgccttggaaacgctgcagcccggcggcgtggtgcagatgggtggtcagtagaggcctcgccagtgcaccaggaaccagccaccaggccccctacctcgacgcgccccacgcttctcccgctccggtcctctcttctcccccagggaagccaaaacccagaaggtgagcttcccacgtggaacctcaattcaagaggctgacactgagcgtcgcttcgctccaccagacccgcggcgcccgccggagtcagcgatgtacccccttccctttcactgggggaactggcggaacctccggtcaccaggacgtggggaagcagaggccgcttggggcagcagaggccgcgtccaggtgtcggttccggggcaccttttactgtcactctgtccttctctgtgtccaaatttcacccggagcccgagaattcggcaggtctggactgaaaacgtctccccatcccctccggatccaagcctcgaatttcctggctcagtgggaaggcctcggggtctgggcgtggagacggggcccgagacccccaccccgccagggcccactaaagtgctgccagctgagccccggccttcgcccctccttcgtctctccctcattcccctccctctgacaccccgccacatacattactccccgcaataccatgcaattttaagctagggtagggctcacctgagactggagccgccataccgtcgaaccctacgaaaaatttatgcccgtaaataaacaagcccggcgcattcttccttattctaaataacttcttcctgctgcacggggtcgtctcctttaaccacggctaccgcagttggtagtgctggatcccatttcagggtgatgggatgctggatcccatttcagggtgataggaccgaccgcaaggcgaacgattcaggcccgtccgtctgcgtcccgggaccccgggaggtctccactgacgccctgccagcagcaggctccctccgccttcctagtctcctgtccttgctgaaaatgcgaaatgggaaaaaaga

SEQ ID NO: 111561 - DNA, 271 bp, Homo sapiens; identical to SEQ ID NO: 78904
  misc_feature 1..271: note = chr16:3234181-3234452
  misc_feature 1..271: note = Hyper
  source 1..271: mol_type = genomic DNA

SEQ ID NO: 111562 - DNA, 335 bp, Homo sapiens; identical to SEQ ID NO: 78906
  misc_feature 1..335: note = chr16:3237708-3238043
  misc_feature 1..335: note = Hyper
  source 1..335: mol_type = genomic DNA

SEQ ID NO: 111563 - DNA, 1775 bp, Homo sapiens; identical to SEQ ID NO: 78907
  misc_feature 1..1775: note = chr16:3238163-3239938
  misc_feature 1..1775: note = Hyper
  source 1..1775: mol_type = genomic DNA

SEQ ID NO: 111564 - DNA, 35 bp, Homo sapiens; identical to SEQ ID NO: 36049
  misc_feature 1..35: note = chr16:3241024-3241059
  misc_feature 1..35: note = Hyper
  source 1..35: mol_type = genomic DNA

SEQ ID NO: 111565 - DNA, 519 bp, Homo sapiens; identical to SEQ ID NO: 78910
  misc_feature 1..519: note = chr16:3241472-3241991
  misc_feature 1..519: note = Hyper
  source 1..519: mol_type = genomic DNA

SEQ ID NO: 111566 - DNA, 31 bp, Homo sapiens; identical to SEQ ID NO: 78914
  misc_feature 1..31: note = chr16:3269398-3269429
  misc_feature 1..31: note = Hypo
  source 1..31: mol_type = genomic DNA

SEQ ID NO: 111567 - DNA, 46 bp, Homo sapiens; identical to SEQ ID NO: 78915
  misc_feature 1..46: note = chr16:3286277-3286323
  misc_feature 1..46: note = Hypo
  source 1..46: mol_type = genomic DNA

SEQ ID NO: 111568 - DNA, 791 bp, Homo sapiens
  misc_feature 1..791: note = chr16:3355105-3355896
  misc_feature 1..791: note = Hyper
  source 1..791: mol_type = genomic DNA
tcttcctcgaggaggcggcgacgagcccagcaacagctcgagcacggccggccgggccgcgggaagcccgagaacgcggcgcgcgcagctgggaggcgacccttacccggcgaggctcccgggaccaaacgccgcccgacagccacgcagaacagacgcggcagtgcgacgcctcccccactggggacacgagacagcgacagccacgcggtgagccggtacaaggccctctaggcttcagcgggtctggatactcggtggcattaacccttccctaccgccggggaagacagcagtttctctggcgaggaagtaggccgggctcaggcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggtaaccgagaagcggcttcccctatggcttcgaccctggagccgctggagcggcggcggccgcagggaggcagccattttccgtaggcggtggccgcggcgcttccgggccgcgcggctggagcctgaggcggggccaccgtcgggcacgagaaaccattctctccccgcttttcgcagctgtatcccagaggcgcggctgaagctcgctgggacactgcccgcttgcccagtgcccacgggcacgcctgtcg

SEQ ID NO: 111569 - DNA, 86 bp, Homo sapiens; identical to SEQ ID NO: 78930
  misc_feature 1..86: note = chr16:3492682-3492768
  misc_feature 1..86: note = Hypo
  source 1..86: mol_type = genomic DNA

SEQ ID NO: 111570 - DNA, 202 bp, Homo sapiens; identical to SEQ ID NO: 78933
  misc_feature 1..202: note = chr16:3551302-3551504
  misc_feature 1..202: note = Hyper
  source 1..202: mol_type = genomic DNA

SEQ ID NO: 111571 - DNA, 33 bp, Homo sapiens; identical to SEQ ID NO: 16015
  misc_feature 1..33: note = chr16:3598920-3598953
  misc_feature 1..33: note = Hypo
  source 1..33: mol_type = genomic DNA

SEQ ID NO: 111572 - DNA, 30 bp, Homo sapiens; identical to SEQ ID NO: 78936
  misc_feature 1..30: note = chr16:3611471-3611501
  misc_feature 1..30: note = Hypo
  source 1..30: mol_type = genomic DNA

SEQ ID NO: 111573 - DNA, 108 bp, Homo sapiens; identical to SEQ ID NO: 44568
  misc_feature 1..108: note = chr16:3696694-3696802
  misc_feature 1..108: note = Hypo
  source 1..108: mol_type = genomic DNA

SEQ ID NO: 111574 - DNA, 61 bp, Homo sapiens; identical to SEQ ID NO: 78938
  misc_feature 1..61: note = chr16:3740595-3740656
  misc_feature 1..61: note = Hyper
  source 1..61: mol_type = genomic DNA

SEQ ID NO: 111575 - DNA, 118 bp, Homo sapiens; identical to SEQ ID NO: 78939
  misc_feature 1..118: note = chr16:3773018-3773136
  misc_feature 1..118: note = Hypo
  source 1..118: mol_type = genomic DNA

SEQ ID NO: 111576 - DNA, 47 bp, Homo sapiens; identical to SEQ ID NO: 78940
  misc_feature 1..47: note = chr16:3803027-3803074
  misc_feature 1..47: note = Hypo
  source 1..47: mol_type = genomic DNA

SEQ ID NO: 111577 - DNA, 30 bp, Homo sapiens; identical to SEQ ID NO: 44569
  misc_feature 1..30: note = chr16:3925449-3925479
  misc_feature 1..30: note = Hypo
  source 1..30: mol_type = genomic DNA

SEQ ID NO: 111578 - DNA, 78 bp, Homo sapiens; identical to SEQ ID NO: 78942
  misc_feature 1..78: note = chr16:3931903-3931981
  misc_feature 1..78: note = Hypo
  source 1..78: mol_type = genomic DNA

SEQ ID NO: 111579 - DNA, 17 bp, Homo sapiens
  misc_feature 1..17: note = chr16:3951115-3951132
  misc_feature 1..17: note = Hypo
  source 1..17: mol_type = genomic DNA
gttaaaaaaatttaccg

SEQ ID NO: 111580 - DNA, 37 bp, Homo sapiens; identical to SEQ ID NO: 16016
  misc_feature 1..37: note = chr16:3957870-3957907
  misc_feature 1..37: note = Hypo
  source 1..37: mol_type = genomic DNA

SEQ ID NO: 111581 - DNA, 161 bp, Homo sapiens; identical to SEQ ID NO: 78945
  misc_feature 1..161: note = chr16:3998590-3998751
  misc_feature 1..161: note = Hypo
  source 1..161: mol_type = genomic DNA

SEQ ID NO: 111582 - DNA, 30 bp, Homo sapiens; identical to SEQ ID NO: 78949
  misc_feature 1..30: note = chr16:4135781-4135811
  misc_feature 1..30: note = Hypo
  source 1..30: mol_type = genomic DNA

SEQ ID NO: 111583 - DNA, 36 bp, Homo sapiens; identical to SEQ ID NO: 78950
  misc_feature 1..36: note = chr16:4165816-4165852
  misc_feature 1..36: note = Hyper
  source 1..36: mol_type = genomic DNA

SEQ ID NO: 111584 - DNA, 79 bp, Homo sapiens; identical to SEQ ID NO: 78951
  misc_feature 1..79: note = chr16:4203488-4203567
  misc_feature 1..79: note = Hypo
  source 1..79: mol_type = genomic DNA

SEQ ID NO: 111585 - DNA, 84 bp, Homo sapiens; identical to SEQ ID NO: 78952
  misc_feature 1..84: note = chr16:4203911-4203995
  misc_feature 1..84: note = Hypo
  source 1..84: mol_type = genomic DNA

SEQ ID NO: 111586 - DNA, 165 bp, Homo sapiens; identical to SEQ ID NO: 78953
  misc_feature 1..165: note = chr16:4264529-4264694
  misc_feature 1..165: note = Hypo
  source 1..165: mol_type = genomic DNA

SEQ ID NO: 111587 - DNA, 40 bp, Homo sapiens; identical to SEQ ID NO: 78955
  misc_feature 1..40: note = chr16:4308064-4308104
  misc_feature 1..40: note = Hypo
  source 1..40: mol_type = genomic DNA

SEQ ID NO: 111588 - DNA, 160 bp, Homo sapiens; identical to SEQ ID NO: 36054
  misc_feature 1..160: note = chr16:4363920-4364080
  misc_feature 1..160: note = Hyper
  source 1..160: mol_type = genomic DNA

SEQ ID NO: 111589 - DNA, 532 bp, Homo sapiens; identical to SEQ ID NO: 78957
  misc_feature 1..532: note = chr16:4377893-4378425
  misc_feature 1..532: note = Hyper
  source 1..532: mol_type = genomic DNA

SEQ ID NO: 111590 - DNA, 112 bp, Homo sapiens; identical to SEQ ID NO: 78958
  misc_feature 1..112: note = chr16:4385316-4385428
  misc_feature 1..112: note = Hypo
  source 1..112: mol_type = genomic DNA

SEQ ID NO: 111591 - DNA, 184 bp, Homo sapiens; identical to SEQ ID NO: 78959
  misc_feature 1..184: note = chr16:4395357-4395541
  misc_feature 1..184: note = Hypo
  source 1..184: mol_type = genomic DNA

SEQ ID NO: 111592 - DNA, 28 bp, Homo sapiens
  misc_feature 1..28: note = chr16:4402011-4402039
  misc_feature 1..28: note = Hypo
  source 1..28: mol_type = genomic DNA
tggattcacaggttccggacatttcata

SEQ ID NO: 111593 - DNA, 66 bp, Homo sapiens; identical to SEQ ID NO: 44575
  misc_feature 1..66: note = chr16:4410920-4410986
  misc_feature 1..66: note = Hypo
  source 1..66: mol_type = genomic DNA

SEQ ID NO: 111594 - DNA, 131 bp, Homo sapiens; identical to SEQ ID NO: 78963
  misc_feature 1..131: note = chr16:4422122-4422253
  misc_feature 1..131: note = Hyper
  source 1..131: mol_type = genomic DNA

SEQ ID NO: 111595 - DNA, 53 bp, Homo sapiens; identical to SEQ ID NO: 78964
  misc_feature 1..53: note = chr16:4431066-4431119
  misc_feature 1..53: note = Hypo
  source 1..53: mol_type = genomic DNA

SEQ ID NO: 111596 - DNA, 30 bp, Homo sapiens; identical to SEQ ID NO: 78965
  misc_feature 1..30: note = chr16:4442476-4442506
  misc_feature 1..30: note = Hypo
  source 1..30: mol_type = genomic DNA

SEQ ID NO: 111597 - DNA, 98 bp, Homo sapiens; identical to SEQ ID NO: 78966
  misc_feature 1..98: note = chr16:4443075-4443173
  misc_feature 1..98: note = Hypo
  source 1..98: mol_type = genomic DNA

SEQ ID NO: 111598 - DNA, 30 bp, Homo sapiens; identical to SEQ ID NO: 44576
  misc_feature 1..30: note = chr16:4474675-4474705
  misc_feature 1..30: note = Hypo
  source 1..30: mol_type = genomic DNA

SEQ ID NO: 111599 - DNA, 920 bp, Homo sapiens
  misc_feature 1..920: note = chr16:4587903-4588823
  misc_feature 1..920: note = Hyper
  source 1..920: mol_type = genomic DNA
ccggggatgcgcggccgagcgccacatcccgactccacacgtcggcgagccgggcgcgggtgcaggacactgctgggctccgggacggccaaggtcacccgcggggctcggcaggggctggctcggccacggggctcctcctcgaccccctttccttgagaaaacaactcccacccctcccctccccgtctcgccctgcaagacggagatggcaatttccacaaccttccctgacggaaaaacgtgcgggcgagcaggctgccattccgggcgcacaaccccgcggcacacagcggggcgcccgcccgggccccgccaccgcagcggcttcgacatccccagggccgcgctaggtctcggcagcgccctgaggggaggacgggccccgccatgccgcgccccaaccgccggccccgctttacctccagaagcccggtgcccgaggccggccgaaagcggagaggggcccgggtccggacaggcgccggcagaacaagaccctcagccccgcgcggctttgcgcgcacaacgaaaccccccaacccaccgcccaccccaccgcccagaggcttctaggacttgtagtccgcccggtcaccccccccaccacaacccgctctgagaggctggggactacggtgcccggcatgcaccgcccaggcgccgcgggcgggggcggggagggggcgccacggtccgaggtcacgccccgacctgaggagagctggcgcccagacccttcccccggggaggagggctcccgcgcgaagccgtctccgaatgcgtccagtcgactcaccgtccccgcagccctggggcagcggccgcaacagcaggaccgaacgcctcggcagctggcagtcgcacttctgtcacaaggaggcgggtagactttggaccagggccgaggcccgggacgt

SEQ ID NO: 111600 - DNA, 33 bp, Homo sapiens; identical to SEQ ID NO: 78970
  misc_feature 1..33: note = chr16:4644769-4644802
  misc_feature 1..33: note = Hypo
  source 1..33: mol_type = genomic DNA

SEQ ID NO: 111601 - DNA, 30 bp, Homo sapiens; identical to SEQ ID NO: 78971
  misc_feature 1..30: note = chr16:4645003-4645033
  misc_feature 1..30: note = Hypo
  source 1..30: mol_type = genomic DNA

SEQ ID NO: 111602 - DNA, 30 bp, Homo sapiens; identical to SEQ ID NO: 44577
  misc_feature 1..30: note = chr16:4655417-4655447
  misc_feature 1..30: note = Hypo
  source 1..30: mol_type = genomic DNA

SEQ ID NO: 111603 - DNA, 115 bp, Homo sapiens; identical to SEQ ID NO: 78973
  misc_feature 1..115: note = chr16:4665621-4665736
  misc_feature 1..115: note = Hypo
  source 1..115: mol_type = genomic DNA

SEQ ID NO: 111604 - DNA, 137 bp, Homo sapiens; identical to SEQ ID NO: 78982
  misc_feature 1..137: note = chr16:4723596-4723733
  misc_feature 1..137: note = Hypo
  source 1..137: mol_type = genomic DNA

SEQ ID NO: 111605 - DNA, 43 bp, Homo sapiens; identical to SEQ ID NO: 78983
  misc_feature 1..43: note = chr16:4840446-4840489
  misc_feature 1..43: note = Hypo
  source 1..43: mol_type = genomic DNA

SEQ ID NO: 111606 - DNA, 84 bp, Homo sapiens; identical to SEQ ID NO: 44579
  misc_feature 1..84: note = chr16:4841600-4841684
  misc_feature 1..84: note = Hypo
  source 1..84: mol_type = genomic DNA

SEQ ID NO: 111607 - DNA, 91 bp, Homo sapiens; identical to SEQ ID NO: 78985
  misc_feature 1..91: note = chr16:4844989-4845080
  misc_feature 1..91: note = Hypo
  source 1..91: mol_type = genomic DNA

SEQ ID NO: 111608 - DNA, 284 bp, Homo sapiens; identical to SEQ ID NO: 78986
  misc_feature 1..284: note = chr16:4846136-4846420
  misc_feature 1..284: note = Hypo
  source 1..284: mol_type = genomic DNA

SEQ ID NO: 111609 - DNA, 104 bp, Homo sapiens; identical to SEQ ID NO: 78987
  misc_feature 1..104: note = chr16:4846720-4846824
  misc_feature 1..104: note = Hypo
  source 1..104: mol_type = genomic DNA

SEQ ID NO: 111610 - DNA, 30 bp, Homo sapiens; identical to SEQ ID NO: 78991
  misc_feature 1..30: note = chr16:4900604-4900634
  misc_feature 1..30: note = Hypo
  source 1..30: mol_type = genomic DNA

SEQ ID NO: 111611 - DNA, 55 bp, Homo sapiens; identical to SEQ ID NO: 78992
  misc_feature 1..55: note = chr16:4920234-4920289
  misc_feature 1..55: note = Hypo
  source 1..55: mol_type = genomic DNA

SEQ ID NO: 111612 - DNA, 37 bp, Homo sapiens; identical to SEQ ID NO: 78993
  misc_feature 1..37: note = chr16:4920489-4920526
  misc_feature 1..37: note = Hypo
  source 1..37: mol_type = genomic DNA

SEQ ID NO: 111613 - DNA, 30 bp, Homo sapiens; identical to SEQ ID NO: 78999
  misc_feature 1..30: note = chr16:4931529-4931559
  misc_feature 1..30: note = Hypo
  source 1..30: mol_type = genomic DNA

SEQ ID NO: 111614 - DNA, 30 bp, Homo sapiens; identical to SEQ ID NO: 79003
  misc_feature 1..30: note = chr16:4932123-4932153
  misc_feature 1..30: note = Hypo
  source 1..30: mol_type = genomic DNA

SEQ ID NO: 111615 - DNA, 69 bp, Homo sapiens; identical to SEQ ID NO: 79021
  misc_feature 1..69: note = chr16:5007727-5007796
  misc_feature 1..69: note = Hyper
  source 1..69: mol_type = genomic DNA

SEQ ID NO: 111616 - DNA, 667 bp, Homo sapiens; identical to SEQ ID NO: 79028
  misc_feature 1..667: note = chr16:5037514-5038181
  misc_feature 1..667: note = Hyper
  source 1..667: mol_type = genomic DNA

SEQ ID NO: 111617 - DNA, 91 bp, Homo sapiens; identical to SEQ ID NO: 79036
  misc_feature 1..91: note = chr16:5090543-5090634
  misc_feature 1..91: note = Hypo
  source 1..91: mol_type = genomic DNA

SEQ ID NO: 111618 - DNA, 30 bp, Homo sapiens; identical to SEQ ID NO: 79037
  misc_feature 1..30: note = chr16:5094354-5094384
  misc_feature 1..30: note = Hypo
  source 1..30: mol_type = genomic DNA

SEQ ID NO: 111619 - DNA, 170 bp, Homo sapiens; identical to SEQ ID NO: 79039
  misc_feature 1..170: note = chr16:5105315-5105485
  misc_feature 1..170: note = Hypo
  source 1..170: mol_type = genomic DNA

SEQ ID NO: 111620 - DNA, 30 bp, Homo sapiens; identical to SEQ ID NO: 79042
  misc_feature 1..30: note = chr16:5115288-5115318
  misc_feature 1..30: note = Hypo
  source 1..30: mol_type = genomic DNA

SEQ ID NO: 111621 - DNA, 72 bp, Homo sapiens; identical to SEQ ID NO: 79043
  misc_feature 1..72: note = chr16:5115525-5115597
  misc_feature 1..72: note = Hypo
  source 1..72: mol_type = genomic DNA

SEQ ID NO: 111622 - DNA, 22 bp, Homo sapiens
  misc_feature 1..22: note = chr16:5130483-5130505
  misc_feature 1..22: note = Hypo
  source 1..22: mol_type = genomic DNA
ggtgtgggaagaggccgggtct

SEQ ID NO: 111623 - DNA, 22 bp, Homo sapiens
  misc_feature 1..22: note = chr16:5130565-5130587
  misc_feature 1..22: note = Hypo
  source 1..22: mol_type = genomic DNA
tggaacccgcgccatatgctct

SEQ ID NO: 111624 - DNA, 95 bp, Homo sapiens; identical to SEQ ID NO: 79057
  misc_feature 1..95: note = chr16:5164973-5165068
  misc_feature 1..95: note = Hypo
  source 1..95: mol_type = genomic DNA

SEQ ID NO: 111625 - DNA, 21 bp, Homo sapiens
  misc_feature 1..21: note = chr16:5215934-5215955
  misc_feature 1..21: note = Hypo
  source 1..21: mol_type = genomic DNA
agcaagtatgaaaagcgttct

SEQ ID NO: 111626 - DNA, 42 bp, Homo sapiens; identical to SEQ ID NO: 79059
  misc_feature 1..42: note = chr16:5257258-5257300
  misc_feature 1..42: note = Hypo
  source 1..42: mol_type = genomic DNA

SEQ ID NO: 111627 - DNA, 25 bp, Homo sapiens
  misc_feature 1..25: note = chr16:5412643-5412668
  misc_feature 1..25: note = Hypo
  source 1..25: mol_type = genomic DNA
tgagccaccgcgccaggccacatca

SEQ ID NO: 111628 - DNA, 150 bp, Homo sapiens; identical to SEQ ID NO: 79075
  misc_feature 1..150: note = chr16:5439193-5439343
  misc_feature 1..150: note = Hypo
  source 1..150: mol_type = genomic DNA

SEQ ID NO: 111629 - DNA, 82 bp, Homo sapiens; identical to SEQ ID NO: 79086
  misc_feature 1..82: note = chr16:5512088-5512170
  misc_feature 1..82: note = Hypo
  source 1..82: mol_type = genomic DNA

SEQ ID NO: 111630 - DNA, 237 bp, Homo sapiens; identical to SEQ ID NO: 79098
  misc_feature 1..237: note = chr16:5541116-5541353
  misc_feature 1..237: note = Hypo
  source 1..237: mol_type = genomic DNA

SEQ ID NO: 111631 - DNA, 170 bp, Homo sapiens; identical to SEQ ID NO: 79103
  misc_feature 1..170: note = chr16:5559726-5559896
  misc_feature 1..170: note = Hypo
  source 1..170: mol_type = genomic DNA

SEQ ID NO: 111632 - DNA, 30 bp, Homo sapiens; identical to SEQ ID NO: 79134
  misc_feature 1..30: note = chr16:5703116-5703146
  misc_feature 1..30: note = Hypo
  source 1..30: mol_type = genomic DNA

SEQ ID NO: 111633 - DNA, 37 bp, Homo sapiens; identical to SEQ ID NO: 79141
  misc_feature 1..37: note = chr16:5769148-5769185
  misc_feature 1..37: note = Hypo
  source 1..37: mol_type = genomic DNA

SEQ ID NO: 111634 - DNA, 30 bp, Homo sapiens; identical to SEQ ID NO: 79167
  misc_feature 1..30: note = chr16:5950685-5950715
  misc_feature 1..30: note = Hypo
  source 1..30: mol_type = genomic DNA

SEQ ID NO: 111635 - DNA, 78 bp, Homo sapiens
  misc_feature 1..78: note = chr16:6068899-6068977
  misc_feature 1..78: note = Hyper
  source 1..78: mol_type = genomic DNA
aggagaccagggtaccgggtcgcgtgtccgccgccgccgcccgctggaatccagggctgcacgcgtgaccgcggcggc

SEQ ID NO: 111636 - DNA, 102 bp, Homo sapiens
  misc_feature 1..102: note = chr16:6069492-6069594
  misc_feature 1..102: note = Hyper
  source 1..102: mol_type = genomic DNA
ccccccagcagcacccgcggtggggcgggggcgctctgccagccccgggaacagcagaggcggcggcactggctggacccacgcgcgcgcctccggggctga

SEQ ID NO: 111637 - DNA, 202 bp, Homo sapiens; identical to SEQ ID NO: 79173
  misc_feature 1..202: note = chr16:6070067-6070269
  misc_feature 1..202: note = Hyper
  source 1..202: mol_type = genomic DNA

SEQ ID NO: 111638 - DNA, 30 bp, Homo sapiens
  misc_feature 1..30: note = chr16:6070517-6070547
  misc_feature 1..30: note = Hyper
  source 1..30: mol_type = genomic DNA
tactggcactggaatcgatgccccgcggtg

SEQ ID NO: 111639 - DNA, 30 bp, Homo sapiens; identical to SEQ ID NO: 44589
  misc_feature 1..30: note = chr16:6186354-6186384
  misc_feature 1..30: note = Hypo
  source 1..30: mol_type = genomic DNA

SEQ ID NO: 111640 - DNA, 30 bp, Homo sapiens; identical to SEQ ID NO: 44590
  misc_feature 1..30: note = chr16:6314961-6314991
  misc_feature 1..30: note = Hypo
  source 1..30: mol_type = genomic DNA

SEQ ID NO: 111641 - DNA, 313 bp, Homo sapiens
  misc_feature 1..313: note = chr16:6533401-6533714
  misc_feature 1..313: note = Hyper
  source 1..313: mol_type = genomic DNA
tttacattgctagcacgtgggtgccgtttgctgttgcctcggacttctcccgtgctgtgttttcccggtgaggaaacaggaggcactttgcagccgacaatgaaatcttggcagctaattgcagtcgtgggagatgcccttcaggtacggcgagcgaagaagactctaaaacactgtcagggaaggagagaaagagggagagagggagggagggaagggagagaccaggcagcttctgcagaggcttcctgaagcccactgactccgcgggagggggttgcagagggacgggggcgggcgacagggggaggag

SEQ ID NO: 111642 - DNA, 32 bp, Homo sapiens; identical to SEQ ID NO: 79251
  misc_feature 1..32: note = chr16:6825036-6825068
  misc_feature 1..32: note = Hypo
  source 1..32: mol_type = genomic DNA

SEQ ID NO: 111643 - DNA, 148 bp, Homo sapiens; identical to SEQ ID NO: 79257
  misc_feature 1..148: note = chr16:6838778-6838926
  misc_feature 1..148: note = Hypo
  source 1..148: mol_type = genomic DNA

SEQ ID NO: 111644 - DNA, 33 bp, Homo sapiens; identical to SEQ ID NO: 79284
  misc_feature 1..33: note = chr16:6990605-6990638
  misc_feature 1..33: note = Hypo
  source 1..33: mol_type = genomic DNA

SEQ ID NO: 111645 - DNA, 30 bp, Homo sapiens; identical to SEQ ID NO: 79302
  misc_feature 1..30: note = chr16:7137064-7137094
  misc_feature 1..30: note = Hyper
  source 1..30: mol_type = genomic DNA

SEQ ID NO: 111646 - DNA, 33 bp, Homo sapiens; identical to SEQ ID NO: 36062
  misc_feature 1..33: note = chr16:7354091-7354124
  misc_feature 1..33: note = Hyper
  source 1..33: mol_type = genomic DNA

SEQ ID NO: 111647 - DNA, 287 bp, Homo sapiens
  misc_feature 1..287: note = chr16:7354388-7354675
  misc_feature 1..287: note = Hyper
  source 1..287: mol_type = genomic DNA
tgcagcatcctctgacgggggccacctgcgtggcgctccccaacgtgggcatgtgtccccagctttcgtgtgccttgacttttatgtacttacagcaggtaaggcgcgcgtctgccctcggtggctgctttcctggggctgggccagatgggtccccgcgcgtactgggctgcgcttcggtgccttatgtaggttctgaggagggggctcccgcgttgcgatggaaagggtggatggaagcctcctgctctctgtggagcccgggcacctcgcgctgagatgtttct

SEQ ID NO: 111648 - DNA, 179 bp, Homo sapiens; identical to SEQ ID NO: 79343
  misc_feature 1..179: note = chr16:7489013-7489192
  misc_feature 1..179: note = Hypo
  source 1..179: mol_type = genomic DNA

SEQ ID NO: 111649 - DNA, 69 bp, Homo sapiens; identical to SEQ ID NO: 79365
  misc_feature 1..69: note = chr16:7568309-7568378
  misc_feature 1..69: note = Hypo
  source 1..69: mol_type = genomic DNA

SEQ ID NO: 111650 - DNA, 30 bp, Homo sapiens; identical to SEQ ID NO: 79385
  misc_feature 1..30: note = chr16:7827953-7827983
  misc_feature 1..30: note = Hypo
  source 1..30: mol_type = genomic DNA

SEQ ID NO: 111651 - DNA, 16 bp, Homo sapiens
  misc_feature 1..16: note = chr16:8097095-8097111
  misc_feature 1..16: note = Hypo
  source 1..16: mol_type = genomic DNA
agcattagggccaggc

SEQ ID NO: 111652 - DNA, 30 bp, Homo sapiens; identical to SEQ ID NO: 79422
  misc_feature 1..30: note = chr16:8158291-8158321
  misc_feature 1..30: note = Hypo
  source 1..30: mol_type = genomic DNA

SEQ ID NO: 111653 - DNA, 189 bp, Homo sapiens; identical to SEQ ID NO: 79435
  misc_feature 1..189: note = chr16:8222706-8222895
  misc_feature 1..189: note = Hypo
  source 1..189: mol_type = genomic DNA

SEQ ID NO: 111654 - DNA, 30 bp, Homo sapiens; identical to SEQ ID NO: 79439
  misc_feature 1..30: note = chr16:8234670-8234700
  misc_feature 1..30: note = Hypo
  source 1..30: mol_type = genomic DNA

SEQ ID NO: 111655 - DNA, 221 bp, Homo sapiens; identical to SEQ ID NO: 79449
  misc_feature 1..221: note = chr16:8322627-8322848
  misc_feature 1..221: note = Hypo
  source 1..221: mol_type = genomic DNA

SEQ ID NO: 111656 - DNA, 30 bp, Homo sapiens; identical to SEQ ID NO: 79493
  misc_feature 1..30: note = chr16:8519135-8519165
  misc_feature 1..30: note = Hypo
  source 1..30: mol_type = genomic DNA

SEQ ID NO: 111657 - DNA, 51 bp, Homo sapiens; identical to SEQ ID NO: 79556
  misc_feature 1..51: note = chr16:8606896-8606947
  misc_feature 1..51: note = Hypo
  source 1..51: mol_type = genomic DNA

SEQ ID NO: 111658 - DNA, 147 bp, Homo sapiens; identical to SEQ ID NO: 44593
  misc_feature 1..147: note = chr16:8781004-8781151
  misc_feature 1..147: note = Hypo
  source 1..147: mol_type = genomic DNA

SEQ ID NO: 111659 - DNA, 53 bp, Homo sapiens; identical to SEQ ID NO: 79729
  misc_feature 1..53: note = chr16:8870353-8870406
  misc_feature 1..53: note = Hypo
  source 1..53: mol_type = genomic DNA

SEQ ID NO: 111660 - DNA, 29 bp, Homo sapiens
  misc_feature 1..29: note = chr16:8963909-8963938
  misc_feature 1..29: note = Hypo
  source 1..29: mol_type = genomic DNA
gggtgcggtggctcacgcctgtaattcca

SEQ ID NO: 111661 - DNA, 30 bp, Homo sapiens; identical to SEQ ID NO: 79901
  misc_feature 1..30: note = chr16:8971974-8972004
  misc_feature 1..30: note = Hypo
  source 1..30: mol_type = genomic DNA

SEQ ID NO: 111662 - DNA, 334 bp, Homo sapiens; identical to SEQ ID NO: 79905
  misc_feature 1..334: note = chr16:8978000-8978334
  misc_feature 1..334: note = Hypo
  source 1..334: mol_type = genomic DNA

SEQ ID NO: 111663 - DNA, 30 bp, Homo sapiens; identical to SEQ ID NO: 79908
  misc_feature 1..30: note = chr16:8987879-8987909
  misc_feature 1..30: note = Hypo
  source 1..30: mol_type = genomic DNA

SEQ ID NO: 111664 - DNA, 463 bp, Homo sapiens; identical to SEQ ID NO: 79923
  misc_feature 1..463: note = chr16:9005341-9005804
  misc_feature 1..463: note = Hypo
  source 1..463: mol_type = genomic DNA

SEQ ID NO: 111665 - DNA, 199 bp, Homo sapiens; identical to SEQ ID NO: 79926
  misc_feature 1..199: note = chr16:9009860-9010059
  misc_feature 1..199: note = Hypo
  source 1..199: mol_type = genomic DNA

SEQ ID NO: 111666 - DNA, 41 bp, Homo sapiens; identical to SEQ ID NO: 79929
  misc_feature 1..41: note = chr16:9053767-9053808
  misc_feature 1..41: note = Hyper
  source 1..41: mol_type = genomic DNA

SEQ ID NO: 111667 - DNA, 120 bp, Homo sapiens; identical to SEQ ID NO: 79930
  misc_feature 1..120: note = chr16:9062079-9062199
  misc_feature 1..120: note = Hypo
  source 1..120: mol_type = genomic DNA

SEQ ID NO: 111668 - DNA, 30 bp, Homo sapiens; identical to SEQ ID NO: 79931
  misc_feature 1..30: note = chr16:9063642-9063672
  misc_feature 1..30: note = Hypo
  source 1..30: mol_type = genomic DNA

SEQ ID NO: 111669 - DNA, 30 bp, Homo sapiens; identical to SEQ ID NO: 79932
  misc_feature 1..30: note = chr16:9106938-9106968
  misc_feature 1..30: note = Hyper
  source 1..30: mol_type = genomic DNA

SEQ ID NO: 111670 - DNA, 51 bp, Homo sapiens; identical to SEQ ID NO: 79933
  misc_feature 1..51: note = chr16:9229760-9229811
  misc_feature 1..51: note = Hyper
  source 1..51: mol_type = genomic DNA

SEQ ID NO: 111671 - DNA, 30 bp, Homo sapiens; identical to SEQ ID NO: 79938
  misc_feature 1..30: note = chr16:9381764-9381794
  misc_feature 1..30: note = Hypo
  source 1..30: mol_type = genomic DNA

SEQ ID NO: 111672 - DNA, 184 bp, Homo sapiens; identical to SEQ ID NO: 79955
  misc_feature 1..184: note = chr16:9842646-9842830
  misc_feature 1..184: note = Hypo
  source 1..184: mol_type = genomic DNA

SEQ ID NO: 111673 - DNA, 30 bp, Homo sapiens; identical to SEQ ID NO: 79956
  misc_feature 1..30: note = chr16:9862871-9862901
  misc_feature 1..30: note = Hypo
  source 1..30: mol_type = genomic DNA

SEQ ID NO: 111674 - DNA, 208 bp, Homo sapiens; identical to SEQ ID NO: 44598
  misc_feature 1..208: note = chr16:9888740-9888948
  misc_feature 1..208: note = Hypo
  source 1..208: mol_type = genomic DNA

SEQ ID NO: 111675 - DNA, 30 bp, Homo sapiens; identical to SEQ ID NO: 79958
  misc_feature 1..30: note = chr16:9943625-9943655
  misc_feature 1..30: note = Hypo
  source 1..30: mol_type = genomic DNA

SEQ ID NO: 111676 - DNA, 248 bp, Homo sapiens
  misc_feature 1..248: note = chr16:10133318-10133566
  misc_feature 1..248: note = Hyper
  source 1..248: mol_type = genomic DNA
tgtttgtttgaaaatcgagacgctaaactctaagtcttttgctgaagctcctctccctaggggcaggatgggagcaaggcttaccaaggctgccacctacagaacagagggcagcgaggactgcgcagcagcgggagggaccggtggcgttgggcgcggggagggtctgcgcggggagggtccgcacccgggagcgggggcggctgctcgctctactcctgggaggggcctttcgaaggaccaggtgc

SEQ ID NO: 111677 - DNA, 3146 bp, Homo sapiens
  misc_feature 1..3146: note = chr16:10274265-10277411
  misc_feature 1..3146: note = Hyper
  source 1..3146: mol_type = genomic DNA
catagtcgccactgacggtccctgcaaggtgaagagtgagaggcagggccgcggtgagcaaggcgaccagaagaaagggattaccaacttggcttcctgctctaggagccaggcatggaactcagcagcaggataggctgctgggatcacggactccattccgagtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttcacccctacacgcgcgcgtgcacacacacgtgcacacacacacgcacacacacatgttcacacacacacaccctctctcacgcgcgccgtgtgcaatgctgaattctggagagtaggcgcgtccccccgcgggccagcgcgtaggagctggcaaagaacgtgcgtagggggaaaggtaggctcccaagaagctcccagacggacgtggactgtacagcccctccctagcctttctactgcgggcgctgttgccaagtcctaggtgcacgtgggcagtgggccgcacacgctcataggcacgcgcgcttttctgcgcacttcctcagactgctgtagcggtgcccacggccagccggagtcctcacatgtcctcaggtggtgcacacgcatgaactgcggcaggtgcacagccctgcgtacctgcaaataccagcacggtcgtgcacgcgtgccctgacgcgcgcctctcgggacggacgctgctggagccgggggaagttgaggcgaactccaagaggcctcgacgttcctgggtaagcgccgcggagcgcggagccgcagcgccccctggtgcccctcctgcacttcgccgctgggctccctcccgctttccctctccctctctagcctgatccctctcccgctctccctccggtcgagtctccctcctccccggcccaaggagccctgatctccctctgggacgtacctgtagcccgagaaggtcgaggatgcagtggggcgcgctgcgcgcacgagcatctcggccgcctcagcagccaccgggtttagcgggttcccgcatgctgcggccccagcgcgctcccctggctgtcccgcgctgtccgcatcgcccccacggggggcggctatcccagccggaggctctgcagcagggctctaacggggcggaggagagaaggagaggcagggtcagcccaccaacgaggggagggagggttgaggggaaggctgcagtctgcagtgctcacaagcccccctatgcgcccaggggggctagacaagaggggggaagctgaagcccgatgcccacgacgcccccagtgcggatcctcagcccctgtggctgatagcgggagctccactccagggtgcacaggagaatgggagccccaggttggccacccacgagaagctaactgggcacctccacccgcaccccctaccacctccccagcgccggctgctgggagttgtgcgaccgggagctgctgagcgagggaggtagggagagaaagaggaggtaacgagggtgggggggcgctggctgagtttgtgacgagccagcagtaggagagggggagggaaggacgcgggctcccgcggtcccggttccccgagggaggtggatctttcccacgcagcgaccctcttgtgatcctgccgcttcctccctcttcaggcctcccacctccccccttcccaagggggcctcccaggcccggcgtcccgcgctagcactcaccgcagcctctctccacatagttctcagcagtggccgctcctggtcatctccagggctgatggctgcggccgcgattctcagcgctcacccggtcccatgatccggccaagccctaggagctcccctccaagatccctagctccgcttcctgccccactccggacggcaactgcccggtcctctgagcgcgccggagcaccctctccgcaacccagctccgggctggtgtgtttgagggcgagtgtgtgtgtgagtgtgggagcgcgctcgcgtgtggccggggatccccgcggtccccggccgagagaggcgcgggcggggaaaggcagctccctccgggcccttcgctgctgggccagctccgcgccgggcgttcggctccccacttcccagcgggagtccggtgagcgcctggacaccctggttcacagcactggcaaagccgggttcccggggcgtctttctgctgcggtcgcctccgaggaagaggagaaggaaggtagcggcgccctccacaccaacttagggacttgttctcagccggcgagacgcagtagcccccgctcaagcccaagaggcttcgagctccggcgggcgaaagcgtctcctgcccgcagcctctctcctaggtgggtcgagacagaccccgcagtccctcggcggcgacgcggagcgcggccacccgttccgagagcgcacggcggcaaataaggccaggataggtggctggctggcgacgggggcgcctgcggcggcgcgcgctgctgtccgtggtgttggaaccacgctctccgcccgctcccgggcgtctggtgcggctgaagaatcaattattcagatctctgctaccgcttcctcctcccccagtgcctcgcgctgggtacagttatccccctccacg

SEQ ID NO: 111678 - DNA, 635 bp, Homo sapiens
  misc_feature 1..635: note = chr16:10479701-10480336
  misc_feature 1..635: note = Hyper
  source 1..635: mol_type = genomic DNA
gccccggtggctgaccggaagaagcgcccacggaggcgaaccccaggcgcccctcagcctacttccatttcccctcgcgacccttcgccccgcccactctagctggctgtgcctgactggctgggctgccgcatattcgcgctgccattggtccataatcagctgggggtgggcgtagggagacctacttcagcaggtcctggccggaccagcattgttaacggctgcggttcgaagtggctgtgggtattgctgcggctggtgcgtcgtcgctctaggtacgttggggccgggcgagtgtcctgcgagagcggcgattggcggggtggcggctctaggagcgtcggtcgcctctctgagggccggccccggaggcctcggagcgccgggcctaccggacgtttgcggcgaagctgccctgactgaaaagcgtccgcggggccgtctgacaggtccgggaagaggcccctgaggggcggacgggcgcgtctccaccgttttcgcagagggatactggtgaagcgggagtggtgtgcggcctcaggtccgggcggcactggggttagggactgcggagggaagtggtgcgtgttttttgtcctgaggggtaagtaaaagctcgctcttgtccggaa

SEQ ID NO: 111679 - DNA, 153 bp, Homo sapiens; identical to SEQ ID NO: 78308
  misc_feature 1..153: note = chr16:10721492-10721645
  misc_feature 1..153: note = Hypo
  source 1..153: mol_type = genomic DNA

SEQ ID NO: 111680 - DNA, 85 bp, Homo sapiens; identical to SEQ ID NO: 78315
  misc_feature 1..85: note = chr16:10804580-10804665
  misc_feature 1..85: note = Hypo
  source 1..85: mol_type = genomic DNA

SEQ ID NO: 111681 - DNA, 23 bp, Homo sapiens
  misc_feature 1..23: note = chr16:11102871-11102894
  misc_feature 1..23: note = Hypo
  source 1..23: mol_type = genomic DNA
tacattcacgttgtataaccatc

SEQ ID NO: 111682 - DNA, 30 bp, Homo sapiens; identical to SEQ ID NO: 78327
  misc_feature 1..30: note = chr16:11118524-11118554
  misc_feature 1..30: note = Hypo
  source 1..30: mol_type = genomic DNA

SEQ ID NO: 111683 - DNA, 30 bp, Homo sapiens; identical to SEQ ID NO: 78330
  misc_feature 1..30: note = chr16:11140587-11140617
  misc_feature 1..30: note = Hypo
  source 1..30: mol_type = genomic DNA

SEQ ID NO: 111684 - DNA, 30 bp, Homo sapiens; identical to SEQ ID NO: 78331
  misc_feature 1..30: note = chr16:11167520-11167550
  misc_feature 1..30: note = Hypo
  source 1..30: mol_type = genomic DNA

SEQ ID NO: 111685 - DNA, 30 bp, Homo sapiens; identical to SEQ ID NO: 78333
  misc_feature 1..30: note = chr16:11178655-11178685
  misc_feature 1..30: note = Hypo
  source 1..30: mol_type = genomic DNA

SEQ ID NO: 111686 - DNA, 45 bp, Homo sapiens; identical to SEQ ID NO: 78335
  misc_feature 1..45: note = chr16:11232618-11232663
  misc_feature 1..45: note = Hypo
  source 1..45: mol_type = genomic DNA

SEQ ID NO: 111687 - DNA, 30 bp, Homo sapiens; identical to SEQ ID NO: 78336
  misc_feature 1..30: note = chr16:11245768-11245798
  misc_feature 1..30: note = Hypo
  source 1..30: mol_type = genomic DNA

SEQ ID NO: 111688 - DNA, 161 bp, Homo sapiens; identical to SEQ ID NO: 78338
  misc_feature 1..161: note = chr16:11283033-11283194
  misc_feature 1..161: note = Hypo
  source 1..161: mol_type = genomic DNA

SEQ ID NO: 111689 - DNA, 30 bp, Homo sapiens; identical to SEQ ID NO: 78340
  misc_feature 1..30: note = chr16:11354746-11354776
  misc_feature 1..30: note = Hypo
  source 1..30: mol_type = genomic DNA

SEQ ID NO: 111690 - DNA, 38 bp, Homo sapiens; identical to SEQ ID NO: 78341
  misc_feature 1..38: note = chr16:11407112-11407150
  misc_feature 1..38: note = Hypo
  source 1..38: mol_type = genomic DNA

SEQ ID NO: 111691 - DNA, 30 bp, Homo sapiens; identical to SEQ ID NO: 78345
  misc_feature 1..30: note = chr16:11484000-11484030
  misc_feature 1..30: note = Hypo
  source 1..30: mol_type = genomic DNA

SEQ ID NO: 111692 - DNA, 38 bp, Homo sapiens; identical to SEQ ID NO: 78347
  misc_feature 1..38: note = chr16:11568836-11568874
  misc_feature 1..38: note = Hypo
  source 1..38: mol_type = genomic DNA

SEQ ID NO: 111693 - DNA, 30 bp, Homo sapiens; identical to SEQ ID NO: 78351
  misc_feature 1..30: note = chr16:11703494-11703524
  misc_feature 1..30: note = Hypo
  source 1..30: mol_type = genomic DNA

SEQ ID NO: 111694 - DNA, 102 bp, Homo sapiens; identical to SEQ ID NO: 78353
  misc_feature 1..102: note = chr16:11712029-11712131
  misc_feature 1..102: note = Hypo
  source 1..102: mol_type = genomic DNA

SEQ ID NO: 111695 - DNA, 30 bp, Homo sapiens; identical to SEQ ID NO: 78355
  misc_feature 1..30: note = chr16:11770160-11770190
  misc_feature 1..30: note = Hypo
  source 1..30: mol_type = genomic DNA

SEQ ID NO: 111696 - DNA, 23 bp, Homo sapiens
  misc_feature 1..23: note = chr16:11843326-11843349
  misc_feature 1..23: note = Hypo
  source 1..23: mol_type = genomic DNA
ggcgcggtggctcaacgtagtcc

SEQ ID NO: 111697 - DNA, 30 bp, Homo sapiens; identical to SEQ ID NO: 78357
  misc_feature 1..30: note = chr16:11853255-11853285
  misc_feature 1..30: note = Hypo
  source 1..30: mol_type = genomic DNA

SEQ ID NO: 111698 - DNA, 42 bp, Homo sapiens; identical to SEQ ID NO: 44603
  misc_feature 1..42: note = chr16:11853669-11853711
  misc_feature 1..42: note = Hypo
  source 1..42: mol_type = genomic DNA

SEQ ID NO: 111699 - DNA, 30 bp, Homo sapiens; identical to SEQ ID NO: 78361
  misc_feature 1..30: note = chr16:11879750-11879780
  misc_feature 1..30: note = Hypo
  source 1..30: mol_type = genomic DNA

SEQ ID NO: 111700 - DNA, 42 bp, Homo sapiens; identical to SEQ ID NO: 78367
  misc_feature 1..42: note = chr16:12012089-12012131
  misc_feature 1..42: note = Hypo
  source 1..42: mol_type = genomic DNA

SEQ ID NO: 111701 - DNA, 16 bp, Homo sapiens
  misc_feature 1..16: note = chr16:12130487-12130503
  misc_feature 1..16: note = Hypo
  source 1..16: mol_type = genomic DNA
gcgggttttctgtttt

SEQ ID NO: 111702 - DNA, 51 bp, Homo sapiens; identical to SEQ ID NO: 78377
  misc_feature 1..51: note = chr16:12132399-12132450
  misc_feature 1..51: note = Hypo
  source 1..51: mol_type = genomic DNA

SEQ ID NO: 111703 - DNA, 30 bp, Homo sapiens; identical to SEQ ID NO: 78383
  misc_feature 1..30: note = chr16:12177673-12177703
  misc_feature 1..30: note = Hypo
  source 1..30: mol_type = genomic DNA

SEQ ID NO: 111704 - DNA, 361 bp, Homo sapiens
  misc_feature 1..361: note = chr16:12530041-12530402
  misc_feature 1..361: note = Hypo
  source 1..361: mol_type = genomic DNA
ctctgctgcagcccccggaacagtattggcacaggtgagggccacgcctcctccctgggcccaggcatcaggcgctggctctccacaggaggccgcagcttaaggagctcacagacgtttctattcggagagaggggaaggaacgaagacaggaacacagcaccgtttttagtaccaggagacagcgacagcttggcgtcagtgcgatgcgtgacatttccgtgtgtaaggtgtgctgctgcctggtggagtggcgcgcgagcacctggctgctttcctccctgccagatgccatttcaggaaatcgcctttgttgctcaggcattcatacccctgactgctcaggcgcagcctggcttgg

SEQ ID NO: 111705 - DNA, 114 bp, Homo sapiens; identical to SEQ ID NO: 78417
  misc_feature 1..114: note = chr16:12758831-12758945
  misc_feature 1..114: note = Hypo
  source 1..114: mol_type = genomic DNA

SEQ ID NO: 111706 - DNA, 30 bp, Homo sapiens; identical to SEQ ID NO: 78418
  misc_feature 1..30: note = chr16:12798468-12798498
  misc_feature 1..30: note = Hypo
  source 1..30: mol_type = genomic DNA

SEQ ID NO: 111707 - DNA, 108 bp, Homo sapiens; identical to SEQ ID NO: 78420
  misc_feature 1..108: note = chr16:12897794-12897902
  misc_feature 1..108: note = Hyper
  source 1..108: mol_type = genomic DNA

SEQ ID NO: 111708 - DNA, 30 bp, Homo sapiens; identical to SEQ ID NO: 78421
  misc_feature 1..30: note = chr16:12956299-12956329
  misc_feature 1..30: note = Hypo
  source 1..30: mol_type = genomic DNA

SEQ ID NO: 111709 - DNA, 71 bp, Homo sapiens; identical to SEQ ID NO: 78422
  misc_feature 1..71: note = chr16:12971895-12971966
  misc_feature 1..71: note = Hypo
  source 1..71: mol_type = genomic DNA

SEQ ID NO: 111710 - DNA, 3284 bp, Homo sapiens
  misc_feature 1..3284: note = chr16:12994419-12997703
  misc_feature 1..3284: note = Hyper
  source 1..3284: mol_type = genomic DNA
cggggagctggaattcgctaggagagagagggcagatttggaaacacagaggagacgggaggctggaagctgaggaagcaaggcagagctctgcagcccccggtgaggatttccggggggatccgtggggacaggggccagccagctccagagaccgatgcgcgggctccaggtccgggagggtggctgaggctgggtgcccaggccttgcgctgcgccagatccgggagcgcagaggcggcgccgcggtgttccctcctgtggagcgcagaaaacgctgcgggggcgaagagggacagaaagcggcaggttcgagaggctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtctgtccccatcctctccgagtcatccttcccctgatgcacagatttcggccgccgctcctgcacacgcaccggtgaaaaagctacgagctgagccgcctctgcgctctggacagggctgagccgcgcctcctacccagagagggcgcgggaggtcctgccgcggttttccacctgcctggaaatccgagcggctcctctagcctcggctgctgccgagctcgctcctccccgtccgctcgcctggctcagctctgcacgccccccagctagctcccgctctagtcacctcttccccgcgcccccgcccctctagagctcgcgcccgcccccccccacccgcgcctcctctgcccgccctcctccccctcccccttccctcctgccctcccttcattccacaagtgtcgcttcgctctcttcagcgcacttggcgagctggtgaggtgagagggatactgcgagagggctaggggcggccagtccggggctgccggccaaggctaggcgctgccagcccgattctcctctgctctccacccccgcctcacccagtggccggccggacctgcaccccgcgcttgaccccgctcatcctccccccgcccggccgggcgcgctcctccccggccggcccctcggcgcgcggcgcgctggaggcgaacgcgggctgaggcgaacgcgggctgagccgagcgcagtggccgccgaccaccgagcgccccgcgccgctccctgcatgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggtgggctgcctccccttcgccctcccctcggggcttcgctctccctgctctctcctccccaccttcccccaggcaatggcgctccccacggtccccgctccccgcatcccagcctctccgctgggggatgtcaccgggaagccaacttcggcttggaacacggagaaggggcgctgggctcagcacaggtgtgggtctgagcgtgttcgtgtgtgtgtgagcgtgtgtgtgtgtgtgtgtgactctgctccctcaccctctggccgcctcctcccgctggtgactgaggcggacttgagacacgtagcctgggagcccgtggccccgaaatcttcgggtttggggagagggtccatggcacccctcggattccaggtgctagctttttggtaaacaggggcaggcgagcccgaaaggggaggggggcgtgtgtgagcccgagcgcgcgtgtgtgaaggagggagggtcagagtgagtgccgcctgcaactcgtacgactcgcgaaaaggagacgagggaggtggagtgaggggagggcgagaacaaaagccttgcttggagcggccgcctcgctttcccagagcttcgccgtccctggatttgggacctcagctgcccccgcccctttacccacctcatccctttctctggccaccacttctccctgcccggggccgtggccatcgctgcagattgagccccttgccctggctggcgtggactccgggggcccgagccccctcctcgcgcgccctcacttccaagcaccctgatttcgtcaactttcgggtttgccttgttcattatgcaagccccagcaccagctagttccagcagatgggagaaggctttgggggattaatggagctatttgccttttgctttttttaaattttttttattttaagtgtctaaatcgattcgcaaactccgtaactttggaggcggaggacgcagccactaggagcactaagcccccggccgcgggagaggctgggggttggcgtgaggtccgggcgggcggggtggaaggagtgactagcggcctgcgaacagctggatggttggggcataagctttaactgtcccctttcagagtctgggcaacgaagtcgctgtatttttctctaccctctccccaccccttcttccgcgccccctctgccgggggcctgtgtgtgtgcgcgcgtgtgtgcacgcgctccgtgtgatgcctaaa

SEQ ID NO: 111711 - DNA, 27 bp, Homo sapiens
  misc_feature 1..27: note = chr16:13064659-13064686
  misc_feature 1..27: note = Hypo
  source 1..27: mol_type = genomic DNA
tgtgagccaccgcgcctggccggggca

SEQ ID NO: 111712 - DNA, 30 bp, Homo sapiens; identical to SEQ ID NO: 78434
  misc_feature 1..30: note = chr16:13266811-13266841
  misc_feature 1..30: note = Hypo
  source 1..30: mol_type = genomic DNA

SEQ ID NO: 111713 - DNA, 156 bp, Homo sapiens; identical to SEQ ID NO: 78438
  misc_feature 1..156: note = chr16:13676585-13676741
  misc_feature 1..156: note = Hypo
  source 1..156: mol_type = genomic DNA

SEQ ID NO: 111714 - DNA, 93 bp, Homo sapiens; identical to SEQ ID NO: 78439
  misc_feature 1..93: note = chr16:13687295-13687388
  misc_feature 1..93: note = Hypo
  source 1..93: mol_type = genomic DNA

SEQ ID NO: 111715 - DNA, 30 bp, Homo sapiens; identical to SEQ ID NO: 78450
  misc_feature 1..30: note = chr16:13977355-13977385
  misc_feature 1..30: note = Hypo
  source 1..30: mol_type = genomic DNA

SEQ ID NO: 111716 - DNA, 30 bp, Homo sapiens; identical to SEQ ID NO: 78462
  misc_feature 1..30: note = chr16:14359651-14359681
  misc_feature 1..30: note = Hypo
  source 1..30: mol_type = genomic DNA

SEQ ID NO: 111717 - DNA, 32 bp, Homo sapiens; identical to SEQ ID NO: 44607
  misc_feature 1..32: note = chr16:14464204-14464236
  misc_feature 1..32: note = Hypo
  source 1..32: mol_type = genomic DNA

SEQ ID NO: 111718 - DNA, 44 bp, Homo sapiens; identical to SEQ ID NO: 78464
  misc_feature 1..44: note = chr16:14615356-14615400
  misc_feature 1..44: note = Hypo
  source 1..44: mol_type = genomic DNA

SEQ ID NO: 111719 - DNA, 88 bp, Homo sapiens; identical to SEQ ID NO: 78467
  misc_feature 1..88: note = chr16:14724470-14724558
  misc_feature 1..88: note = Hypo
  source 1..88: mol_type = genomic DNA

SEQ ID NO: 111720 - DNA, 102 bp, Homo sapiens; identical to SEQ ID NO: 78468
  misc_feature 1..102: note = chr16:14725771-14725873
  misc_feature 1..102: note = Hypo
  source 1..102: mol_type = genomic DNA

SEQ ID NO: 111721 - DNA, 102 bp, Homo sapiens; identical to SEQ ID NO: 78469
  misc_feature 1..102: note = chr16:14726113-14726215
  misc_feature 1..102: note = Hypo
  source 1..102: mol_type = genomic DNA

SEQ ID NO: 111722 - DNA, 30 bp, Homo sapiens; identical to SEQ ID NO: 44610
  misc_feature 1..30: note = chr16:14728494-14728524
  misc_feature 1..30: note = Hypo
  source 1..30: mol_type = genomic DNA

SEQ ID NO: 111723 - DNA, 48 bp, Homo sapiens; identical to SEQ ID NO: 44611
  misc_feature 1..48: note = chr16:14761842-14761890
  misc_feature 1..48: note = Hypo
  source 1..48: mol_type = genomic DNA

SEQ ID NO: 111724 - DNA, 48 bp, Homo sapiens; identical to SEQ ID NO: 78480
  misc_feature 1..48: note = chr16:15052961-15053009
  misc_feature 1..48: note = Hypo
  source 1..48: mol_type = genomic DNA

SEQ ID NO: 111725 - DNA, 35 bp, Homo sapiens; identical to SEQ ID NO: 78481
  misc_feature 1..35: note = chr16:15191537-15191572
  misc_feature 1..35: note = Hypo
  source 1..35: mol_type = genomic DNA

SEQ ID NO: 111726 - DNA, 174 bp, Homo sapiens; identical to SEQ ID NO: 78484
  misc_feature 1..174: note = chr16:15241215-15241389
  misc_feature 1..174: note = Hypo
  source 1..174: mol_type = genomic DNA

SEQ ID NO: 111727 - DNA, 259 bp, Homo sapiens; identical to SEQ ID NO: 78486
  misc_feature 1..259: note = chr16:15489930-15490189
  misc_feature 1..259: note = Hyper
  source 1..259: mol_type = genomic DNA

SEQ ID NO: 111728 - DNA, 36 bp, Homo sapiens; identical to SEQ ID NO: 78487
  misc_feature 1..36: note = chr16:15522286-15522322
  misc_feature 1..36: note = Hypo
  source 1..36: mol_type = genomic DNA

SEQ ID NO: 111729 - DNA, 808 bp, Homo sapiens; identical to SEQ ID NO: 78488
  misc_feature 1..808: note = chr16:15528335-15529143
  misc_feature 1..808: note = Hyper
  source 1..808: mol_type = genomic DNA

SEQ ID NO: 111730 - DNA, 20 bp, Homo sapiens
  misc_feature 1..20: note = chr16:15552675-15552695
  misc_feature 1..20: note = Hypo
  source 1..20: mol_type = genomic DNA
aaacaaagccaggtgcggtg

SEQ ID NO: 111731 - DNA, 30 bp, Homo sapiens; identical to SEQ ID NO: 44614
  misc_feature 1..30: note = chr16:15555102-15555132
  misc_feature 1..30: note = Hypo
  source 1..30: mol_type = genomic DNA

SEQ ID NO: 111732 - DNA, 15 bp, Homo sapiens
  misc_feature 1..15: note = chr16:15594787-15594802
  misc_feature 1..15: note = Hypo
  source 1..15: mol_type = genomic DNA
cgtgagccaccgtgc

SEQ ID NO: 111733 - DNA, 161 bp, Homo sapiens; identical to SEQ ID NO: 78492
  misc_feature 1..161: note = chr16:15595873-15596034
  misc_feature 1..161: note = Hypo
  source 1..161: mol_type = genomic DNA

SEQ ID NO: 111734 - DNA, 17 bp, Homo sapiens
  misc_feature 1..17: note = chr16:15600039-15600056
  misc_feature 1..17: note = Hypo
  source 1..17: mol_type = genomic DNA
cttttatttttgagacg

SEQ ID NO: 111735 - DNA, 113 bp, Homo sapiens; identical to SEQ ID NO: 78494
  misc_feature 1..113: note = chr16:15604260-15604373
  misc_feature 1..113: note = Hypo
  source 1..113: mol_type = genomic DNA

SEQ ID NO: 111736 - DNA, 58 bp, Homo sapiens; identical to SEQ ID NO: 78495
  misc_feature 1..58: note = chr16:15626753-15626811
  misc_feature 1..58: note = Hypo
  source 1..58: mol_type = genomic DNA

SEQ ID NO: 111737 - DNA, 30 bp, Homo sapiens; identical to SEQ ID NO: 78496
  misc_feature 1..30: note = chr16:15628035-15628065
  misc_feature 1..30: note = Hypo
  source 1..30: mol_type = genomic DNA

SEQ ID NO: 111738 - DNA, 129 bp, Homo sapiens; identical to SEQ ID NO: 78497
  misc_feature 1..129: note = chr16:15692042-15692171
  misc_feature 1..129: note = Hypo
  source 1..129: mol_type = genomic DNA

SEQ ID NO: 111739 - DNA, 37 bp, Homo sapiens; identical to SEQ ID NO: 78498
  misc_feature 1..37: note = chr16:15743162-15743199
  misc_feature 1..37: note = Hypo
  source 1..37: mol_type = genomic DNA

SEQ ID NO: 111740 - DNA, 28 bp, Homo sapiens
  misc_feature 1..28: note = chr16:15746797-15746825
  misc_feature 1..28: note = Hypo
  source 1..28: mol_type = genomic DNA
gagagagccaccgcgcctggcctaagct

SEQ ID NO: 111741 - DNA, 170 bp, Homo sapiens; identical to SEQ ID NO: 78500
  misc_feature 1..170: note = chr16:15762561-15762731
  misc_feature 1..170: note = Hypo
  source 1..170: mol_type = genomic DNA

SEQ ID NO: 111742 - DNA, 30 bp, Homo sapiens; identical to SEQ ID NO: 78502
  misc_feature 1..30: note = chr16:15767710-15767740
  misc_feature 1..30: note = Hypo
  source 1..30: mol_type = genomic DNA

SEQ ID NO: 111743 - DNA, 92 bp, Homo sapiens; identical to SEQ ID NO: 44620
  misc_feature 1..92: note = chr16:15820825-15820917
  misc_feature 1..92: note = Hypo
  source 1..92: mol_type = genomic DNA

SEQ ID NO: 111744 - DNA, 30 bp, Homo sapiens; identical to SEQ ID NO: 78505
  misc_feature 1..30: note = chr16:15841780-15841810
  misc_feature 1..30: note = Hypo
  source 1..30: mol_type = genomic DNA

SEQ ID NO: 111745 - DNA, 498 bp, Homo sapiens; identical to SEQ ID NO: 78506
  misc_feature 1..498: note = chr16:15950839-15951337
  misc_feature 1..498: note = Hyper
  source 1..498: mol_type = genomic DNA

SEQ ID NO: 111746 - DNA, 643 bp, Homo sapiens; identical to SEQ ID NO: 78507
  misc_feature 1..643: note = chr16:15951793-15952436
  misc_feature 1..643: note = Hyper
  source 1..643: mol_type = genomic DNA

SEQ ID NO: 111747 - DNA, 30 bp, Homo sapiens; identical to SEQ ID NO: 78508
  misc_feature 1..30: note = chr16:16045826-16045856
  misc_feature 1..30: note = Hypo
  source 1..30: mol_type = genomic DNA

SEQ ID NO: 111748 - DNA, 30 bp, Homo sapiens; identical to SEQ ID NO: 78509
  misc_feature 1..30: note = chr16:16122579-16122609
  misc_feature 1..30: note = Hypo
  source 1..30: mol_type = genomic DNA

SEQ ID NO: 111749 - DNA, 37 bp, Homo sapiens; identical to SEQ ID NO: 78511
  misc_feature 1..37: note = chr16:16663469-16663506
  misc_feature 1..37: note = Hypo
  source 1..37: mol_type = genomic DNA

SEQ ID NO: 111750 - DNA, 30 bp, Homo sapiens; identical to SEQ ID NO: 78513
  misc_feature 1..30: note = chr16:17046472-17046502
  misc_feature 1..30: note = Hypo
  source 1..30: mol_type = genomic DNA

SEQ ID NO: 111751 - DNA, 22 bp, Homo sapiens
  misc_feature 1..22: note = chr16:17049589-17049611
  misc_feature 1..22: note = Hypo
  source 1..22: mol_type = genomic DNA
accacgccggccacaacagatt

SEQ ID NO: 111752 - DNA, 30 bp, Homo sapiens; identical to SEQ ID NO: 78515
  misc_feature 1..30: note = chr16:17077914-17077944
  misc_feature 1..30: note = Hypo
  source 1..30: mol_type = genomic DNA

SEQ ID NO: 111753 - DNA, 30 bp, Homo sapiens; identical to SEQ ID NO: 78516
  misc_feature 1..30: note = chr16:17202525-17202555
  misc_feature 1..30: note = Hypo
  source 1..30: mol_type = genomic DNA

SEQ ID NO: 111754 - DNA, 30 bp, Homo sapiens; identical to SEQ ID NO: 78518
  misc_feature 1..30: note = chr16:17294271-17294301
  misc_feature 1..30: note = Hypo
  source 1..30: mol_type = genomic DNA

SEQ ID NO: 111755 - DNA, 66 bp, Homo sapiens; identical to SEQ ID NO: 78521
  misc_feature 1..66: note = chr16:17335057-17335123
  misc_feature 1..66: note = Hypo
  source 1..66: mol_type = genomic DNA

SEQ ID NO: 111756 - DNA, 30 bp, Homo sapiens; identical to SEQ ID NO: 44622
  misc_feature 1..30: note = chr16:17341523-17341553
  misc_feature 1..30: note = Hypo
  source 1..30: mol_type = genomic DNA

SEQ ID NO: 111757 - DNA, 18 bp, Homo sapiens
  misc_feature 1..18: note = chr16:17368739-17368757
  misc_feature 1..18: note = Hypo
  source 1..18: mol_type = genomic DNA
ctctcagagcagggccgg

SEQ ID NO: 111758 - DNA, 16 bp, Homo sapiens
  misc_feature 1..16: note = chr16:17566188-17566204
  misc_feature 1..16: note = Hypo
  source 1..16: mol_type = genomic DNA
tgagataggcctgggc

SEQ ID NO: 111759 - DNA, 30 bp, Homo sapiens; identical to SEQ ID NO: 78530
  misc_feature 1..30: note = chr16:17659142-17659172
  misc_feature 1..30: note = Hypo
  source 1..30: mol_type = genomic DNA

SEQ ID NO: 111760 - DNA, 29 bp, Homo sapiens
  misc_feature 1..29: note = chr16:17821439-17821468
  misc_feature 1..29: note = Hypo
  source 1..29: mol_type = genomic DNA
tgagatcaggccaggcgcggtggctcaca

SEQ ID NO: 111761 - DNA, 88 bp, Homo sapiens; identical to SEQ ID NO: 78533
  misc_feature 1..88: note = chr16:17866374-17866462
  misc_feature 1..88: note = Hypo
  source 1..88: mol_type = genomic DNA

SEQ ID NO: 111762 - DNA, 152 bp, Homo sapiens; identical to SEQ ID NO: 78534
  misc_feature 1..152: note = chr16:17913465-17913617
  misc_feature 1..152: note = Hypo
  source 1..152: mol_type = genomic DNA

SEQ ID NO: 111763 - DNA, 146 bp, Homo sapiens; identical to SEQ ID NO: 44624
  misc_feature 1..146: note = chr16:18802485-18802631
  misc_feature 1..146: note = Hypo
  source 1..146: mol_type = genomic DNA

SEQ ID NO: 111764 - DNA, 128 bp, Homo sapiens; identical to SEQ ID NO: 78545
  misc_feature 1..128: note = chr16:18804414-18804542
  misc_feature 1..128: note = Hypo
  source 1..128: mol_type = genomic DNA

SEQ ID NO: 111765 - DNA, 33 bp, Homo sapiens; identical to SEQ ID NO: 78547
  misc_feature 1..33: note = chr16:18950653-18950686
  misc_feature 1..33: note = Hypo
  source 1..33: mol_type = genomic DNA

SEQ ID NO: 111766 - DNA, 32 bp, Homo sapiens; identical to SEQ ID NO: 78548
  misc_feature 1..32: note = chr16:18950986-18951018
  misc_feature 1..32: note = Hypo
  source 1..32: mol_type = genomic DNA

SEQ ID NO: 111767 - DNA, 40 bp, Homo sapiens; identical to SEQ ID NO: 78549
  misc_feature 1..40: note = chr16:18995550-18995590
  misc_feature 1..40: note = Hyper
  source 1..40: mol_type = genomic DNA

SEQ ID NO: 111768 - DNA, 142 bp, Homo sapiens; identical to SEQ ID NO: 78553
  misc_feature 1..142: note = chr16:19422024-19422166
  misc_feature 1..142: note = Hyper
  source 1..142: mol_type = genomic DNA

SEQ ID NO: 111769 - DNA, 166 bp, Homo sapiens; identical to SEQ ID NO: 78554
  misc_feature 1..166: note = chr16:19422383-19422549
  misc_feature 1..166: note = Hyper
  source 1..166: mol_type = genomic DNA

SEQ ID NO: 111770 - DNA, 30 bp, Homo sapiens; identical to SEQ ID NO: 78555
  misc_feature 1..30: note = chr16:19442928-19442958
  misc_feature 1..30: note = Hypo
  source 1..30: mol_type = genomic DNA

SEQ ID NO: 111771 - DNA, 30 bp, Homo sapiens; identical to SEQ ID NO: 78558
  misc_feature 1..30: note = chr16:19485502-19485532
  misc_feature 1..30: note = Hypo
  source 1..30: mol_type = genomic DNA

SEQ ID NO: 111772 - DNA, 30 bp, Homo sapiens; identical to SEQ ID NO: 78559
  misc_feature 1..30: note = chr16:19498338-19498368
  misc_feature 1..30: note = Hypo
  source 1..30: mol_type = genomic DNA

SEQ ID NO: 111773 - DNA, 30 bp, Homo sapiens; identical to SEQ ID NO: 78560
  misc_feature 1..30: note = chr16:19529179-19529209
  misc_feature 1..30: note = Hypo
  source 1..30: mol_type = genomic DNA

SEQ ID NO: 111774 - DNA, 23 bp, Homo sapiens
  misc_feature 1..23: note = chr16:19534847-19534870
  misc_feature 1..23: note = Hypo
  source 1..23: mol_type = genomic DNA
atcacgcccggtgggttcagcaa

SEQ ID NO: 111775 - DNA, 27 bp, Homo sapiens
  misc_feature 1..27: note = chr16:19554463-19554490
  misc_feature 1..27: note = Hypo
  source 1..27: mol_type = genomic DNA
ggaagtcagggaccccgaatggaggga

SEQ ID NO: 111776 - DNA, 486 bp, Homo sapiens; identical to SEQ ID NO: 78563
  misc_feature 1..486: note = chr16:19567041-19567527
  misc_feature 1..486: note = Hyper
  source 1..486: mol_type = genomic DNA

SEQ ID NO: 111777 - DNA, 42 bp, Homo sapiens; identical to SEQ ID NO: 78564
  misc_feature 1..42: note = chr16:19568977-19569019
  misc_feature 1..42: note = Hypo
  source 1..42: mol_type = genomic DNA

SEQ ID NO: 111778 - DNA, 57 bp, Homo sapiens; identical to SEQ ID NO: 78569
  misc_feature 1..57: note = chr16:19708504-19708561
  misc_feature 1..57: note = Hypo
  source 1..57: mol_type = genomic DNA

SEQ ID NO: 111779 - DNA, 30 bp, Homo sapiens
  misc_feature 1..30: note = chr16:19891072-19891102
  misc_feature 1..30: note = Hypo
  source 1..30: mol_type = genomic DNA
caccccatggggttgcggtgacggttaaaa

SEQ ID NO: 111780 - DNA, 420 bp, Homo sapiens
  misc_feature 1..420: note = chr16:19894846-19895266
  misc_feature 1..420: note = Hyper
  source 1..420: mol_type = genomic DNA
ccttggctgaagtgccggggtttttgtgccagatccctcccccacttctcttgtctttgcggggtcccccagggctttctgggctctgttcaggtgccccccggcctggtgcagttgggcggccaatgtggcgcgtgggctggggccccaggcggggacgccgctgcccgccacactccaggggcctttgtccgcgctccaaggagccgcccccttagcgaacgggggacggaaagggaggactggctaggcctgggtgtgacagagcaaggacggaggagtgaacccgctgcacgggggagatttctggggcaaggtcgttggccccttcccaggctgttcaaccggctgcccggggccaaggcgggtgcgggctcctcccgcgcgctcccttttcggcctaagcgctagggaccccgg

SEQ ID NO: 111781 - DNA, 18 bp, Homo sapiens
  misc_feature 1..18: note = chr16:19929829-19929847
  misc_feature 1..18: note = Hypo
  source 1..18: mol_type = genomic DNA
tcccggtcggaaatttat

SEQ ID NO: 111782 - DNA, 97 bp, Homo sapiens; identical to SEQ ID NO: 78571
  misc_feature 1..97: note = chr16:20084459-20084556
  misc_feature 1..97: note = Hyper
  source 1..97: mol_type = genomic DNA

SEQ ID NO: 111783 - DNA, 816 bp, Homo sapiens
  misc_feature 1..816: note = chr16:20084616-20085432
  misc_feature 1..816: note = Hyper
  source 1..816: mol_type = genomic DNA
cacacacacacggtccccagctagggcacagcaacttcctttccccccgtgtggaaatatccatagttgcccttaaagcttaaactttttccgagggggcgccagggaacgcacgggggaggacgggggattctgggtagggttgcccggcacttggggttcctggcttccctccctctcccccacgcccctcacctggtaaaccgaggcacagcaagaggctgtagtagaccacgggcacgaaacccaagccgcaggccgagccgggggaccaccaagacagcgagctgttggctgcgaggtgggcgtgcgtgtgctccatgagcgcgcccctcgctccccttgccgcttcgcgcccggcctgccagcccgactctggtcgccggctcggtggtggcggcggcggaggcagcggcagctggagcagcagcgcctctctccccgcaggactggctcctacccttggccgtgatcccctctgctcgctccgcacctgcccgcctggagtcttggctcagccctcccgcagggcgcggggcgcagggtgcggggcgcgctgcgcggggcctcgggaggggctcccggagcccgtctgtgcgcctcccacctcggacccgctccactcccgcctcaaagccggggggctgggacgccgctccccgcagccaatcagcggctgcctggaagcggagtgtgtgtggggtgggagggatgcggaagaggagggggtcccagccgcctcgcttggctccactttcaggggagaagatgcagttagacctgggagccccgaaggaagaccggagtggaaaacag

SEQ ID NO: 111784 - DNA, 205 bp, Homo sapiens; identical to SEQ ID NO: 78574
  misc_feature 1..205: note = chr16:20085652-20085857
  misc_feature 1..205: note = Hyper
  source 1..205: mol_type = genomic DNA

SEQ ID NO: 111785 - DNA, 30 bp, Homo sapiens; identical to SEQ ID NO: 78575
  misc_feature 1..30: note = chr16:20133385-20133415
  misc_feature 1..30: note = Hypo
  source 1..30: mol_type = genomic DNA

SEQ ID NO: 111786 - DNA, 201 bp, Homo sapiens; identical to SEQ ID NO: 78578
  misc_feature 1..201: note = chr16:20327304-20327505
  misc_feature 1..201: note = Hypo
  source 1..201: mol_type = genomic DNA

SEQ ID NO: 111787 - DNA, 201 bp, Homo sapiens; identical to SEQ ID NO: 78580
  misc_feature 1..201: note = chr16:20359734-20359935
  misc_feature 1..201: note = Hyper
  source 1..201: mol_type = genomic DNA

SEQ ID NO: 111788 - DNA, 108 bp, Homo sapiens; identical to SEQ ID NO: 78597
  misc_feature 1..108: note = chr16:21289404-21289512
  misc_feature 1..108: note = Hyper
  source 1..108: mol_type = genomic DNA

SEQ ID NO: 111789 - DNA, 464 bp, Homo sapiens
  misc_feature 1..464: note = chr16:21294910-21295374
  misc_feature 1..464: note = Hyper
  source 1..464: mol_type = genomic DNA
ggccaggacaagcaacggatgaagtatctcggaagccggagaagggtggtctggggctcttgggagcatgcgcggggtggggcggtggggggactgaggtggcgctcccggctcctccgcgcgcccccggcaccttccgcgcgtccccggctccccacactccgtccccggctccccacactcccaccccggtctgccccgggcgcccccggttccccacctcctggtgtgcctctggcgggtccgcgcaggatcaggctacagactcgcccgcgggcggctgcgcggcgggccgttggggagggtgttgggatgaggagccccaaccagatggacgcgcaccccgcagcggcggaggcggcggcgaggcttgagcagtgagtgctcgggagccccggccagcccttcctccttctgcctgcgtcctctgcgctggccgctgctccagacgccagggggcccac

SEQ ID NO: 111790 - DNA, 59 bp, Homo sapiens; identical to SEQ ID NO: 78602
  misc_feature 1..59: note = chr16:21363314-21363373
  misc_feature 1..59: note = Hypo
  source 1..59: mol_type = genomic DNA

SEQ ID NO: 111791 - DNA, 90 bp, Homo sapiens; identical to SEQ ID NO: 78609
  misc_feature 1..90: note = chr16:21526523-21526613
  misc_feature 1..90: note = Hypo
  source 1..90: mol_type = genomic DNA

SEQ ID NO: 111792 - DNA, 48 bp, Homo sapiens; identical to SEQ ID NO: 78610
  misc_feature 1..48: note = chr16:21539162-21539210
  misc_feature 1..48: note = Hypo
  source 1..48: mol_type = genomic DNA

SEQ ID NO: 111793 - DNA, 38 bp, Homo sapiens; identical to SEQ ID NO: 78611
  misc_feature 1..38: note = chr16:21541457-21541495
  misc_feature 1..38: note = Hypo
  source 1..38: mol_type = genomic DNA

SEQ ID NO: 111794 - DNA, 157 bp, Homo sapiens; identical to SEQ ID NO: 78612
  misc_feature 1..157: note = chr16:21566618-21566775
  misc_feature 1..157: note = Hypo
  source 1..157: mol_type = genomic DNA

SEQ ID NO: 111795 - DNA, 51 bp, Homo sapiens; identical to SEQ ID NO: 78613
  misc_feature 1..51: note = chr16:21569348-21569399
  misc_feature 1..51: note = Hypo
  source 1..51: mol_type = genomic DNA

SEQ ID NO: 111796 - DNA, 256 bp, Homo sapiens; identical to SEQ ID NO: 78617
  misc_feature 1..256: note = chr16:21675205-21675461
  misc_feature 1..256: note = Hyper
  source 1..256: mol_type = genomic DNA

SEQ ID NO: 111797 - DNA, 33 bp, Homo sapiens; identical to SEQ ID NO: 44635
  misc_feature 1..33: note = chr16:21719131-21719164
  misc_feature 1..33: note = Hypo
  source 1..33: mol_type = genomic DNA

SEQ ID NO: 111798 - DNA, 411 bp, Homo sapiens; identical to SEQ ID NO: 78619
  misc_feature 1..411: note = chr16:21831546-21831957
  misc_feature 1..411: note = Hyper
  source 1..411: mol_type = genomic DNA

SEQ ID NO: 111799 - DNA, 20 bp, Homo sapiens
  misc_feature 1..20: note = chr16:21839328-21839348
  misc_feature 1..20: note = Hypo
  source 1..20: mol_type = genomic DNA
acagacagaaaagcacggtc

SEQ ID NO: 111800 - DNA, 328 bp, Homo sapiens; identical to SEQ ID NO: 78625
  misc_feature 1..328: note = chr16:22173605-22173933
  misc_feature 1..328: note = Hyper
  source 1..328: mol_type = genomic DNA

SEQ ID NO: 111801 - DNA, 30 bp, Homo sapiens; identical to SEQ ID NO: 78626
  misc_feature 1..30: note = chr16:22189581-22189611
  misc_feature 1..30: note = Hypo
  source 1..30: mol_type = genomic DNA

SEQ ID NO: 111802 - DNA, 377 bp, Homo sapiens; identical to SEQ ID NO: 12422
  misc_feature 1..377: note = chr16:22203596-22203973
  misc_feature 1..377: note = Hyper
  source 1..377: mol_type = genomic DNA

SEQ ID NO: 111803 - DNA, 19 bp, Homo sapiens
  misc_feature 1..19: note = chr16:22216598-22216617
  misc_feature 1..19: note = Hypo
  source 1..19: mol_type = genomic DNA
gtttttgtttttttgcgac

SEQ ID NO: 111804 - DNA, 30 bp, Homo sapiens; identical to SEQ ID NO: 78629
  misc_feature 1..30: note = chr16:22289966-22289996
  misc_feature 1..30: note = Hypo
  source 1..30: mol_type = genomic DNA

SEQ ID NO: 111805 - DNA, 1906 bp, Homo sapiens
  misc_feature 1..1906: note = chr16:22824473-22826379
  misc_feature 1..1906: note = Hyper
  source 1..1906: mol_type = genomic DNA
tctggacatggtcaccgagaactgtcctgtaggcattcacttaggaatcattcgaagtggaattgctcctggatacgttctccttgtactctgtttcctcctcctagtgtctctgtgtgaagaagccctcctcactcagccctcggcgaccctctggtaccctggacagctccccggggagcagtctaccgctaggcggcggctgctaagagaggaaccctcctgacgcggagtctgccgctccggggctcgctctccggcaggcccggggagaggtggggtgacaatgggttggggtgcgcgcgtgcctcataggtgcgagacagagcgagccgccggggtgtgagtcagcgcgctgggggctaagaagctgggtgaatagtcacggaatctcactcacgctcggctcctccacccatcccgtctacagcgcgtgtcccagtccagggcgtgcgtgcgctcggtgtccgattccgggctgtgtgtgtccatttggcgagatgtcgagagcggggggagtgtccttgtcggtgtatctgggcccaggttaggggacttctcctccccacccccgcgtgggtgtgggggtgtgtccgggctagggcgcgtgtgcttctgtgcctgtgcgtgcgtgtgcgggtcagggtggtgggaccgcgcatcagggcagggtgcctgcgtctgcgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcctgcatggggagggcccgcgtgctgtgtttctgggaggggtaagagagtgggggcgcagggggcgggccaggtccctgggcgcggcgcgggctcgggggacccgcgcggctgacgtcaggccactccttaaatagagccggcagcgcgctccgctcggcatttcccgaagagccagatcgcggccggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgagccgcccggctgcccggagccccatcgcctaggaccgggagatgctggaaatgcaaccgcctgttccccgaggagccgctgcccccgggaccccctggcactgtgcgcaccctggtcagcagcccccggagaagacggcgcccccaacgcccgacccgcgtggccgtggcagcgccacgcgagccctctaggcgaccgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttct

SEQ ID NO: 111806 - DNA, 30 bp, Homo sapiens; identical to SEQ ID NO: 44636
  misc_feature 1..30: note = chr16:23093885-23093915
  misc_feature 1..30: note = Hypo
  source 1..30: mol_type = genomic DNA

SEQ ID NO: 111807 - DNA, 37 bp, Homo sapiens; identical to SEQ ID NO: 78655
  misc_feature 1..37: note = chr16:23194399-23194436
  misc_feature 1..37: note = Hyper
  source 1..37: mol_type = genomic DNA

SEQ ID NO: 111808 - DNA, 213 bp, Homo sapiens; identical to SEQ ID NO: 78658
  misc_feature 1..213: note = chr16:23303285-23303498
  misc_feature 1..213: note = Hypo
  source 1..213: mol_type = genomic DNA

SEQ ID NO: 111809 - DNA, 621 bp, Homo sapiens
  misc_feature 1..621: note = chr16:23313389-23314010
  misc_feature 1..621: note = Hyper
  source 1..621: mol_type = genomic DNA
ggcgcatgtgggtatcgctggtgtcccgaggtggggagggagaatgcggagcgcgtgcgtgcggggggcgtccagtgtccctgaacctggcgtgtgggggctggagcttattgggaggcgagggaggtggccaggggagccgggaccgtgcgtgtggccaggccggtagcgcccagtaagctccacccgcgggcgctccccgtgcttccccgcccctgaacctgctccctcccagtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtatgacggcgaaccctggctcgcacccggtctcccgcgcgctgcccggagtccctgcgcgcgcgccttctcctgcccaaccccggcccgcgagctcctgtcccggcctcagtttcccacgggagggcgcttgggtgcctgtctgaggcgcctgggacccggcctggggactgaacgggttgggggcggaggggagagctggaggctgggaaaagcccccagggtgcagaaggcagacggggccagggtccc

SEQ ID NO: 111810 - DNA, 151 bp, Homo sapiens; identical to SEQ ID NO: 78663
  misc_feature 1..151: note = chr16:23444796-23444947
  misc_feature 1..151: note = Hypo
  source 1..151: mol_type = genomic DNA

SEQ ID NO: 111811 - DNA, 47 bp, Homo sapiens; identical to SEQ ID NO: 78664
  misc_feature 1..47: note = chr16:23511691-23511738
  misc_feature 1..47: note = Hypo
  source 1..47: mol_type = genomic DNA

SEQ ID NO: 111812 - DNA, 29 bp, Homo sapiens
  misc_feature 1..29: note = chr16:23551968-23551997
  misc_feature 1..29: note = Hypo
  source 1..29: mol_type = genomic DNA
aaggtttgggctgagcgcagtggctcatg

SEQ ID NO: 111813 - DNA, 30 bp, Homo sapiens; identical to SEQ ID NO: 78666
  misc_feature 1..30: note = chr16:23595732-23595762
  misc_feature 1..30: note = Hypo
  source 1..30: mol_type = genomic DNA

SEQ ID NO: 111814 - DNA, 38 bp, Homo sapiens; identical to SEQ ID NO: 78667
  misc_feature 1..38: note = chr16:23606618-23606656
  misc_feature 1..38: note = Hypo
  source 1..38: mol_type = genomic DNA

SEQ ID NO: 111815 - DNA, 19 bp, Homo sapiens
  misc_feature 1..19: note = chr16:23651266-23651285
  misc_feature 1..19: note = Hypo
  source 1..19: mol_type = genomic DNA
atctcggcagctccctgca

SEQ ID NO: 111816 - DNA, 389 bp, Homo sapiens
  misc_feature 1..389: note = chr16:23706226-23706615
  misc_feature 1..389: note = Hyper
  source 1..389: mol_type = genomic DNA
cctggcttcaggtcccggtgcactgtgggagaggggcagaaagaaagctggttgctgagggcggaaggcaggggctaaggacagggagcgggaggcaggggaagtgcgggtacctatgtgtaaagagtgcaggtgggccaggccagacatcagctgctgcagcacgacctcgggctccagacccccgcgatccaggtccgggttttctacgtactgagcagcagcaagggccaaagcatcactctccagcccggaccttcccactcaccctccctgaaccgcaatgcaactcacctcctgcaaggaggcccggcagagctccagggcaatgtagtggaactggggtccccgctcggtgcagaagtagcggagcacgttggggtgcctgt

SEQ ID NO: 111817 - DNA, 96 bp, Homo sapiens; identical to SEQ ID NO: 78671
  misc_feature 1..96: note = chr16:23716327-23716423
  misc_feature 1..96: note = Hypo
  source 1..96: mol_type = genomic DNA

SEQ ID NO: 111818 - DNA, 104 bp, Homo sapiens; identical to SEQ ID NO: 36097
  misc_feature 1..104: note = chr16:23765896-23766000
  misc_feature 1..104: note = Hyper
  source 1..104: mol_type = genomic DNA

SEQ ID NO: 111819 - DNA, 337 bp, Homo sapiens; identical to SEQ ID NO: 78673
  misc_feature 1..337: note = chr16:23766233-23766570
  misc_feature 1..337: note = Hyper
  source 1..337: mol_type = genomic DNA

SEQ ID NO: 111820 - DNA, 102 bp, Homo sapiens; identical to SEQ ID NO: 78674
  misc_feature 1..102: note = chr16:23782435-23782537
  misc_feature 1..102: note = Hypo
  source 1..102: mol_type = genomic DNA

SEQ ID NO: 111821 - DNA, 30 bp, Homo sapiens; identical to SEQ ID NO: 78675
  misc_feature 1..30: note = chr16:23829399-23829429
  misc_feature 1..30: note = Hypo
  source 1..30: mol_type = genomic DNA

SEQ ID NO: 111822 - DNA, 1773 bp, Homo sapiens
  misc_feature 1..1773: note = chr16:23846792-23848565
  misc_feature 1..1773: note = Hyper
  source 1..1773: mol_type = genomic DNA
cctacctctgcagaacgtgtgtgtgtatgtgtgtgtaagtgtgtgcggccacaagcctttccgaatgagtgacagcgggagcccatccctccaggagacgcgtgcagaatgaccaatgggatggatgggggtggatgggtaccagtctccgcagaggccggggtggaattcgctgcgccccaccccttccacccgctccccttcgccccgtaggtctttccactctcgctcctcccctgggcacatctcctgaacgcagccccgggggccgaggacggggtggggtggggggcgaggctcgggtccgacgaccccgggctgcggtcccggcgctgcagagctgcggctgtgcacgcttagccgcgaggcccgcggtagcccgggcgccgatatgtaaagcagctggcagcgctgggcggggcctgggcgcgatgcaaatgaggagggcggggctggcccggggctccgcctccctcccccgcagctggggccagcggtgccaagcgcagctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggtgagcgcgcgcgcgcagggcaccttcccgggcccccgagggcagcgccgcgccagggaccccctctccgcgccctctgcgccctccgcgccctccgcaccctgggaccccgcgtctccggactcccggctccggaccctgctgcccgggactcccggatggacagtcctgccgttgccctgtccccaccctggtcccagacgggccgccgcggggcgcctcctgccctctcctgctctcaggcgcctctagagcgcccaggggcggcgtcgcgggagcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggcggcgccctgggtgtccttctctatctccctgcgggcatgggacatcctttctcactcctctgtgcctccgggcagcgccctgtgttatctcccattgcccctccccgagggcctgggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttcccgagggtgctcggggcatctatgggtacatctgtcgcctgccttcagcccctaccccgacggaaacgctccccactatcccgccacctggtggtcgcagcctcctctcttctgcaggagtgaaggcagatgggggttacagccgagctcccacctacccccacaaaggcggaagactcttggg

SEQ ID NO: 111823 - DNA, 30 bp, Homo sapiens; identical to SEQ ID NO: 78683
  misc_feature 1..30: note = chr16:23939787-23939817
  misc_feature 1..30: note = Hypo
  source 1..30: mol_type = genomic DNA

SEQ ID NO: 111824 - DNA, 30 bp, Homo sapiens; identical to SEQ ID NO: 78684
  misc_feature 1..30: note = chr16:23966825-23966855
  misc_feature 1..30: note = Hypo
  source 1..30: mol_type = genomic DNA

SEQ ID NO: 111825 - DNA, 105 bp, Homo sapiens; identical to SEQ ID NO: 78685
  misc_feature 1..105: note = chr16:23967391-23967496
  misc_feature 1..105: note = Hypo
  source 1..105: mol_type = genomic DNA

SEQ ID NO: 111826 - DNA, 231 bp, Homo sapiens; identical to SEQ ID NO: 78686
  misc_feature 1..231: note = chr16:23990945-23991176
  misc_feature 1..231: note = Hypo
  source 1..231: mol_type = genomic DNA

SEQ ID NO: 111827 - DNA, 33 bp, Homo sapiens; identical to SEQ ID NO: 44642
  misc_feature 1..33: note = chr16:24013932-24013965
  misc_feature 1..33: note = Hypo
  source 1..33: mol_type = genomic DNA

SEQ ID NO: 111828 - DNA, 30 bp, Homo sapiens; identical to SEQ ID NO: 78688
  misc_feature 1..30: note = chr16:24118868-24118898
  misc_feature 1..30: note = Hypo
  source 1..30: mol_type = genomic DNA

SEQ ID NO: 111829 - DNA, 690 bp, Homo sapiens
  misc_feature 1..690: note = chr16:24266904-24267594
  misc_feature 1..690: note = Hyper
  source 1..690: mol_type = genomic DNA
cgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatcc

SEQ ID NO: 111830 - DNA, 150 bp, Homo sapiens
  misc_feature 1..150: note = chr16:24267654-24267804
  misc_feature 1..150: note = Hyper
  source 1..150: mol_type = genomic DNA
cacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatg

SEQ ID NO: 111831 - DNA, 30 bp, Homo sapiens; identical to SEQ ID NO: 78694
  misc_feature 1..30: note = chr16:24366205-24366235
  misc_feature 1..30: note = Hypo
  source 1..30: mol_type = genomic DNA

SEQ ID NO: 111832 - DNA, 100 bp, Homo sapiens; identical to SEQ ID NO: 78695
  misc_feature 1..100: note = chr16:24373008-24373108
  misc_feature 1..100: note = Hypo
  source 1..100: mol_type = genomic DNA

SEQ ID NO: 111833 - DNA, 37 bp, Homo sapiens; identical to SEQ ID NO: 78696
  misc_feature 1..37: note = chr16:24383172-24383209
  misc_feature 1..37: note = Hypo
  source 1..37: mol_type = genomic DNA

SEQ ID NO: 111834 - DNA, 30 bp, Homo sapiens; identical to SEQ ID NO: 78697
  misc_feature 1..30: note = chr16:24549351-24549381
  misc_feature 1..30: note = Hypo
  source 1..30: mol_type = genomic DNA

SEQ ID NO: 111835 - DNA, 212 bp, Homo sapiens; identical to SEQ ID NO: 78698
  misc_feature 1..212: note = chr16:24621853-24622065
  misc_feature 1..212: note = Hyper
  source 1..212: mol_type = genomic DNA

SEQ ID NO: 111836 - DNA, 23 bp, Homo sapiens
  misc_feature 1..23: note = chr16:24880199-24880222
  misc_feature 1..23: note = Hypo
  source 1..23: mol_type = genomic DNA
tttttttttttgagacggagtct

SEQ ID NO: 111837 - DNA, 23 bp, Homo sapiens
  misc_feature 1..23: note = chr16:25071412-25071435
  misc_feature 1..23: note = Hypo
  source 1..23: mol_type = genomic DNA
aaacttgttaatcaccgggcgcg

SEQ ID NO: 111838 - DNA, 31 bp, Homo sapiens; identical to SEQ ID NO: 78706
  misc_feature 1..31: note = chr16:25077193-25077224
  misc_feature 1..31: note = Hypo
  source 1..31: mol_type = genomic DNA

SEQ ID NO: 111839 - DNA, 30 bp, Homo sapiens; identical to SEQ ID NO: 78707
  misc_feature 1..30: note = chr16:25078633-25078663
  misc_feature 1..30: note = Hyper
  source 1..30: mol_type = genomic DNA

SEQ ID NO: 111840 - DNA, 78 bp, Homo sapiens; identical to SEQ ID NO: 78710
  misc_feature 1..78: note = chr16:25111119-25111197
  misc_feature 1..78: note = Hypo
  source 1..78: mol_type = genomic DNA

SEQ ID NO: 111841 - DNA, 36 bp, Homo sapiens; identical to SEQ ID NO: 78713
  misc_feature 1..36: note = chr16:25266537-25266573
  misc_feature 1..36: note = Hypo
  source 1..36: mol_type = genomic DNA

SEQ ID NO: 111842 - DNA, 30 bp, Homo sapiens; identical to SEQ ID NO: 78720
  misc_feature 1..30: note = chr16:25535143-25535173
  misc_feature 1..30: note = Hypo
  source 1..30: mol_type = genomic DNA

SEQ ID NO: 111843 - DNA, 19 bp, Homo sapiens
  misc_feature 1..19: note = chr16:25551069-25551088
  misc_feature 1..19: note = Hypo
  source 1..19: mol_type = genomic DNA
ggtgctggccaggcacggt

SEQ ID NO: 111844 - DNA, 28 bp, Homo sapiens
  misc_feature 1..28: note = chr16:25692519-25692547
  misc_feature 1..28: note = Hypo
  source 1..28: mol_type = genomic DNA
ttaagatatgtaggccgggtgcggtggc

SEQ ID NO: 111845 - DNA, 1849 bp, Homo sapiens
  misc_feature 1..1849: note = chr16:25702795-25704644
  misc_feature 1..1849: note = Hyper
  source 1..1849: mol_type = genomic DNA
agagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaagcggaagcgagagcttcgtcacccgctgtcttccagctcccggtgcgcggcaccggaggcaggcgttgggctttacctctctaaaagtactggggcaaaggaatggagaacacggcgtcccgagctcccaagggaggggagtaaacgaggtggggtggggaacaccccaagtgcgtgcgtgctgggggctggggggcacgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcggcggcggcggcggcggcgggggcggcggctgaaaccatgtccgggcagcgccgggggctgccgccgccgccgccgccgccgcgagccgggagccgcgatggcccggtggcccgcacctcctccgcctccgcctccgcctccacctctggccgcgccgccgccgcccggcgcctctgctaaggggccgccggcgcgcaagctgctttttatgtgcaccttgtccctgtctgtcacctacctgtgctacagcctcctgggcggctcgggctccctgcaattccctctggcgctgcaggagtcgccgggcgccgccgccgagcccccgccgagcccgccgccaccctctctgctgcctacccccgtgcgcctcggcgccccctcgcagccgcccgcgccgccgccgctggacaacgcgagccacggggagccgcccgagcccccagagcagccagccgcccccgggaccgacggctgggggctgccgagcggcggcggaggcgcccaggacgcctggctccggaccccgctggcccccagcgagatgatcacggctcagagcgcgctgccggagagggaagcgcaggagtccagcaccaccgacgaggatctcgcaggccggagagcggccaacgggagcagcgagaggggcggcgccgtcagcacccccgactatggggagaagaagctgccacaggcgctcatcatcggggtcaagaaaggagggacccgcgcgctgctggaggcgatccgcgtgcacccggacgtgcgggcggtgggcgtagagccgcacttcttcgacaggaactacgaaaaggggttggagtggtacaggtaggaccctgggctccgcgggctggtggagacgcgtgggggagacgcggaggggaagccgcggctttccacgcccttcgagcatccaggcaccgtcccgagaggcccaagcccccgcgagggctctgcaaaccctggcggcgttgctcagggggatcggctgagagggctg

SEQ ID NO: 111846 - DNA, 151 bp, Homo sapiens; identical to SEQ ID NO: 78725
  misc_feature 1..151: note = chr16:25808282-25808433
  misc_feature 1..151: note = Hypo
  source 1..151: mol_type = genomic DNA

SEQ ID NO: 111847 - DNA, 30 bp, Homo sapiens; identical to SEQ ID NO: 78726
  misc_feature 1..30: note = chr16:25859755-25859785
  misc_feature 1..30: note = Hypo
  source 1..30: mol_type = genomic DNA

SEQ ID NO: 111848 - DNA, 18 bp, Homo sapiens
  misc_feature 1..18: note = chr16:26044215-26044233
  misc_feature 1..18: note = Hypo
  source 1..18: mol_type = genomic DNA
tctcgcctcttcttcaca

SEQ ID NO: 111849 - DNA, 32 bp, Homo sapiens; identical to SEQ ID NO: 78729
  misc_feature 1..32: note = chr16:26383401-26383433
  misc_feature 1..32: note = Hypo
  source 1..32: mol_type = genomic DNA

SEQ ID NO: 111850 - DNA, 88 bp, Homo sapiens; identical to SEQ ID NO: 78730
  misc_feature 1..88: note = chr16:26388441-26388529
  misc_feature 1..88: note = Hypo
  source 1..88: mol_type = genomic DNA

SEQ ID NO: 111851 - DNA, 214 bp, Homo sapiens; identical to SEQ ID NO: 78731
  misc_feature 1..214: note = chr16:26501488-26501702
  misc_feature 1..214: note = Hypo
  source 1..214: mol_type = genomic DNA

SEQ ID NO: 111852 - DNA, 134 bp, Homo sapiens; identical to SEQ ID NO: 78732
  misc_feature 1..134: note = chr16:26616439-26616573
  misc_feature 1..134: note = Hypo
  source 1..134: mol_type = genomic DNA

SEQ ID NO: 111853 - DNA, 42 bp, Homo sapiens; identical to SEQ ID NO: 44646
  misc_feature 1..42: note = chr16:26664733-26664775
  misc_feature 1..42: note = Hypo
  source 1..42: mol_type = genomic DNA

SEQ ID NO: 111854 - DNA, 30 bp, Homo sapiens; identical to SEQ ID NO: 44647
  misc_feature 1..30: note = chr16:26732577-26732607
  misc_feature 1..30: note = Hypo
  source 1..30: mol_type = genomic DNA

SEQ ID NO: 111855 - DNA, 30 bp, Homo sapiens; identical to SEQ ID NO: 78735
  misc_feature 1..30: note = chr16:26830222-26830252
  misc_feature 1..30: note = Hypo
  source 1..30: mol_type = genomic DNA

SEQ ID NO: 111856 - DNA, 30 bp, Homo sapiens; identical to SEQ ID NO: 78736
  misc_feature 1..30: note = chr16:27006797-27006827
  misc_feature 1..30: note = Hypo
  source 1..30: mol_type = genomic DNA

SEQ ID NO: 111857 - DNA, 32 bp, Homo sapiens; identical to SEQ ID NO: 44648
  misc_feature 1..32: note = chr16:27038943-27038975
  misc_feature 1..32: note = Hypo
  source 1..32: mol_type = genomic DNA

SEQ ID NO: 111858 - DNA, 70 bp, Homo sapiens; identical to SEQ ID NO: 78738
  misc_feature 1..70: note = chr16:27052238-27052308
  misc_feature 1..70: note = Hypo
  source 1..70: mol_type = genomic DNA

SEQ ID NO: 111859 - DNA, 57 bp, Homo sapiens; identical to SEQ ID NO: 78740
  misc_feature 1..57: note = chr16:27166676-27166733
  misc_feature 1..57: note = Hyper
  source 1..57: mol_type = genomic DNA

SEQ ID NO: 111860 - DNA, 36 bp, Homo sapiens; identical to SEQ ID NO: 44649
  misc_feature 1..36: note = chr16:27279055-27279091
  misc_feature 1..36: note = Hypo
  source 1..36: mol_type = genomic DNA

SEQ ID NO: 111861 - DNA, 30 bp, Homo sapiens; identical to SEQ ID NO: 78743
  misc_feature 1..30: note = chr16:27460076-27460106
  misc_feature 1..30: note = Hypo
  source 1..30: mol_type = genomic DNA

SEQ ID NO: 111862 - DNA, 30 bp, Homo sapiens; identical to SEQ ID NO: 78747
  misc_feature 1..30: note = chr16:27661959-27661989
  misc_feature 1..30: note = Hypo
  source 1..30: mol_type = genomic DNA

SEQ ID NO: 111863 - DNA, 110 bp, Homo sapiens; identical to SEQ ID NO: 78749
  misc_feature 1..110: note = chr16:27853439-27853549
  misc_feature 1..110: note = Hypo
  source 1..110: mol_type = genomic DNA

SEQ ID NO: 111864 - DNA, 56 bp, Homo sapiens; identical to SEQ ID NO: 78751
  misc_feature 1..56: note = chr16:28057979-28058035
  misc_feature 1..56: note = Hypo
  source 1..56: mol_type = genomic DNA

SEQ ID NO: 111865 - DNA, 1388 bp, Homo sapiens
  misc_feature 1..1388: note = chr16:28073999-28075387
  misc_feature 1..1388: note = Hyper
  source 1..1388: mol_type = genomic DNA
gggcatctagtgccccgcgaaaggaagaggaggagggggcgagcgtggagatgagttcaggagcggaaagcagcgcgcgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaacgtcgcccctagccaggcggagcgctgggagctgggcccaggcggcgggaggagggcgaacgggtccggggctcgggcctcgatggccgcgccgccccgggggagccggagccgagctggccgccgcccgcgcgcactcaccaagcccgctgagctcctcctcgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtgcggggcgggctggcggggcgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggacc

SEQ ID NO: 111866 - DNA, 221 bp, Homo sapiens; identical to SEQ ID NO: 78757
  misc_feature 1..221: note = chr16:28104147-28104368
  misc_feature 1..221: note = Hypo
  source 1..221: mol_type = genomic DNA

SEQ ID NO: 111867 - DNA, 220 bp, Homo sapiens; identical to SEQ ID NO: 78760
  misc_feature 1..220: note = chr16:28304439-28304659
  misc_feature 1..220: note = Hyper
  source 1..220: mol_type = genomic DNA

SEQ ID NO: 111868 - DNA, 104 bp, Homo sapiens; identical to SEQ ID NO: 78762
  misc_feature 1..104: note = chr16:28560175-28560279
  misc_feature 1..104: note = Hypo
  source 1..104: mol_type = genomic DNA

SEQ ID NO: 111869 - DNA, 165 bp, Homo sapiens; identical to SEQ ID NO: 78766
  misc_feature 1..165: note = chr16:28878680-28878845
  misc_feature 1..165: note = Hypo
  source 1..165: mol_type = genomic DNA

SEQ ID NO: 111870 - DNA, 149 bp, Homo sapiens; identical to SEQ ID NO: 78767
  misc_feature 1..149: note = chr16:28887653-28887802
  misc_feature 1..149: note = Hypo
  source 1..149: mol_type = genomic DNA

SEQ ID NO: 111871 - DNA, 523 bp, Homo sapiens; identical to SEQ ID NO: 78768
  misc_feature 1..523: note = chr16:28891515-28892038
  misc_feature 1..523: note = Hyper
  source 1..523: mol_type = genomic DNA

SEQ ID NO: 111872 - DNA, 26 bp, Homo sapiens
  misc_feature 1..26: note = chr16:28947344-28947370
  misc_feature 1..26: note = Hypo
  source 1..26: mol_type = genomic DNA
cccgtccgcctcgcaatttgaactcc

SEQ ID NO: 111873 - DNA, 70 bp, Homo sapiens; identical to SEQ ID NO: 78772
  misc_feature 1..70: note = chr16:28947831-28947901
  misc_feature 1..70: note = Hyper
  source 1..70: mol_type = genomic DNA

SEQ ID NO: 111874 - DNA, 38 bp, Homo sapiens; identical to SEQ ID NO: 78773
  misc_feature 1..38: note = chr16:28986682-28986720
  misc_feature 1..38: note = Hyper
  source 1..38: mol_type = genomic DNA

SEQ ID NO: 111875 - DNA, 90 bp, Homo sapiens; identical to SEQ ID NO: 78774
  misc_feature 1..90: note = chr16:29009366-29009456
  misc_feature 1..90: note = Hypo
  source 1..90: mol_type = genomic DNA

SEQ ID NO: 111876 - DNA, 30 bp, Homo sapiens; identical to SEQ ID NO: 78775
  misc_feature 1..30: note = chr16:29083064-29083094
  misc_feature 1..30: note = Hypo
  source 1..30: mol_type = genomic DNA

SEQ ID NO: 111877 - DNA, 30 bp, Homo sapiens; identical to SEQ ID NO: 78776
  misc_feature 1..30: note = chr16:29119028-29119058
  misc_feature 1..30: note = Hypo
  source 1..30: mol_type = genomic DNA

SEQ ID NO: 111878 - DNA, 85 bp, Homo sapiens; identical to SEQ ID NO: 78777
  misc_feature 1..85: note = chr16:29139086-29139171
  misc_feature 1..85: note = Hypo
  source 1..85: mol_type = genomic DNA

SEQ ID NO: 111879 - DNA, 97 bp, Homo sapiens; identical to SEQ ID NO: 78778
  misc_feature 1..97: note = chr16:29153157-29153254
  misc_feature 1..97: note = Hypo
  source 1..97: mol_type = genomic DNA

SEQ ID NO: 111880 - DNA, 217 bp, Homo sapiens; identical to SEQ ID NO: 78779
  misc_feature 1..217: note = chr16:29153374-29153591
  misc_feature 1..217: note = Hypo
  source 1..217: mol_type = genomic DNA

SEQ ID NO: 111881 - DNA, 159 bp, Homo sapiens; identical to SEQ ID NO: 78780
  misc_feature 1..159: note = chr16:29169937-29170096
  misc_feature 1..159: note = Hypo
  source 1..159: mol_type = genomic DNA

SEQ ID NO: 111882 - DNA, 30 bp, Homo sapiens; identical to SEQ ID NO: 78781
  misc_feature 1..30: note = chr16:29179232-29179262
  misc_feature 1..30: note = Hypo
  source 1..30: mol_type = genomic DNA

SEQ ID NO: 111883 - DNA, 181 bp, Homo sapiens; identical to SEQ ID NO: 78782
  misc_feature 1..181: note = chr16:29187850-29188031
  misc_feature 1..181: note = Hypo
  source 1..181: mol_type = genomic DNA

SEQ ID NO: 111884 - DNA, 55 bp, Homo sapiens; identical to SEQ ID NO: 78783
  misc_feature 1..55: note = chr16:29191424-29191479
  misc_feature 1..55: note = Hypo
  source 1..55: mol_type = genomic DNA

SEQ ID NO: 111885 - DNA, 146 bp, Homo sapiens; identical to SEQ ID NO: 78784
  misc_feature 1..146: note = chr16:29230150-29230296
  misc_feature 1..146: note = Hypo
  source 1..146: mol_type = genomic DNA

SEQ ID NO: 111886 - DNA, 344 bp, Homo sapiens; identical to SEQ ID NO: 78785
  misc_feature 1..344: note = chr16:29244717-29245061
  misc_feature 1..344: note = Hypo
  source 1..344: mol_type = genomic DNA

SEQ ID NO: 111887 - DNA, 125 bp, Homo sapiens; identical to SEQ ID NO: 78786
  misc_feature 1..125: note = chr16:29248426-29248551
  misc_feature 1..125: note = Hypo
  source 1..125: mol_type = genomic DNA

SEQ ID NO: 111888 - DNA, 30 bp, Homo sapiens; identical to SEQ ID NO: 44659
  misc_feature 1..30: note = chr16:29262965-29262995
  misc_feature 1..30: note = Hypo
  source 1..30: mol_type = genomic DNA

SEQ ID NO: 111889 - DNA, 80 bp, Homo sapiens; identical to SEQ ID NO: 78788
  misc_feature 1..80: note = chr16:29266368-29266448
  misc_feature 1..80: note = Hypo
  source 1..80: mol_type = genomic DNA

SEQ ID NO: 111890 - DNA, 30 bp, Homo sapiens; identical to SEQ ID NO: 78789
  misc_feature 1..30: note = chr16:29324346-29324376
  misc_feature 1..30: note = Hypo
  source 1..30: mol_type = genomic DNA

SEQ ID NO: 111891 - DNA, 34 bp, Homo sapiens; identical to SEQ ID NO: 44661
  misc_feature 1..34: note = chr16:29324812-29324846
  misc_feature 1..34: note = Hypo
  source 1..34: mol_type = genomic DNA

SEQ ID NO: 111892 - DNA, 63 bp, Homo sapiens; identical to SEQ ID NO: 78791
  misc_feature 1..63: note = chr16:29353324-29353387
  misc_feature 1..63: note = Hypo
  source 1..63: mol_type = genomic DNA

SEQ ID NO: 111893 - DNA, 27 bp, Homo sapiens
  misc_feature 1..27: note = chr16:29660744-29660771
  misc_feature 1..27: note = Hypo
  source 1..27: mol_type = genomic DNA
ggcgtgagcgatcgcacccagcctctt

SEQ ID NO: 111894 - DNA, 37 bp, Homo sapiens; identical to SEQ ID NO: 78793
  misc_feature 1..37: note = chr16:29682566-29682603
  misc_feature 1..37: note = Hypo
  source 1..37: mol_type = genomic DNA

SEQ ID NO: 111895 - DNA, 73 bp, Homo sapiens; identical to SEQ ID NO: 44662
  misc_feature 1..73: note = chr16:29691644-29691717
  misc_feature 1..73: note = Hypo
  source 1..73: mol_type = genomic DNA

SEQ ID NO: 111896 - DNA, 30 bp, Homo sapiens; identical to SEQ ID NO: 78795
  misc_feature 1..30: note = chr16:29703508-29703538
  misc_feature 1..30: note = Hypo
  source 1..30: mol_type = genomic DNA

SEQ ID NO: 111897 - DNA, 30 bp, Homo sapiens; identical to SEQ ID NO: 78796
  misc_feature 1..30: note = chr16:29711222-29711252
  misc_feature 1..30: note = Hypo
  source 1..30: mol_type = genomic DNA

SEQ ID NO: 111898 - DNA, 252 bp, Homo sapiens; identical to SEQ ID NO: 78798
  misc_feature 1..252: note = chr16:29830871-29831123
  misc_feature 1..252: note = Hypo
  source 1..252: mol_type = genomic DNA

SEQ ID NO: 111899 - DNA, 35 bp, Homo sapiens; identical to SEQ ID NO: 78799
  misc_feature 1..35: note = chr16:29884723-29884758
  misc_feature 1..35: note = Hypo
  source 1..35: mol_type = genomic DNA

SEQ ID NO: 111900 - DNA, 145 bp, Homo sapiens
  misc_feature 1..145: note = chr16:29888121-29888266
  misc_feature 1..145: note = Hyper
  source 1..145: mol_type = genomic DNA
ggcaagtgagaatgtcggagcctagcagctcgtagccaggctcgcactggtaggtgagcaccgtgccccggatcaggtccccgtgggatgccgttctccagccccactccggaggtggcagctcggggcacgtgtcgttcctcgg

SEQ ID NO: 111901 - DNA, 148 bp, Homo sapiens; identical to SEQ ID NO: 78800
  misc_feature 1..148: note = chr16:29888624-29888772
  misc_feature 1..148: note = Hyper
  source 1..148: mol_type = genomic DNA

SEQ ID NO: 111902 - DNA, 30 bp, Homo sapiens; identical to SEQ ID NO: 78801
  misc_feature 1..30: note = chr16:29913174-29913204
  misc_feature 1..30: note = Hypo
  source 1..30: mol_type = genomic DNA

SEQ ID NO: 111903 - DNA, 141 bp, Homo sapiens; identical to SEQ ID NO: 78802
  misc_feature 1..141: note = chr16:29936349-29936490
  misc_feature 1..141: note = Hypo
  source 1..141: mol_type = genomic DNA

SEQ ID NO: 111904 - DNA, 35 bp, Homo sapiens; identical to SEQ ID NO: 78803
  misc_feature 1..35: note = chr16:29972439-29972474
  misc_feature 1..35: note = Hypo
  source 1..35: mol_type = genomic DNA

SEQ ID NO: 111905 - DNA, 112 bp, Homo sapiens; identical to SEQ ID NO: 78805
  misc_feature 1..112: note = chr16:30015457-30015569
  misc_feature 1..112: note = Hypo
  source 1..112: mol_type = genomic DNA

SEQ ID NO: 111906 - DNA, 630 bp, Homo sapiens; identical to SEQ ID NO: 78806
  misc_feature 1..630: note = chr16:30017228-30017858
  misc_feature 1..630: note = Hypo
  source 1..630: mol_type = genomic DNA

SEQ ID NO: 111907 - DNA, 44 bp, Homo sapiens; identical to SEQ ID NO: 78807
  misc_feature 1..44: note = chr16:30018478-30018522
  misc_feature 1..44: note = Hypo
  source 1..44: mol_type = genomic DNA

SEQ ID NO: 111908 - DNA, 38 bp, Homo sapiens; identical to SEQ ID NO: 78808
  misc_feature 1..38: note = chr16:30020315-30020353
  misc_feature 1..38: note = Hypo
  source 1..38: mol_type = genomic DNA

SEQ ID NO: 111909 - DNA, 114 bp, Homo sapiens; identical to SEQ ID NO: 78810
  misc_feature 1..114: note = chr16:30022990-30023104
  misc_feature 1..114: note = Hyper
  source 1..114: mol_type = genomic DNA

SEQ ID NO: 111910 - DNA, 38 bp, Homo sapiens; identical to SEQ ID NO: 78811
  misc_feature 1..38: note = chr16:30032589-30032627
  misc_feature 1..38: note = Hyper
  source 1..38: mol_type = genomic DNA

SEQ ID NO: 111911 - DNA, 129 bp, Homo sapiens; identical to SEQ ID NO: 78812
  misc_feature 1..129: note = chr16:30042292-30042421
  misc_feature 1..129: note = Hyper
  source 1..129: mol_type = genomic DNA

SEQ ID NO: 111912 - DNA, 26 bp, Homo sapiens
  misc_feature 1..26: note = chr16:30065618-30065644
  misc_feature 1..26: note = Hypo
  source 1..26: mol_type = genomic DNA
cagtgatactccgtctcaataagaat

SEQ ID NO: 111913 - DNA, 30 bp, Homo sapiens; identical to SEQ ID NO: 78814
  misc_feature 1..30: note = chr16:30085375-30085405
  misc_feature 1..30: note = Hypo
  source 1..30: mol_type = genomic DNA

SEQ ID NO: 111914 - DNA, 107 bp, Homo sapiens; identical to SEQ ID NO: 78815
  misc_feature 1..107: note = chr16:30100357-30100464
  misc_feature 1..107: note = Hypo
  source 1..107: mol_type = genomic DNA

SEQ ID NO: 111915 - DNA, 30 bp, Homo sapiens; identical to SEQ ID NO: 78816
  misc_feature 1..30: note = chr16:30103941-30103971
  misc_feature 1..30: note = Hyper
  source 1..30: mol_type = genomic DNA

SEQ ID NO: 111916 - DNA, 196 bp, Homo sapiens; identical to SEQ ID NO: 78817
  misc_feature 1..196: note = chr16:30116119-30116315
  misc_feature 1..196: note = Hypo
  source 1..196: mol_type = genomic DNA

SEQ ID NO: 111917 - DNA, 34 bp, Homo sapiens; identical to SEQ ID NO: 78818
  misc_feature 1..34: note = chr16:30124080-30124114
  misc_feature 1..34: note = Hypo
  source 1..34: mol_type = genomic DNA

SEQ ID NO: 111918 - DNA, 364 bp, Homo sapiens; identical to SEQ ID NO: 78819
  misc_feature 1..364: note = chr16:30124497-30124861
  misc_feature 1..364: note = Hypo
  source 1..364: mol_type = genomic DNA

SEQ ID NO: 111919 - DNA, 23 bp, Homo sapiens
  misc_feature 1..23: note = chr16:30135083-30135106
  misc_feature 1..23: note = Hypo
  source 1..23: mol_type = genomic DNA
agggtctctctctgtcgtccagg

SEQ ID NO: 111920 - DNA, 30 bp, Homo sapiens; identical to SEQ ID NO: 44667
  misc_feature 1..30: note = chr16:30354712-30354742
  misc_feature 1..30: note = Hypo
  source 1..30: mol_type = genomic DNA

SEQ ID NO: 111921 - DNA, 181 bp, Homo sapiens; identical to SEQ ID NO: 78826
  misc_feature 1..181: note = chr16:30365186-30365367
  misc_feature 1..181: note = Hypo
  source 1..181: mol_type = genomic DNA

SEQ ID NO: 111922 - DNA, 20 bp, Homo sapiens
  misc_feature 1..20: note = chr16:30401737-30401757
  misc_feature 1..20: note = Hypo
  source 1..20: mol_type = genomic DNA
ttattttttttgagtcggag

SEQ ID NO: 111923 - DNA, 153 bp, Homo sapiens; identical to SEQ ID NO: 78828
  misc_feature 1..153: note = chr16:30430020-30430173
  misc_feature 1..153: note = Hypo
  source 1..153: mol_type = genomic DNA

SEQ ID NO: 111924 - DNA, 19 bp, Homo sapiens
  misc_feature 1..19: note = chr16:30541444-30541463
  misc_feature 1..19: note = Hypo
  source 1..19: mol_type = genomic DNA
cggccgagaatagctacat

SEQ ID NO: 111925 - DNA, 63 bp, Homo sapiens; identical to SEQ ID NO: 78830
  misc_feature 1..63: note = chr16:30567446-30567509
  misc_feature 1..63: note = Hypo
  source 1..63: mol_type = genomic DNA

SEQ ID NO: 111926 - DNA, 34 bp, Homo sapiens; identical to SEQ ID NO: 78831
  misc_feature 1..34: note = chr16:30573625-30573659
  misc_feature 1..34: note = Hypo
  source 1..34: mol_type = genomic DNA

SEQ ID NO: 111927 - DNA, 31 bp, Homo sapiens; identical to SEQ ID NO: 78832
  misc_feature 1..31: note = chr16:30584531-30584562
  misc_feature 1..31: note = Hypo
  source 1..31: mol_type = genomic DNA

SEQ ID NO: 111928 - DNA, 47 bp, Homo sapiens; identical to SEQ ID NO: 78833
  misc_feature 1..47: note = chr16:30644928-30644975
  misc_feature 1..47: note = Hypo
  source 1..47: mol_type = genomic DNA

SEQ ID NO: 111929 - DNA, 69 bp, Homo sapiens; identical to SEQ ID NO: 78835
  misc_feature 1..69: note = chr16:30761038-30761107
  misc_feature 1..69: note = Hypo
  source 1..69: mol_type = genomic DNA

SEQ ID NO: 111930 - DNA, 48 bp, Homo sapiens; identical to SEQ ID NO: 78837
  misc_feature 1..48: note = chr16:30790427-30790475
  misc_feature 1..48: note = Hypo
  source 1..48: mol_type = genomic DNA

SEQ ID NO: 111931 - DNA, 104 bp, Homo sapiens; identical to SEQ ID NO: 78838
  misc_feature 1..104: note = chr16:30803850-30803954
  misc_feature 1..104: note = Hypo
  source 1..104: mol_type = genomic DNA

SEQ ID NO: 111932 - DNA, 26 bp, Homo sapiens
  misc_feature 1..26: note = chr16:30804455-30804481
  misc_feature 1..26: note = Hypo
  source 1..26: mol_type = genomic DNA
tgcggacttcccgattaaaaagcact

SEQ ID NO: 111933 - DNA, 34 bp, Homo sapiens; identical to SEQ ID NO: 78840
  misc_feature 1..34: note = chr16:30817004-30817038
  misc_feature 1..34: note = Hyper
  source 1..34: mol_type = genomic DNA

SEQ ID NO: 111934 - DNA, 145 bp, Homo sapiens; identical to SEQ ID NO: 78841
  misc_feature 1..145: note = chr16:30826330-30826475
  misc_feature 1..145: note = Hypo
  source 1..145: mol_type = genomic DNA

SEQ ID NO: 111935 - DNA, 30 bp, Homo sapiens; identical to SEQ ID NO: 78842
  misc_feature 1..30: note = chr16:30832615-30832645
  misc_feature 1..30: note = Hypo
  source 1..30: mol_type = genomic DNA

SEQ ID NO: 111936 - DNA, 30 bp, Homo sapiens; identical to SEQ ID NO: 78843
  misc_feature 1..30: note = chr16:30832846-30832876
  misc_feature 1..30: note = Hypo
  source 1..30: mol_type = genomic DNA

SEQ ID NO: 111937 - DNA, 30 bp, Homo sapiens; identical to SEQ ID NO: 78844
  misc_feature 1..30: note = chr16:30833324-30833354
  misc_feature 1..30: note = Hypo
  source 1..30: mol_type = genomic DNA

SEQ ID NO: 111938 - DNA, 76 bp, Homo sapiens; identical to SEQ ID NO: 44672
  misc_feature 1..76: note = chr16:30906986-30907062
  misc_feature 1..76: note = Hypo
  source 1..76: mol_type = genomic DNA

SEQ ID NO: 111939 - DNA, 196 bp, Homo sapiens; identical to SEQ ID NO: 44673
  misc_feature 1..196: note = chr16:30907122-30907318
  misc_feature 1..196: note = Hypo
  source 1..196: mol_type = genomic DNA

SEQ ID NO: 111940 - DNA, 30 bp, Homo sapiens; identical to SEQ ID NO: 78849
  misc_feature 1..30: note = chr16:30979173-30979203
  misc_feature 1..30: note = Hypo
  source 1..30: mol_type = genomic DNA

SEQ ID NO: 111941 - DNA, 30 bp, Homo sapiens; identical to SEQ ID NO: 78850
  misc_feature 1..30: note = chr16:31001301-31001331
  misc_feature 1..30: note = Hypo
  source 1..30: mol_type = genomic DNA

SEQ ID NO: 111942 - DNA, 30 bp, Homo sapiens; identical to SEQ ID NO: 44674
  misc_feature 1..30: note = chr16:31018076-31018106
  misc_feature 1..30: note = Hypo
  source 1..30: mol_type = genomic DNA

SEQ ID NO: 111943 - DNA, 30 bp, Homo sapiens; identical to SEQ ID NO: 36119
  misc_feature 1..30: note = chr16:31022167-31022197
  misc_feature 1..30: note = Hyper
  source 1..30: mol_type = genomic DNA

SEQ ID NO: 111944 - DNA, 198 bp, Homo sapiens; identical to SEQ ID NO: 78853
  misc_feature 1..198: note = chr16:31138607-31138805
  misc_feature 1..198: note = Hypo
  source 1..198: mol_type = genomic DNA

SEQ ID NO: 111945 - DNA, 39 bp, Homo sapiens; identical to SEQ ID NO: 44676
  misc_feature 1..39: note = chr16:31149942-31149981
  misc_feature 1..39: note = Hypo
  source 1..39: mol_type = genomic DNA

SEQ ID NO: 111946 - DNA, 81 bp, Homo sapiens; identical to SEQ ID NO: 78855
  misc_feature 1..81: note = chr16:31173147-31173228
  misc_feature 1..81: note = Hypo
  source 1..81: mol_type = genomic DNA

SEQ ID NO: 111947 - DNA, 196 bp, Homo sapiens; identical to SEQ ID NO: 78856
  misc_feature 1..196: note = chr16:31213944-31214140
  misc_feature 1..196: note = Hyper
  source 1..196: mol_type = genomic DNA

SEQ ID NO: 111948 - DNA, 138 bp, Homo sapiens; identical to SEQ ID NO: 36120
  misc_feature 1..138: note = chr16:31226609-31226747
  misc_feature 1..138: note = Hyper
  source 1..138: mol_type = genomic DNA

SEQ ID NO: 111949 - DNA, 68 bp, Homo sapiens; identical to SEQ ID NO: 78858
  misc_feature 1..68: note = chr16:31227017-31227085
  misc_feature 1..68: note = Hyper
  source 1..68: mol_type = genomic DNA

SEQ ID NO: 111950 - DNA, 43 bp, Homo sapiens; identical to SEQ ID NO: 78859
  misc_feature 1..43: note = chr16:31227355-31227398
  misc_feature 1..43: note = Hyper
  source 1..43: mol_type = genomic DNA

SEQ ID NO: 111951 - DNA, 543 bp, Homo sapiens
  misc_feature 1..543: note = chr16:31227770-31228313
  misc_feature 1..543: note = Hyper
  source 1..543: mol_type = genomic DNA
aaaaaaacccaacctcgcccaaccttgcccgtctttatctgcgaagaaagcacagaacccatgaaacggaacagggcccaggcagcccaggagcctggaagggggcagtggggcgagatgcagcccaccagggttcgcggcagcccagcccttcgcccccgggaggggctggccggaggtctgagggaggaccccaggagggaccctgaaggaggggaacaggaaggctctgggcgggacctgacgcgtgggtccttggcgaggaagcggggttgggtcccgagatcacgtaccagctcagagtggccctcacgcagcccgctgcagccgtgcggcctcctccaacatgcgcatgtcgcgcagcacggccacgacgagctcggctgcgtagtcctcgtagtaggaggcgaccagcttgtcggtgaggtccacgatatctagctgcccgagcgcgccccgcgggatgcgctcaaagccctcgcgcagcggcaccgtccccagcttcatcttgaacttcttgagctcctccggtgtcaggttctc

SEQ ID NO: 111952 - DNA, 152 bp, Homo sapiens; identical to SEQ ID NO: 78862
  misc_feature 1..152: note = chr16:31373926-31374078
  misc_feature 1..152: note = Hypo
  source 1..152: mol_type = genomic DNA

SEQ ID NO: 111953 - DNA, 40 bp, Homo sapiens; identical to SEQ ID NO: 78863
  misc_feature 1..40: note = chr16:31384803-31384843
  misc_feature 1..40: note = Hypo
  source 1..40: mol_type = genomic DNA

SEQ ID NO: 111954 - DNA, 65 bp, Homo sapiens; identical to SEQ ID NO: 78864
  misc_feature 1..65: note = chr16:31388356-31388421
  misc_feature 1..65: note = Hypo
  source 1..65: mol_type = genomic DNA

SEQ ID NO: 111955 - DNA, 445 bp, Homo sapiens; identical to SEQ ID NO: 78868
  misc_feature 1..445: note = chr16:31446903-31447348
  misc_feature 1..445: note = Hypo
  source 1..445: mol_type = genomic DNA

SEQ ID NO: 111956 - DNA, 141 bp, Homo sapiens; identical to SEQ ID NO: 78869
  misc_feature 1..141: note = chr16:31483518-31483659
  misc_feature 1..141: note = Hyper
  source 1..141: mol_type = genomic DNA

SEQ ID NO: 111957 - DNA, 30 bp, Homo sapiens; identical to SEQ ID NO: 78870
  misc_feature 1..30: note = chr16:31496344-31496374
  misc_feature 1..30: note = Hypo
  source 1..30: mol_type = genomic DNA

SEQ ID NO: 111958 - DNA, 42 bp, Homo sapiens; identical to SEQ ID NO: 78871
  misc_feature 1..42: note = chr16:31498048-31498090
  misc_feature 1..42: note = Hypo
  source 1..42: mol_type = genomic DNA

SEQ ID NO: 111959 - DNA, 261 bp, Homo sapiens; identical to SEQ ID NO: 78872
  misc_feature 1..261: note = chr16:31498557-31498818
  misc_feature 1..261: note = Hyper
  source 1..261: mol_type = genomic DNA

SEQ ID NO: 111960 - DNA, 182 bp, Homo sapiens; identical to SEQ ID NO: 78873
  misc_feature 1..182: note = chr16:31499022-31499204
  misc_feature 1..182: note = Hyper
  source 1..182: mol_type = genomic DNA

SEQ ID NO: 111961 - DNA, 413 bp, Homo sapiens; identical to SEQ ID NO: 78874
  misc_feature 1..413: note = chr16:31499494-31499907
  misc_feature 1..413: note = Hyper
  source 1..413: mol_type = genomic DNA

SEQ ID NO: 111962 - DNA, 151 bp, Homo sapiens; identical to SEQ ID NO: 78875
  misc_feature 1..151: note = chr16:31500522-31500673
  misc_feature 1..151: note = Hypo
  source 1..151: mol_type = genomic DNA

SEQ ID NO: 111963 - DNA, 41 bp, Homo sapiens; identical to SEQ ID NO: 78877
  misc_feature 1..41: note = chr16:31524056-31524097
  misc_feature 1..41: note = Hypo
  source 1..41: mol_type = genomic DNA

SEQ ID NO: 111964 - DNA, 40 bp, Homo sapiens; identical to SEQ ID NO: 78878
  misc_feature 1..40: note = chr16:31526376-31526416
  misc_feature 1..40: note = Hypo
  source 1..40: mol_type = genomic DNA

SEQ ID NO: 111965 - DNA, 249 bp, Homo sapiens; identical to SEQ ID NO: 36126
  misc_feature 1..249: note = chr16:31540812-31541061
  misc_feature 1..249: note = Hyper
  source 1..249: mol_type = genomic DNA

SEQ ID NO: 111966 - DNA, 30 bp, Homo sapiens
  misc_feature 1..30: note = chr16:31549080-31549110
  misc_feature 1..30: note = Hyper
  source 1..30: mol_type = genomic DNA
ccgctcctccattgccgcccagcggggatc

SEQ ID NO: 111967 - DNA, 30 bp, Homo sapiens; identical to SEQ ID NO: 78881
  misc_feature 1..30: note = chr16:31558059-31558089
  misc_feature 1..30: note = Hypo
  source 1..30: mol_type = genomic DNA

SEQ ID NO: 111968 - DNA, 30 bp, Homo sapiens; identical to SEQ ID NO: 78882
  misc_feature 1..30: note = chr16:31560507-31560537
  misc_feature 1..30: note = Hypo
  source 1..30: mol_type = genomic DNA

SEQ ID NO: 111969 - DNA, 556 bp, Homo sapiens
  misc_feature 1..556: note = chr16:31580480-31581036
  misc_feature 1..556: note = Hyper
  source 1..556: mol_type = genomic DNA
tctttggtgtcatttcgatttataaatccatatccatttctgacgttgaaccatttgacagtgccaaggactttggtggcgagaacttttttctccgcgtcttcgctgtcggcggcggtggctaaagaggcggcggccgcggtgcccgtggctgcgggggccccgtccccacccgggtttcctgcgacgagggcggcgggcgccggggccgcggcttggggtgcaccgctgcccacccggctcttggtcgcggggtcctggggagccgcggcggccgccaccgcaggagcctgctggagggtggtggtgatgatggtggcctcgcccgcctcgctcatgcctcctcctcctctgctctcgctcatgcgcctcggtggcggttggtcggcggttagtgcggctggtggtcgccgcggccggggctcgctctcggggaggccggggctgatctcgcggcgcaggcggcggcggcagaggtggggtcgcgcagcggaggcagctcgagcttcgggatgcgcgctcgcttcttgggctcctcgctcgatcttactgcccc

SEQ ID NO: 111970 - DNA, 21 bp, Homo sapiens
  misc_feature 1..21: note = chr16:31658246-31658267
  misc_feature 1..21: note = Hypo
  source 1..21: mol_type = genomic DNA
aatggaaggactgggcgcggt

SEQ ID NO: 111971 - DNA, 150 bp, Homo sapiens; identical to SEQ ID NO: 78893
  misc_feature 1..150: note = chr16:32127040-32127190
  misc_feature 1..150: note = Hyper
  source 1..150: mol_type = genomic DNA

SEQ ID NO: 111972 - DNA, 179 bp, Homo sapiens; identical to SEQ ID NO: 78912
  misc_feature 1..179: note = chr16:32485443-32485622
  misc_feature 1..179: note = Hypo
  source 1..179: mol_type = genomic DNA

SEQ ID NO: 111973 - DNA, 20 bp, Homo sapiens
  misc_feature 1..20: note = chr16:33396766-33396786
  misc_feature 1..20: note = Hypo
  source 1..20: mol_type = genomic DNA
tatgagatggattttcgccc

SEQ ID NO: 111974 - DNA, 30 bp, Homo sapiens; identical to SEQ ID NO: 78922
  misc_feature 1..30: note = chr16:33619032-33619062
  misc_feature 1..30: note = Hypo
  source 1..30: mol_type = genomic DNA

SEQ ID NO: 111975 - DNA, 30 bp, Homo sapiens; identical to SEQ ID NO: 78924
  misc_feature 1..30: note = chr16:33784579-33784609
  misc_feature 1..30: note = Hypo
  source 1..30: mol_type = genomic DNA

SEQ ID NO: 111976 - DNA, 120 bp, Homo sapiens; identical to SEQ ID NO: 78925
  misc_feature 1..120: note = chr16:33893476-33893596
  misc_feature 1..120: note = Hypo
  source 1..120: mol_type = genomic DNA

SEQ ID NO: 111977 - DNA, 97 bp, Homo sapiens; identical to SEQ ID NO: 78926
  misc_feature 1..97: note = chr16:33897828-33897925
  misc_feature 1..97: note = Hypo
  source 1..97: mol_type = genomic DNA

SEQ ID NO: 111978 - DNA, 162 bp, Homo sapiens; identical to SEQ ID NO: 78927
  misc_feature 1..162: note = chr16:34264932-34265094
  misc_feature 1..162: note = Hypo
  source 1..162: mol_type = genomic DNA

SEQ ID NO: 111979 - DNA, 83 bp, Homo sapiens; identical to SEQ ID NO: 78928
  misc_feature 1..83: note = chr16:34407744-34407827
  misc_feature 1..83: note = Hypo
  source 1..83: mol_type = genomic DNA

SEQ ID NO: 111980 - DNA, 30 bp, Homo sapiens; identical to SEQ ID NO: 78929
  misc_feature 1..30: note = chr16:34788530-34788560
  misc_feature 1..30: note = Hypo
  source 1..30: mol_type = genomic DNA

SEQ ID NO: 111981 - DNA, 213 bp, Homo sapiens; identical to SEQ ID NO: 78931
  misc_feature 1..213: note = chr16:34983934-34984147
  misc_feature 1..213: note = Hypo
  source 1..213: mol_type = genomic DNA

SEQ ID NO: 111982 - DNA, 116 bp, Homo sapiens; identical to SEQ ID NO: 78974
  misc_feature 1..116: note = chr16:46721647-46721763
  misc_feature 1..116: note = Hypo
  source 1..116: mol_type = genomic DNA

SEQ ID NO: 111983 - DNA, 30 bp, Homo sapiens; identical to SEQ ID NO: 78975
  misc_feature 1..30: note = chr16:46763064-46763094
  misc_feature 1..30: note = Hypo
  source 1..30: mol_type = genomic DNA

SEQ ID NO: 111984 - DNA, 30 bp, Homo sapiens; identical to SEQ ID NO: 78976
  misc_feature 1..30: note = chr16:46785401-46785431
  misc_feature 1..30: note = Hypo
  source 1..30: mol_type = genomic DNA

SEQ ID NO: 111985 - DNA, 44 bp, Homo sapiens; identical to SEQ ID NO: 78977
  misc_feature 1..44: note = chr16:46803052-46803096
  misc_feature 1..44: note = Hypo
  source 1..44: mol_type = genomic DNA

SEQ ID NO: 111986 - DNA, 85 bp, Homo sapiens; identical to SEQ ID NO: 78979
  misc_feature 1..85: note = chr16:47053768-47053853
  misc_feature 1..85: note = Hypo
  source 1..85: mol_type = genomic DNA

SEQ ID NO: 111987 - DNA, 987 bp, Homo sapiens; identical to SEQ ID NO: 78980
  misc_feature 1..987: note = chr16:47176772-47177759
  misc_feature 1..987: note = Hyper
  source 1..987: mol_type = genomic DNA

SEQ ID NO: 111988 - DNA, 626 bp, Homo sapiens; identical to SEQ ID NO: 78981
  misc_feature 1..626: note = chr16:47177819-47178445
  misc_feature 1..626: note = Hyper
  source 1..626: mol_type = genomic DNA

SEQ ID NO: 111989 - DNA, 120 bp, Homo sapiens; identical to SEQ ID NO: 78988
  misc_feature 1..120: note = chr16:48642018-48642138
  misc_feature 1..120: note = Hypo
  source 1..120: mol_type = genomic DNA

SEQ ID NO: 111990 - DNA, 96 bp, Homo sapiens; identical to SEQ ID NO: 78989
  misc_feature 1..96: note = chr16:48644969-48645065
  misc_feature 1..96: note = Hypo
  source 1..96: mol_type = genomic DNA

SEQ ID NO: 111991 - DNA, 656 bp, Homo sapiens
  misc_feature 1..656: note = chr16:48844517-48845173
  misc_feature 1..656: note = Hyper
  source 1..656: mol_type = genomic DNA
ggggggtgggggctgcgctgcctcctctcctctgcgctcacctgggcggcggacagggtcgagtgccctaaagtccccctggcacgcccgggtgcgcgtccctcctcgacgccctgcgcccacccaggcccgggggcacgaggcggcctccagcttccccgcgggtccggggcgggcacagcgggtcgggggcggcctggctgggctggcagagcacgtctcggcggcaaaagaggcgccgggcatgctctcggatgaacttggcagatttagacactcagccctaattgcggcgagctcgggccgctgcacccgcgcggggcagatgtgcctcggcgctgcccggcccaattgctcccatttatcccggcctcgcccgcccagttgggagcgcgcggccggctcgggccgccaggaaaagcctctgccatcaatcagaggcggcggggcggccgcgatcgatggcggcccccgcactgaggcccccgcctcccgatcaatcggccgcctgccgtgttccaccgcggcctgcggacgccgcgctgggagagacgggtcgatgcgtctcggggcgccggggcacgcggggacggcggccttcgcggggctctgccctcaccctggcatcgtcctgccgggcccgggtgatgctggcc

SEQ ID NO: 111992 - DNA, 487 bp, Homo sapiens; identical to SEQ ID NO: 78994
  misc_feature 1..487: note = chr16:49309010-49309497
  misc_feature 1..487: note = Hyper
  source 1..487: mol_type = genomic DNA

SEQ ID NO: 111993 - DNA, 1514 bp, Homo sapiens
  misc_feature 1..1514: note = chr16:49311063-49312577
  misc_feature 1..1514: note = Hyper
  source 1..1514: mol_type = genomic DNA
cagggagcgccaaagcgtacaggggcagcttccttgagcggtggctctccaaccttcgcggccctacagcctcaagcttacacgcaccctactgactatagggtctccacaagcccggagggctggccctgcaacggcagagctgctgggtggagctagtttcgctgccaaaggctccaactgtctccgacctctccttcccaaccaggagacttcggagaaagcgcgtctctttattaaaagcagtttttctttaaatccctttaaggccccttatttcttctcattcacacttccctggggcctaacagagtagaagggaaactgttgggcagaaacagaaaagtactcgggtccactcctcactcgcgaagtccctatctatctctgtgggtcccggaggcacagggctgcaagggcgcccgctagagctgctccacggcttaccggattgcatgcggagaagaaacgggcccgggtttcaacagaggccccgtgctccgtgaatttctaactcgaaccagccgctgggataaatccgagaaacgttgtttattgtgctattattaactttcccttctccccacgcccctagaggaaataaaattcattcctgaatattgggccaggaaaacgtttctctgaaaggaaccacaactgcaggggaccacccggctgcagctcccagctcccggcccttcgccctaggctgcccactcgctccggctcccgacctccccgctgccgaagcaactgggtcagcctttcagacttaaaacgaagtcgtttatttcatttttgctttcacattatgttccgatacaatcaaaactcctggacgaacctcttgaataaagtcctgtgaatgagcggaatcataggtcctgggcgcccgagtatgcggcgggtggactccggattcagaggcggtgtataaaacatacgctgcttcgggaactgcgagggggacgcggtgggagacatccggggacagaaggcctgaggagtctgccgctccaggcagggtcgtttgggtcctcaaactgggactattcctgatgcatttggaatgcaaagaaaaaaatcaaacttcgctcctgggccggcggccgcgcctggcctagcaagatttcggccacatttcttacgtttccgccaaagctgtgaacacaggcgaatgcagtgctggtccccggcctggcgcaggaaggagcgcaaggccggctttgcaaggaagccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagctccttggcgtttcgtggagtcacagagcacgacggcattgacaagca

SEQ ID NO: 111994 - DNA, 3557 bp, Homo sapiens
  misc_feature 1..3557: note = chr16:49313154-49316711
  misc_feature 1..3557: note = Hyper
  source 1..3557: mol_type = genomic DNA
ttgtcccacagctggcgcgcacctttttacccagatacagttagagaacatgtaggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccccccatcaagtttccccgctccagcttgaggtatgctcggtcgcctttctccatttggattaggactccgttgctggcggcctcccgggtcacgtcctggtcaccagcgaaggctgaaatcaccggccacccgtttagcatgaggctcacctgagaaagagaaaggcccgcttcagaggcgcaacctaggcaggcaccgaagccgcggtggagcgaacctcctccttgcttggctaacagcctgtaaggcctggaagcacggagaggtggggggtggggggggcgaatggaggaaaaggggctttgcagcttactgctgaggctccagtggggcgaaagaccacacatctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatttgtgattagaagtctcgcaccgagcggcacaatgtatttcctccccaaaccacgggctcaattccctcccccatccagccgcgcccgccaccgcctggttttgcccctgtggtggcaccgtcagccaagggcctcgcgccctctccccagctgtgcgtcccacctctctcggcgcccaagggaaacctggacatctttggggacccggagagccggcgagtgattgctgggacacggctggagccgggagagagtagcactacgccccctccctccctcctctctctacccctcaccctccggggctaaatgctgctagctcaaaaacccacagtccgcacggggtggggattggggacaagtgggagaaaacgggggccccgtccgtggtgctgaagacaagcacgcaagccgcatcgcaggcttctgagccggggcaaggggtagggtgtactgtcgcggtgcttcctggggagtccgggaaggcttcccaagcggcagctgtctggggcgctaacaacagccgttacaaggaagtccctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgaggccagtaacccccctacggggccagggcccggcacgaggcgtcggctgacctgtatggtttgtctgttgtagacttttaccacgtggaagttaaaactgtagatccctttgcgcggggcgatgaaagtgctgcgttctgaatcaaagttgttcccaatgttcactagtacctataacgagacgggaacgaaggggagtgggcaggaatcggtcccggactgtcgtccccgcgcctccgcagagcccttggagaggaccgggcatcggtcttccatccatccctccttcaccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggcacttgccctccagcacgatgggctccgtctcattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcggccacctgaccccgggcgccgttgttattaggcgcggcgaggcgggtggcgcgcggcagcagggttgggctctcgccgtgagtcgacgaagggagcgcgggcgcgcgcccgcgtccgcgcactgagagtcgcctcggccgctcgctttctcgactcccgcctcgcgcctcgatcctgttccgcctccctcggccctcctgcccgcccccactcgtcggccctcaggtaggaggcggcgcgccccggggtcgggagtggaatcgctggaggctgcgagtcgcctgcccgcctgtgggcgcgcccgttgggaggggagcgccccccagcgggcgcgggcgcgagggcagccggcgcgctgggcgagcctggctcagggtcccggcggccggggtgcagggcgcgtgcgcgcgcggcggggcggggcctgcgcggctctggcgggcgcacgtggtgcccgggagctgctgggcgggcactcaccgcggggactcggtgcggagccggggcgccgagtgtctccgtgtccctctgccccagccggcggccgcgatggtggagcttggcctctcgctctctcccgcctctccagcgactgctctgccggccgcggaggtcggatcgagcggtcattcattcatttgttaattcgttcacttattcaggggagatcattgaacccctacggagtaccgggtactgggccgggcgctgaggacgcggggctgagcaaaagcagccgaggcccaccttcgtgccccttaaaacccagcgtgcggggcggcaacgagtactg

SEQ ID NO: 111995 - DNA, 182 bp, Homo sapiens; identical to SEQ ID NO: 79001
  misc_feature 1..182: note = chr16:49317053-49317235
  misc_feature 1..182: note = Hyper
  source 1..182: mol_type = genomic DNA

SEQ ID NO: 111996 - DNA, 48 bp, Homo sapiens; identical to SEQ ID NO: 79002
  misc_feature 1..48: note = chr16:49317700-49317748
  misc_feature 1..48: note = Hyper
  source 1..48: mol_type = genomic DNA

SEQ ID NO: 111997 - DNA, 30 bp, Homo sapiens; identical to SEQ ID NO: 79004
  misc_feature 1..30: note = chr16:49434635-49434665
  misc_feature 1..30: note = Hypo
  source 1..30: mol_type = genomic DNA

SEQ ID NO: 111998 - DNA, 30 bp, Homo sapiens; identical to SEQ ID NO: 79005
  misc_feature 1..30: note = chr16:49464835-49464865
  misc_feature 1..30: note = Hypo
  source 1..30: mol_type = genomic DNA

SEQ ID NO: 111999 - DNA, 30 bp, Homo sapiens; identical to SEQ ID NO: 44691
  misc_feature 1..30: note = chr16:49500178-49500208
  misc_feature 1..30: note = Hypo
  source 1..30: mol_type = genomic DNA

SEQ ID NO: 112000 - DNA, 30 bp, Homo sapiens; identical to SEQ ID NO: 79007
  misc_feature 1..30: note = chr16:49508868-49508898
  misc_feature 1..30: note = Hypo
  source 1..30: mol_type = genomic DNA

SEQ ID NO: 112001 - DNA, 184 bp, Homo sapiens; identical to SEQ ID NO: 79008
  misc_feature 1..184: note = chr16:49532989-49533173
  misc_feature 1..184: note = Hypo
  source 1..184: mol_type = genomic DNA

SEQ ID NO: 112002 - DNA, 161 bp, Homo sapiens; identical to SEQ ID NO: 44693
  misc_feature 1..161: note = chr16:49545215-49545376
  misc_feature 1..161: note = Hypo
  source 1..161: mol_type = genomic DNA

SEQ ID NO: 112003 - DNA, 52 bp, Homo sapiens; identical to SEQ ID NO: 79010
  misc_feature 1..52: note = chr16:49577715-49577767
  misc_feature 1..52: note = Hypo
  source 1..52: mol_type = genomic DNA

SEQ ID NO: 112004 - DNA, 30 bp, Homo sapiens; identical to SEQ ID NO: 79011
  misc_feature 1..30: note = chr16:49593939-49593969
  misc_feature 1..30: note = Hypo
  source 1..30: mol_type = genomic DNA

SEQ ID NO: 112005 - DNA, 90 bp, Homo sapiens; identical to SEQ ID NO: 44694
  misc_feature 1..90: note = chr16:49623675-49623765
  misc_feature 1..90: note = Hypo
  source 1..90: mol_type = genomic DNA

SEQ ID NO: 112006 - DNA, 43 bp, Homo sapiens; identical to SEQ ID NO: 79013
  misc_feature 1..43: note = chr16:49634728-49634771
  misc_feature 1..43: note = Hypo
  source 1..43: mol_type = genomic DNA

SEQ ID NO: 112007 - DNA, 44 bp, Homo sapiens; identical to SEQ ID NO: 79014
  misc_feature 1..44: note = chr16:49638054-49638098
  misc_feature 1..44: note = Hypo
  source 1..44: mol_type = genomic DNA

SEQ ID NO: 112008 - DNA, 30 bp, Homo sapiens; identical to SEQ ID NO: 79015
  misc_feature 1..30: note = chr16:49671197-49671227
  misc_feature 1..30: note = Hypo
  source 1..30: mol_type = genomic DNA

SEQ ID NO: 112009 - DNA, 97 bp, Homo sapiens; identical to SEQ ID NO: 79016
  misc_feature 1..97: note = chr16:49671872-49671969
  misc_feature 1..97: note = Hypo
  source 1..97: mol_type = genomic DNA

SEQ ID NO: 112010 - DNA, 20 bp, Homo sapiens
  misc_feature 1..20: note = chr16:49736772-49736792
  misc_feature 1..20: note = Hypo
  source 1..20: mol_type = genomic DNA
tgtgtgctggaggagcgagt

SEQ ID NO: 112011 - DNA, 140 bp, Homo sapiens; identical to SEQ ID NO: 79018
  misc_feature 1..140: note = chr16:49736852-49736992
  misc_feature 1..140: note = Hypo
  source 1..140: mol_type = genomic DNA

SEQ ID NO: 112012 - DNA, 30 bp, Homo sapiens; identical to SEQ ID NO: 79019
  misc_feature 1..30: note = chr16:49893240-49893270
  misc_feature 1..30: note = Hyper
  source 1..30: mol_type = genomic DNA

SEQ ID NO: 112013 - DNA, 27 bp, Homo sapiens
  misc_feature 1..27: note = chr16:50070326-50070353
  misc_feature 1..27: note = Hypo
  source 1..27: mol_type = genomic DNA
ggcataagccaccgtgcctggcctctt

SEQ ID NO: 112014 - DNA, 17 bp, Homo sapiens
  misc_feature 1..17: note = chr16:50292023-50292040
  misc_feature 1..17: note = Hypo
  source 1..17: mol_type = genomic DNA
aacctccaagctactcg

SEQ ID NO: 112015 - DNA, 37 bp, Homo sapiens; identical to SEQ ID NO: 79024
  misc_feature 1..37: note = chr16:50292820-50292857
  misc_feature 1..37: note = Hypo
  source 1..37: mol_type = genomic DNA

SEQ ID NO: 112016 - DNA, 51 bp, Homo sapiens; identical to SEQ ID NO: 79025
  misc_feature 1..51: note = chr16:50335767-50335818
  misc_feature 1..51: note = Hypo
  source 1..51: mol_type = genomic DNA

SEQ ID NO: 112017 - DNA, 30 bp, Homo sapiens; identical to SEQ ID NO: 44700
  misc_feature 1..30: note = chr16:50336356-50336386
  misc_feature 1..30: note = Hypo
  source 1..30: mol_type = genomic DNA

SEQ ID NO: 112018 - DNA, 152 bp, Homo sapiens; identical to SEQ ID NO: 44701
  misc_feature 1..152: note = chr16:50336625-50336777
  misc_feature 1..152: note = Hypo
  source 1..152: mol_type = genomic DNA

SEQ ID NO: 112019 - DNA, 237 bp, Homo sapiens; identical to SEQ ID NO: 79029
  misc_feature 1..237: note = chr16:50501876-50502113
  misc_feature 1..237: note = Hyper
  source 1..237: mol_type = genomic DNA

SEQ ID NO: 112020 - DNA, 66 bp, Homo sapiens; identical to SEQ ID NO: 79031
  misc_feature 1..66: note = chr16:50581600-50581666
  misc_feature 1..66: note = Hyper
  source 1..66: mol_type = genomic DNA

SEQ ID NO: 112021 - DNA, 53 bp, Homo sapiens; identical to SEQ ID NO: 79032
  misc_feature 1..53: note = chr16:50667548-50667601
  misc_feature 1..53: note = Hypo
  source 1..53: mol_type = genomic DNA

SEQ ID NO: 112022 - DNA, 184 bp, Homo sapiens; identical to SEQ ID NO: 79033
  misc_feature 1..184: note = chr16:50699260-50699444
  misc_feature 1..184: note = Hyper
  source 1..184: mol_type = genomic DNA

SEQ ID NO: 112023 - DNA, 188 bp, Homo sapiens; identical to SEQ ID NO: 79034
  misc_feature 1..188: note = chr16:50753089-50753277
  misc_feature 1..188: note = Hypo
  source 1..188: mol_type = genomic DNA

SEQ ID NO: 112024 - DNA, 195 bp, Homo sapiens; identical to SEQ ID NO: 79035
  misc_feature 1..195: note = chr16:50753681-50753876
  misc_feature 1..195: note = Hypo
  source 1..195: mol_type = genomic DNA

SEQ ID NO: 112025 - DNA, 197 bp, Homo sapiens; identical to SEQ ID NO: 79038
  misc_feature 1..197: note = chr16:50958551-50958748
  misc_feature 1..197: note = Hypo
  source 1..197: mol_type = genomic DNA

SEQ ID NO: 112026 - DNA, 123 bp, Homo sapiens; identical to SEQ ID NO: 79044
  misc_feature 1..123: note = chr16:51167687-51167810
  misc_feature 1..123: note = Hyper
  source 1..123: mol_type = genomic DNA

SEQ ID NO: 112027 - DNA, 856 bp, Homo sapiens
  misc_feature 1..856: note = chr16:51183605-51184461
  misc_feature 1..856: note = Hyper
  source 1..856: mol_type = genomic DNA
aggattcccctttcccgacatcaggggtaaagggagcgggggtcccttcgcttcactgtgccccagctctaccgagaggcaggcctctgggaaacgagccggggacctgggggcccgggcggccgcagcttagtgggctgaggtgccgatcagggtcacgcttcggagctctgtcggggcccagctccctccttcacaccccaaaatgccgcctagggcgtgggcatcccgagtggcatccggagccgctgagaccccgccgagattgctccttgtgcgtcctcccacagccgagaggccagcatcgtgccgggacgacccggggacccgagtccgggcgccgctacaccgcctcgggcgctaggcctgggagctttgaggccggtaccgtgaaacacctttaggagcaaggagggattccaggtgtcctccctttgtaccccaactccctgcccggatctcttccactctctgccatagcccccacacacaaactttgttctggacttgttcagccccttcgggacccacagttgtcgcctccatcggagaaaacaagtgcccctgtttcaggggggattccactctggctggccacccgcaaacctggaaaactattctatgacttcttccctgacccccctggaagtagggagcaccacgatccgcagagggcgcataccgaccagaaagattttggggggcagagggtgcaagtgttgtgggaagagatgcggagataaattttgcgagccagaccccgacactttccccgtccgtttgcaccgtctccggaacaactggcggccagcagcactctccaccccggccgcaaccccagcgggtcaggcgctgg

SEQ ID NO: 112028 - DNA, 2873 bp, Homo sapiens
  misc_feature 1..2873: note = chr16:51184677-51187550
  misc_feature 1..2873: note = Hyper
  source 1..2873: mol_type = genomic DNA
gagcgctaggggccccgtgcggtcaggccggggcgacctccacccgcacccacgcctcatggggctcccgggtcttggccgcggctgggatccccggaaaagcagggacggagaagccaggccggcatgcccgccctccttcccccgggaggacccaacaactccggaaagatcctgccgggagatgtgctcgctttccccggggcagcgggggaaagcccagcaaaggcacattgaaaattaaaaagaaaaaaaaaattacgccgagtggaagaagcaatcggggccgcggcggcggtgaggtagggggcgcgggggccagccgcgtgtgagtgggtccgagtgtgcgtgagtgtgagtgcgtgtgtgtgtgtccacggcgcgggccggagcactcaccatctcgccgggggagcgaggccacttcggggtcggattggaaatgttgaggcttcgcttgcttcctccgcgacatgctggctcaaacatcagctggggcagaataaaaaattactaaaaaaaaatcttctcaaaattacggaaatcgagcggcggcggcggcggcggctccccccgcccgccggcccgcccgccccctccccggctccccggccccgggcgcagcgcgcatgtgtcctgctataattatgattatcaataatgcattgcgattaatcatagaggggctctttgaaaggcgattggcaccgggccagcgctattcaaacccgctcgccttaatcaattagttcgtgatttgctgcagacccctgtctctccgcgcgctggcccaataagccggccgcggggctggctctgcgcgccgcgccgcccgacactgggttaaccctctttgcgaccgcccgggactccgcggcccggccgccgggggccggcctcctctccactgcgggcccggcgccccggcaggcgccccccgctctctccctctcccctccctcttccctccctccttcgcccccccccacaatcccgggctgggccgacccaaattagcatgccctccccggaattgagccgccccgggtggggggtggggccgggcggcgagggctggggacccgggctgccggcgcgctgcgaacttcccaactcgggggcgaggcgcgccggcccgcggggggagggagtcccgcggcgggatcaggggggagggcgtcccgtttcgtgagtgtttcttcgtttctttaagagctaccagaaagcagcccacccccacccccattaaaaaaaaaaataagcgagtggggaagagccagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcgccgcagagccccgggcgggcggagagcggggaccggcctgggctccgagttcagctccggccggggggaggggaggggctgcggctcacactgagcgcagcagcgagcaccggcctagggagacacagcccgggcggacccggcactggactgggccagtccctgggacccctgggcaccccgccctggggagggggccgcgccccagccttccgggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactccggacctgtactgcgctccggtagaggacccttccctttctcttagcttcttaaatcttttcttttaaggtgtaaatgtgtgtgtgtgccgatgaatgtttctgtttttcatctgctgactttatttttttttattggtataacttctcccttctctctccctgctcgtccgttttccaccttttctcttacttatcttctgccctcgctcactccctaacacacacattcacaccctctccgcctcgctctcccgttctcgccaggtcctgatgggtacagtagattttgataaaaagacaaacgaagctatcagtggggctgatgttgaagaatgaagataataatgtttccataggtggtgcttcaaatgccattatttctcactgaatatttaaagagatccctcggcaaagatggatc

SEQ ID NO: 112029 - DNA, 191 bp, Homo sapiens
  misc_feature 1..191: note = chr16:51189183-51189374
  misc_feature 1..191: note = Hyper
  source 1..191: mol_type = genomic DNA
cccagctcaaggccccgctggcccccggccgaggctagaagggcagtagtggaggtttcgttttcttaagcaaggcaaaaagcggcgaaaaggcggcagcggcgccccgggggcgggggacgaggcacatcgatggtatcaacattattgatggggaaaagttcggggcaggagcccggagatcaggttcc

SEQ ID NO: 112030 - DNA, 329 bp, Homo sapiens
  misc_feature 1..329: note = chr16:51189922-51190251
  misc_feature 1..329: note = Hyper
  source 1..329: mol_type = genomic DNA
ttttgggggaactcccgccgcccgccaccaagggctatctccagacgggcgccgggtgcagcgccgtgaccgggcgccctggcgccggctcgggcgcgaaattcagcggtggcaagcggagggtgggcttggtaaccacccgcgcgcgcccgagccaagagtcgcgtactgtctgcccgcggcaaagttcgtctttctccgcttggagggctgttcctacaccggtattaagaaaccgacttcgctagcgactgcaagtgcttgcgattttgactttccgtccacagttgagcgtcttgcacttaaattcactgcgccccgcatgcaac

SEQ ID NO: 112031 - DNA, 309 bp, Homo sapiens; identical to SEQ ID NO: 79060
  misc_feature 1..309: note = chr16:52580711-52581020
  misc_feature 1..309: note = Hyper
  source 1..309: mol_type = genomic DNA

SEQ ID NO: 112032 - DNA, 174 bp, Homo sapiens
  misc_feature 1..174: note = chr16:52581360-52581534
  misc_feature 1..174: note = Hyper
  source 1..174: mol_type = genomic DNA
cggacgccagccctgcgtcccgtgtgtcccaccctcctcctgcgcgaccacagcttccccgggccccagcatccccaagccgtctgctcccttcctgtcgctttcctccccatgacccccttccttcttcatgggtgcctgtccccgggcccctctcctcgaccccgccttgcc

SEQ ID NO: 112033 - DNA, 80 bp, Homo sapiens; identical to SEQ ID NO: 79062
  misc_feature 1..80: note = chr16:53448471-53448551
  misc_feature 1..80: note = Hypo
  source 1..80: mol_type = genomic DNA

SEQ ID NO: 112034 - DNA, 200 bp, Homo sapiens; identical to SEQ ID NO: 44704
  misc_feature 1..200: note = chr16:53563454-53563654
  misc_feature 1..200: note = Hypo
  source 1..200: mol_type = genomic DNA

SEQ ID NO: 112035 - DNA, 94 bp, Homo sapiens; identical to SEQ ID NO: 79065
  misc_feature 1..94: note = chr16:54317132-54317226
  misc_feature 1..94: note = Hyper
  source 1..94: mol_type = genomic DNA

SEQ ID NO: 112036 - DNA, 30 bp, Homo sapiens; identical to SEQ ID NO: 79066
  misc_feature 1..30: note = chr16:54317821-54317851
  misc_feature 1..30: note = Hyper
  source 1..30: mol_type = genomic DNA

SEQ ID NO: 112037 - DNA, 245 bp, Homo sapiens
  misc_feature 1..245: note = chr16:54318505-54318750
  misc_feature 1..245: note = Hyper
  source 1..245: mol_type = genomic DNA
gcccagcagggagagcgggtgcaggcgggggccgggcggtgggcctggaaacggccggttggtccaagccgggaacttgcccagcggcgctgagaccagtctgtgagcggcggcggcggcggcggccggagagagctgcagggcggaaggcgcgaccgctgcccccggtggagacccccccgcgccgggaggcgagcggcgcgggttgtccgggcttgtggcagtctccgcgagggaccagatct

SEQ ID NO: 112038 - DNA, 98 bp, Homo sapiens; identical to SEQ ID NO: 79069
  misc_feature 1..98: note = chr16:54318955-54319053
  misc_feature 1..98: note = Hyper
  source 1..98: mol_type = genomic DNA

SEQ ID NO: 112039 - DNA, 295 bp, Homo sapiens; identical to SEQ ID NO: 79070
  misc_feature 1..295: note = chr16:54319354-54319649
  misc_feature 1..295: note = Hyper
  source 1..295: mol_type = genomic DNA

SEQ ID NO: 112040 - DNA, 341 bp, Homo sapiens; identical to SEQ ID NO: 79071
  misc_feature 1..341: note = chr16:54320739-54321080
  misc_feature 1..341: note = Hyper
  source 1..341: mol_type = genomic DNA

SEQ ID NO: 112041 - DNA, 548 bp, Homo sapiens
  misc_feature 1..548: note = chr16:54321286-54321834
  misc_feature 1..548: note = Hyper
  source 1..548: mol_type = genomic DNA
ccttactaaaaatggcgggctggctccgggggctgaagggtggcagcccgggggcactggaagggtagggagccgccacaaatcggtgaagcaggcccgcgccccaggcggctgggaatgggggaggagcagggcgccgggggacggaggccctaggaacttttggagagctcttcgagaagtttctgtattggcgtttttgtctgtggagaaccttccttgcgcgacccctaccccttctcccggtcccggcgctaacctcttttctctctgcaaggatcctcccaccgcctccggtggggatggaaagcaagagttttggtttaatgatgggatatttcctaaatcaaacttgaaatctcaggatcgggcgcccaccttcacggattagggcgtgcagtcgatagcggcattgaaattcccagcattgccgcggctgggggctcagagctttaggccgcggcggcgacccacaagccggccaggcctgcagtgggcacgccccggagacaaaacgggggtggtgactctgccgtggagtggccagc

SEQ ID NO: 112042 - DNA, 53 bp, Homo sapiens; identical to SEQ ID NO: 79073
  misc_feature 1..53: note = chr16:54322754-54322807
  misc_feature 1..53: note = Hyper
  source 1..53: mol_type = genomic DNA

SEQ ID NO: 112043 - DNA, 33 bp, Homo sapiens; identical to SEQ ID NO: 36160
  misc_feature 1..33: note = chr16:54325062-54325095
  misc_feature 1..33: note = Hyper
  source 1..33: mol_type = genomic DNA

SEQ ID NO: 112044 - DNA, 342 bp, Homo sapiens; identical to SEQ ID NO: 79076
  misc_feature 1..342: note = chr16:54628674-54629016
  misc_feature 1..342: note = Hyper
  source 1..342: mol_type = genomic DNA

SEQ ID NO: 112045 - DNA, 285 bp, Homo sapiens; identical to SEQ ID NO: 79077
  misc_feature 1..285: note = chr16:54962651-54962936
  misc_feature 1..285: note = Hyper
  source 1..285: mol_type = genomic DNA

SEQ ID NO: 112046 - DNA, 446 bp, Homo sapiens; identical to SEQ ID NO: 79078
  misc_feature 1..446: note = chr16:54963430-54963876
  misc_feature 1..446: note = Hyper
  source 1..446: mol_type = genomic DNA

SEQ ID NO: 112047 - DNA, 44 bp, Homo sapiens; identical to SEQ ID NO: 36164
  misc_feature 1..44: note = chr16:54964141-54964185
  misc_feature 1..44: note = Hyper
  source 1..44: mol_type = genomic DNA

SEQ ID NO: 112048 - DNA, 163 bp, Homo sapiens; identical to SEQ ID NO: 79080
  misc_feature 1..163: note = chr16:54964972-54965135
  misc_feature 1..163: note = Hyper
  source 1..163: mol_type = genomic DNA

SEQ ID NO: 112049 - DNA, 159 bp, Homo sapiens
  misc_feature 1..159: note = chr16:54966076-54966235
  misc_feature 1..159: note = Hyper
  source 1..159: mol_type = genomic DNA
atctgcatggagggccgggccgccgtggccagatctgcgcacggggtacggacgtgcccgggcagatgggggcctacggggtgacaccgaggccgggacagcttcaggggccccagaaggacctgacccagaaattgaggtccccgctgccttctgagg

SEQ ID NO: 112050 - DNA, 81 bp, Homo sapiens
  misc_feature 1..81: note = chr16:54966450-54966531
  misc_feature 1..81: note = Hyper
  source 1..81: mol_type = genomic DNA
ggggtaccatccttacgcggcgcccctgggatcgtacccttacggggacccagcgtaccggaagaacgccacaagggacgc

SEQ ID NO: 112051 - DNA, 526 bp, Homo sapiens
  misc_feature 1..526: note = chr16:54966765-54967291
  misc_feature 1..526: note = Hyper
  source 1..526: mol_type = genomic DNA
cgagccccagaagcccgaggacaagggcgaccccgagggccccgaagcaggttggtggacatgggaaagggcgtgttgggcgggagtaaaaaggaaaagagaggcctggagggggcgcgcacggggcctggaggttgggggcaggggtccctgcctttgcgggcgggaaccgggtcccgccgcgcggcctctgcgcccctgacagcctgggtttcgcccgcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgc

SEQ ID NO: 112052 - DNA, 53 bp, Homo sapiens
  misc_feature 1..53: note = chr16:54971043-54971096
  misc_feature 1..53: note = Hyper
  source 1..53: mol_type = genomic DNA
gaggcagtgcaaaaccggaaacctgctctgtgcggggccgaatcagttcatgg

SEQ ID NO: 112053 - DNA, 272 bp, Homo sapiens
  misc_feature 1..272: note = chr16:54971342-54971614
  misc_feature 1..272: note = Hyper
  source 1..272: mol_type = genomic DNA
agctagctgccaactcggacggaagcgcggaacagcgcaatgcaaaccgcccaaagtgaaaggaatgtaattgcgctcccatgacagagccagacgcggatgcagtttaggaagggcgccgcctaccggcccctgggagccatgcgattcgaagggagggggacctagaggagacccccgctatccccccacccaccgtggggccttagctttgaactccggcccggacaaacttaaactgcttcgccaccccaacgcgccacagccctgga

SEQ ID NO: 112054 - DNA, 46 bp, Homo sapiens; identical to SEQ ID NO: 36169
  misc_feature 1..46: note = chr16:54972930-54972976
  misc_feature 1..46: note = Hyper
  source 1..46: mol_type = genomic DNA

SEQ ID NO: 112055 - DNA, 402 bp, Homo sapiens; identical to SEQ ID NO: 79085
  misc_feature 1..402: note = chr16:55090666-55091068
  misc_feature 1..402: note = Hyper
  source 1..402: mol_type = genomic DNA

SEQ ID NO: 112056 - DNA, 244 bp, Homo sapiens; identical to SEQ ID NO: 79087
  misc_feature 1..244: note = chr16:55203739-55203983
  misc_feature 1..244: note = Hypo
  source 1..244: mol_type = genomic DNA

SEQ ID NO: 112057 - DNA, 1681 bp, Homo sapiens
  misc_feature 1..1681: note = chr16:55357444-55359125
  misc_feature 1..1681: note = Hyper
  source 1..1681: mol_type = genomic DNA
ctcccccacccctgccgccgcccacccatcagtgcccctttgaagacccctgggatggagtgagggggtggtcagaccgctgggcccagccgggcgtccaggaggagcgcagggaatgggccgccctcccggagcgctccactgcggctctccagcgccacccccagcggagcgcaggggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtcctggggaggctgaggcggggaaccagatccccgaggacaaagatgggcgggccagtgggatccaccgacgctgcccggagctgctccaacgagagccgggcctgtggcgtgaacaaactttacttcagcgcaggggcggaggaaccgggctggaggcttctcccccgggcctctgctctcctccacctgccagtgctcagcctccgcccagccttcgcccaccccagctccctccccctcccccacgcgcctctgttcactcagactcctgtctcccctctcccctcctccttctccctcttgcctttctcccccacttttctcctgtctcttcttttgtattctctcctccctcgccgccccggttgcctctcgcctcctccgggccgcaggggaggaggtgagcgcgctgcgcccggggcctgcgcggctcagagggaggcgtttctcctacttctcccgggtaatttggagaggttgtgtgtgtgtgcgcgcgcgcgtgagctccaggcgaaaaggggtaggattcagcgccgagcagagagggtcagggtttttgacgttcctcgccagctgcacaaacctcccggagcaagtgtgagtgtgggtgagagtgcgcgcgcgcgcacgggctggctgcgcttggcacgcttggtggcccagggtcccggggcccggggtcccgtctggcggcccgggattaccgtgacgtcacattgagcctctggccaccttggactgggacacctccggagcctcacagccccgcgccgcgccgcgcctcacctcgccaccacgcgcctttgggaacccgcatcttcttccttcccctgcccatccatgggcccttctgtcttccggaccccacgggccggaggggcgccttccggagcgcagggctcggcagccgggctgccctcggctctgcctccactggggccaaccaggcgaaggaaccggcgctgggcatccgcagcggtgtaaggaactgagacacctcactgctgggggcgcggaacagctgggctgagacgggaactcgacagggaagagagagacgggccagggacagccaccatgtccttcccacactttggacacccgtaccgcggcgcttcccaggtaagaggcgcctctatgggggataggggacagactgggtggagggagtgcctagtgcacggcgcctgcctctgatc

SEQ ID NO: 112058 - DNA, 336 bp, Homo sapiens
  misc_feature 1..336: note = chr16:55362920-55363256
  misc_feature 1..336: note = Hyper
  source 1..336: mol_type = genomic DNA
catgcttggagaaaccgcgcatctggtctctggcgcacaccgcgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggtagtgggcccccagcggcgctgggagtatcta

SEQ ID NO: 112059 - DNA, 776 bp, Homo sapiens
  misc_feature 1..776: note = chr16:55364692-55365468
  misc_feature 1..776: note = Hyper
  source 1..776: mol_type = genomic DNA
aggtgcttgagaggtcggtgtgcaggcaaagatgcattgcggccagggattcttgcgacagcgcggcgtgggctgcatacctcagttcctttagtagctgggaaagaaactgacaaggtaacagacaaggccgtggcgcctgcagctcagcggactaaccgctgcgtaaccaatccgtggagccaagctgaccacctcgcgggtcctgcgcatgggaagtggtgggacttgtcaggatgtttatctggaaactgcatctgtttccgggttcgtatttgggttgtaagtttactgggggaggggtgacgaggaccgcgctcctccgatcgaactgaacctaatggggaggtcaggcagctttcagggtcggtgtgaggcgagagggggcattcttcccgttttatcaaaagtgtcagcaaacacttccggtacaggccaaccaatgggaactgacgggcagggaaggggtctttgtcccccttgctaggagtgtcgagcgaccgggttgggggtaagagatttaaagacgcccgcgcaatggtgggtgggggaggctgcctgcgttcgtgtcccgcgtctagtggctttggctttagccagggagtgagcgcaccgctgctcgcagggaagcagggacccggggcagtgccctagaggggagctccgaagagcaaatgaggcgggaaggcaggacgaaaggcagctggggtgtgcgcccaaggcctggattcctggggagctgcgtttccaacgccgggtcccggccaggccaggcc

SEQ ID NO: 112060 - DNA, 329 bp, Homo sapiens
  misc_feature 1..329: note = chr16:55404915-55405244
  misc_feature 1..329: note = Hyper
  source 1..329: mol_type = genomic DNA
cttttgcatcttatacggatagccggctcatggcaatgtgactcaagctggcaggggtctttgagcatcaaacgtgtcctccttccctctacctacttcggctccggtttctctcccgaagcctaaataaagaaggtaacagacaacacctctattggcagaggcttctgccttttccgtcaggctggctgcagcacatccgtaatccttatgtcagcctgcactctagcgttgccggcccggtccagcatctgacagccgcgaatccaaagctgccggcctctcgtttctaagcagcagctcacagcgccagccgccctcccgcagaa

SEQ ID NO: 112061 - DNA, 895 bp, Homo sapiens
  misc_feature 1..895: note = chr16:55512644-55513539
  misc_feature 1..895: note = Hyper
  source 1..895: mol_type = genomic DNA
cctatccctaaatatcgaaaatttctgtctctgaccatctatcattgtggctgatcatctgtttctgaccattccttcccgttcctgaccccagggagtgcagggtgtcctagccaagccggcgtccctcctagtagtaccgctgctctctaacctcaggacgtcaagggcctagagcgacagatgtttcccagcagggggttctgaggctgtgcgcccagatcgcgagagaggcaagtggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttgg

SEQ ID NO: 112062 - DNA, 437 bp, Homo sapiens; identical to SEQ ID NO: 79102
  misc_feature 1..437: note = chr16:55514076-55514513
  misc_feature 1..437: note = Hyper
  source 1..437: mol_type = genomic DNA

SEQ ID NO: 112063 - DNA, 76 bp, Homo sapiens; identical to SEQ ID NO: 79104
  misc_feature 1..76: note = chr16:55689542-55689618
  misc_feature 1..76: note = Hyper
  source 1..76: mol_type = genomic DNA

SEQ ID NO: 112064 - DNA, 933 bp, Homo sapiens
  misc_feature 1..933: note = chr16:55689876-55690809
  misc_feature 1..933: note = Hyper
  source 1..933: mol_type = genomic DNA
taccagcccggcccccgccaggcacggccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggtctgcctgggaggcccgggccgagacgcgccagcagagggctagcgagtttgtagtgcagtgacgttaagtgtccgagaaggctcctgtggctgttgaagtgtcgcggacctgagctggggagggggtcggcacgctgccctcagcctcggtgagttcaatcccagccatttggggcaggcgagagtgggtgaacgaggaaaagtgctgcagggtcttcagccgcccccagagggctgtcagaagtctccaactcttgagttccggcgtgccccaacctctgtttccaaatttttccagcggacgcgcgcccttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtc

SEQ ID NO: 112065 - DNA, 1299 bp, Homo sapiens
  misc_feature 1..1299: note = chr16:56224364-56225663
  misc_feature 1..1299: note = Hyper
  source 1..1299: mol_type = genomic DNA
aaaattcattttgtgcgtttcgaagggggaggacaggagaatttagtgcaaagacggcctccaccaaacgaaaccgtccaacatttgcaaaagcttttaaaataaactgctcagggatcaggggtttgctggaaactcccggtcgcttgaagccctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgcgggtttattccgacccactaccacatcgcgtttcctgaggtaacccggcctcggctctgcggccccagcggctggagagccacggagaaggcgggctacgggcgacaagatggagagccggcccgagagggacagaggccgcgctggcagcgagctggggggcccacctgaccgtcctgcgggcagcccggccccgcgctcccattgacaaggaggtccgcgccgccggcgcgtggggcgggggcggaggcggggtggggcgccccggcgcgcgcccggccccactccccgcccccgccagtcccgcaagcacccaccccgggggagccgcgggccgggagggcgctggggggaggggcaggccgctccgcgagcgcgtgtgcgcgccgccgccggctgacgcgaactccggcgcgcgcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgc

SEQ ID NO: 112066 - DNA, 158 bp, Homo sapiens; identical to SEQ ID NO: 79113
  misc_feature 1..158: note = chr16:56225723-56225881
  misc_feature 1..158: note = Hyper
  source 1..158: mol_type = genomic DNA

SEQ ID NO: 112067 - DNA, 215 bp, Homo sapiens; identical to SEQ ID NO: 79114
  misc_feature 1..215: note = chr16:56226149-56226364
  misc_feature 1..215: note = Hyper
  source 1..215: mol_type = genomic DNA

SEQ ID NO: 112068 - DNA, 222 bp, Homo sapiens
  misc_feature 1..222: note = chr16:56228369-56228591
  misc_feature 1..222: note = Hyper
  source 1..222: mol_type = genomic DNA
ggatgaggtttcaggcgttgcaagtggtggacagcgcccagccgaggccggaaaagtcgatggggctcagttcggcgacgctcggctaggttcggtgcggtctgggcgcggggctcggagggagtcggcggtgttcggagccgagtcggtgctccggcggagagagccgagccgcttcggagggggtcgaaagcattcggaaatactcgggggaggggagtg

SEQ ID NO: 112069 - DNA, 43 bp, Homo sapiens; identical to SEQ ID NO: 79117
  misc_feature 1..43: note = chr16:56460223-56460266
  misc_feature 1..43: note = Hypo
  source 1..43: mol_type = genomic DNA

SEQ ID NO: 112070 - DNA, 816 bp, Homo sapiens; identical to SEQ ID NO: 79118
  misc_feature 1..816: note = chr16:56623053-56623869
  misc_feature 1..816: note = Hyper
  source 1..816: mol_type = genomic DNA

SEQ ID NO: 112071 - DNA, 366 bp, Homo sapiens
  misc_feature 1..366: note = chr16:56650999-56651365
  misc_feature 1..366: note = Hyper
  source 1..366: mol_type = genomic DNA
aggcctacccagggacgaagctggggttgcacaccggctccgggaatggcgaaataccgcagatggggtggtgggggtgggaatatcgcgaccaccagaggctgggttcccggaacgctcggggacggagatggccagcaaccacaaggaaatggggaatatggggaagttgcgcgggcaggacggcacggacgccgcggacgaccgggcgcacaggcctgagcgagcgagcgagtgagcgggtgccaagcaagagacccgcggtgcacaccttgcgcccggccggcctgctgctcacagtccctccacgtacccacaggaggcccagactcagcggggcgggtgcaagcgcggggcggggcctct

SEQ ID NO: 112072 - DNA, 715 bp, Homo sapiens; identical to SEQ ID NO: 79121
  misc_feature 1..715: note = chr16:56659106-56659821
  misc_feature 1..715: note = Hyper
  source 1..715: mol_type = genomic DNA

SEQ ID NO: 112073 - DNA, 649 bp, Homo sapiens; identical to SEQ ID NO: 79122
  misc_feature 1..649: note = chr16:56665943-56666592
  misc_feature 1..649: note = Hyper
  source 1..649: mol_type = genomic DNA

SEQ ID NO: 112074 - DNA, 571 bp, Homo sapiens
  misc_feature 1..571: note = chr16:56672114-56672685
  misc_feature 1..571: note = Hyper
  source 1..571: mol_type = genomic DNA
cgctctgcactacgccgatccggggacaggagcaggaggctgtggctgcactcagacttcgggacaggccgagctgaaaaccgtgagaggggtggggtggaggcgaccgaaacgccaaggctgggttcccggaacgcgcggggactagggtggaaggcaacttcggggaaactgggaaaggcgaccgggacctcggggacgccccgtaccccgggcgtaaactcactcccgcgttagcggccccaaagcggggagggggtggtcccgtggtccgcacccaggggagctcagtggactgtgcgccttgcctttctgctgcgcaaagcccagtccaggtcatcacctcgggcggggcggactcggctgggcggactcagcggggcgggcgcaggcgcagggcgggtcctttgcgtccggccctctttcccctgaccataaaagcagccgctggctgctgggccctaccaagccttccacgtgcgccttatagcctctcaacttcttgcttgggatctccaacctcaccgcggctcgaaatggaccccaactgctcctgcgccactggtaaggg

SEQ ID NO: 112075 - DNA, 451 bp, Homo sapiens; identical to SEQ ID NO: 79126
  misc_feature 1..451: note = chr16:56677117-56677568
  misc_feature 1..451: note = Hyper
  source 1..451: mol_type = genomic DNA

SEQ ID NO: 112076 - DNA, 74 bp, Homo sapiens; identical to SEQ ID NO: 79127
  misc_feature 1..74: note = chr16:56692017-56692091
  misc_feature 1..74: note = Hyper
  source 1..74: mol_type = genomic DNA

SEQ ID NO: 112077 - DNA, 265 bp, Homo sapiens; identical to SEQ ID NO: 79128
  misc_feature 1..265: note = chr16:56701956-56702221
  misc_feature 1..265: note = Hyper
  source 1..265: mol_type = genomic DNA

SEQ ID NO: 112078 - DNA, 30 bp, Homo sapiens
  misc_feature 1..30: note = chr16:56703372-56703402
  misc_feature 1..30: note = Hyper
  source 1..30: mol_type = genomic DNA
ggggtgggcaggccccggggtgtggggcgc

SEQ ID NO: 112079 - DNA, 235 bp, Homo sapiens
  misc_feature 1..235: note = chr16:56709814-56710049
  misc_feature 1..235: note = Hyper
  source 1..235: mol_type = genomic DNA
cagcatagcccctcccgcacgagcgggccccaaaagggcggtccccgggagcccaccaggctgcactcaggggatggtgcgcctgacccgcctgctgcgcacagctcaacccaagaccgcaggcgccgcggattccgcgtgggggtgggtgagaagggtactctgcacccggccccctcttctaactataaattgagcttccggttcctagaatccaccacgcctcccacctgcc

SEQ ID NO: 112080 - DNA, 27 bp, Homo sapiens
  misc_feature 1..27: note = chr16:56774935-56774962
  misc_feature 1..27: note = Hypo
  source 1..27: mol_type = genomic DNA
ggagagggagagcgctaaatttctttt

SEQ ID NO: 112081 - DNA, 30 bp, Homo sapiens; identical to SEQ ID NO: 79133
  misc_feature 1..30: note = chr16:57017302-57017332
  misc_feature 1..30: note = Hypo
  source 1..30: mol_type = genomic DNA

SEQ ID NO: 112082 - DNA, 216 bp, Homo sapiens; identical to SEQ ID NO: 79135
  misc_feature 1..216: note = chr16:57222193-57222409
  misc_feature 1..216: note = Hypo
  source 1..216: mol_type = genomic DNA

SEQ ID NO: 112083 - DNA, 35 bp, Homo sapiens; identical to SEQ ID NO: 79136
  misc_feature 1..35: note = chr16:57222709-57222744
  misc_feature 1..35: note = Hypo
  source 1..35: mol_type = genomic DNA

SEQ ID NO: 112084 - DNA, 35 bp, Homo sapiens; identical to SEQ ID NO: 79137
  misc_feature 1..35: note = chr16:57299645-57299680
  misc_feature 1..35: note = Hypo
  source 1..35: mol_type = genomic DNA

SEQ ID NO: 112085 - DNA, 82 bp, Homo sapiens; identical to SEQ ID NO: 79138
  misc_feature 1..82: note = chr16:57321270-57321352
  misc_feature 1..82: note = Hypo
  source 1..82: mol_type = genomic DNA

SEQ ID NO: 112086 - DNA, 23 bp, Homo sapiens
  misc_feature 1..23: note = chr16:57457827-57457850
  misc_feature 1..23: note = Hypo
  source 1..23: mol_type = genomic DNA
tacaaatccactggtcgggcgtg

SEQ ID NO: 112087 - DNA, 30 bp, Homo sapiens; identical to SEQ ID NO: 79140
  misc_feature 1..30: note = chr16:57656267-57656297
  misc_feature 1..30: note = Hypo
  source 1..30: mol_type = genomic DNA

SEQ ID NO: 112088 - DNA, 30 bp, Homo sapiens; identical to SEQ ID NO: 16055
  misc_feature 1..30: note = chr16:57759922-57759952
  misc_feature 1..30: note = Hypo
  source 1..30: mol_type = genomic DNA

SEQ ID NO: 112089 - DNA, 30 bp, Homo sapiens; identical to SEQ ID NO: 79143
  misc_feature 1..30: note = chr16:57935550-57935580
  misc_feature 1..30: note = Hypo
  source 1..30: mol_type = genomic DNA

SEQ ID NO: 112090 - DNA, 199 bp, Homo sapiens; identical to SEQ ID NO: 79144
  misc_feature 1..199: note = chr16:57937598-57937797
  misc_feature 1..199: note = Hypo
  source 1..199: mol_type = genomic DNA

SEQ ID NO: 112091 - DNA, 933 bp, Homo sapiens; identical to SEQ ID NO: 79145
  misc_feature 1..933: note = chr16:58018551-58019484
  misc_feature 1..933: note = Hyper
  source 1..933: mol_type = genomic DNA

SEQ ID NO: 112092 - DNA, 103 bp, Homo sapiens; identical to SEQ ID NO: 79146
  misc_feature 1..103: note = chr16:58061004-58061107
  misc_feature 1..103: note = Hyper
  source 1..103: mol_type = genomic DNA

SEQ ID NO: 112093 - DNA, 122 bp, Homo sapiens; identical to SEQ ID NO: 44712
  misc_feature 1..122: note = chr16:58120963-58121085
  misc_feature 1..122: note = Hypo
  source 1..122: mol_type = genomic DNA

SEQ ID NO: 112094 - DNA, 50 bp, Homo sapiens; identical to SEQ ID NO: 79148
  misc_feature 1..50: note = chr16:58192290-58192340
  misc_feature 1..50: note = Hypo
  source 1..50: mol_type = genomic DNA

SEQ ID NO: 112095 - DNA, 214 bp, Homo sapiens; identical to SEQ ID NO: 79149
  misc_feature 1..214: note = chr16:58427268-58427482
  misc_feature 1..214: note = Hypo
  source 1..214: mol_type = genomic DNA

SEQ ID NO: 112096 - DNA, 23 bp, Homo sapiens
  misc_feature 1..23: note = chr16:58462000-58462023
  misc_feature 1..23: note = Hypo
  source 1..23: mol_type = genomic DNA
taatacatcgtggacatccttcc

SEQ ID NO: 112097 - DNA, 1510 bp, Homo sapiens
  misc_feature 1..1510: note = chr16:58497214-58498724
  misc_feature 1..1510: note = Hyper
  source 1..1510: mol_type = genomic DNA
tctaaacaaagactacggcagcgccgtcccctcccccgggaacccgacgccgcgcggccacagggggcctggaggggcgggcagggcctcgcagcgcacccagcacagtccgcgcggcggagcgggtgagaagtcggcgggggcgcggatcgaccggggtgtcccccaggctccgcgtcgcggtccccgctcgccctcccgcccgcccaccgggcaccccagccgcgcagaaggcggaagccacgcgcgagggaccgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccgccgcggctgctgcgcgcgtccccgcccagcccagcccagccccgagcacgaccccagccccacgcacgaccctagccccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggtaccgcccgcctgccccgcagccggccgccactttccgagttggagcggactccgggcgcggcggccggggactggggcggctcgggtctgagcaggaaggggtgcggaccccaactaagtcctagttttgtgctacctgtttgtgtgcggagcccagccccgggagaggacttgaggttgtggcgagtccctggcgctggcgtccgggctgcgggagcaccggtcagggggtggccccatggggtctctgaccagcggagctcggattaggaccctgaaagctagctcagggctcctgccctccaatcagtgtcgcttgtcccctaagaaaggacccgtgggcttctggca

SEQ ID NO: 112098 - DNA, 119 bp, Homo sapiens; identical to SEQ ID NO: 79154
  misc_feature 1..119: note = chr16:58499185-58499304
  misc_feature 1..119: note = Hyper
  source 1..119: mol_type = genomic DNA

SEQ ID NO: 112099 - DNA, 29 bp, Homo sapiens
  misc_feature 1..29: note = chr16:58521708-58521737
  misc_feature 1..29: note = Hyper
  source 1..29: mol_type = genomic DNA
ccctgaggagaagccgctgctccggggcc

SEQ ID NO: 112100 - DNA, 44 bp, Homo sapiens; identical to SEQ ID NO: 79155
  misc_feature 1..44: note = chr16:58540563-58540607
  misc_feature 1..44: note = Hypo
  source 1..44: mol_type = genomic DNA

SEQ ID NO: 112101 - DNA, 97 bp, Homo sapiens; identical to SEQ ID NO: 79156
  misc_feature 1..97: note = chr16:58548289-58548386
  misc_feature 1..97: note = Hypo
  source 1..97: mol_type = genomic DNA

SEQ ID NO: 112102 - DNA, 87 bp, Homo sapiens; identical to SEQ ID NO: 79157
  misc_feature 1..87: note = chr16:58549151-58549238
  misc_feature 1..87: note = Hyper
  source 1..87: mol_type = genomic DNA

SEQ ID NO: 112103 - DNA, 50 bp, Homo sapiens; identical to SEQ ID NO: 79158
  misc_feature 1..50: note = chr16:58550442-58550492
  misc_feature 1..50: note = Hypo
  source 1..50: mol_type = genomic DNA

SEQ ID NO: 112104 - DNA, 145 bp, Homo sapiens; identical to SEQ ID NO: 79159
  misc_feature 1..145: note = chr16:58831937-58832082
  misc_feature 1..145: note = Hypo
  source 1..145: mol_type = genomic DNA

SEQ ID NO: 112105 - DNA, 35 bp, Homo sapiens; identical to SEQ ID NO: 79160
  misc_feature 1..35: note = chr16:58850468-58850503
  misc_feature 1..35: note = Hypo
  source 1..35: mol_type = genomic DNA

SEQ ID NO: 112106 - DNA, 20 bp, Homo sapiens
  misc_feature 1..20: note = chr16:58886050-58886070
  misc_feature 1..20: note = Hypo
  source 1..20: mol_type = genomic DNA
aatgctggtcaggcacggtg

SEQ ID NO: 112107 - DNA, 33 bp, Homo sapiens; identical to SEQ ID NO: 79162
  misc_feature 1..33: note = chr16:58886324-58886357
  misc_feature 1..33: note = Hypo
  source 1..33: mol_type = genomic DNA

SEQ ID NO: 112108 - DNA, 27 bp, Homo sapiens
  misc_feature 1..27: note = chr16:58932088-58932115
  misc_feature 1..27: note = Hypo
  source 1..27: mol_type = genomic DNA
tttgcctaggctgagcgcagtggtgtg

SEQ ID NO: 112109 - DNA, 61 bp, Homo sapiens; identical to SEQ ID NO: 79164
  misc_feature 1..61: note = chr16:58969757-58969818
  misc_feature 1..61: note = Hypo
  source 1..61: mol_type = genomic DNA

SEQ ID NO: 112110 - DNA, 38 bp, Homo sapiens; identical to SEQ ID NO: 16056
  misc_feature 1..38: note = chr16:59046529-59046567
  misc_feature 1..38: note = Hypo
  source 1..38: mol_type = genomic DNA

SEQ ID NO: 112111 - DNA, 30 bp, Homo sapiens; identical to SEQ ID NO: 79166
  misc_feature 1..30: note = chr16:59182473-59182503
  misc_feature 1..30: note = Hypo
  source 1..30: mol_type = genomic DNA

SEQ ID NO: 112112 - DNA, 28 bp, Homo sapiens
  misc_feature 1..28: note = chr16:60166000-60166028
  misc_feature 1..28: note = Hypo
  source 1..28: mol_type = genomic DNA
gcgtgagccaccgcgtcaggccgaaagc

SEQ ID NO: 112113 - DNA, 30 bp, Homo sapiens; identical to SEQ ID NO: 79184
  misc_feature 1..30: note = chr16:61479596-61479626
  misc_feature 1..30: note = Hypo
  source 1..30: mol_type = genomic DNA

SEQ ID NO: 112114 - DNA, 85 bp, Homo sapiens; identical to SEQ ID NO: 36213
  misc_feature 1..85: note = chr16:62068463-62068548
  misc_feature 1..85: note = Hyper
  source 1..85: mol_type = genomic DNA

SEQ ID NO: 112115 - DNA, 426 bp, Homo sapiens
  misc_feature 1..426: note = chr16:62069009-62069435
  misc_feature 1..426: note = Hyper
  source 1..426: mol_type = genomic DNA
agcacgtttttttaccgtttcccagccttggctggatcctgggagaaccggagtaggtcccttatgaacctcttacgtactggcagaacctaggcaagagcctttttccctccgatcctgcgaggggcgcgaccagcccctcaaaggttcccggatgagaagcggccagaccacagaaagcgcaggtctgggctcagctgtccctaggagagcggctacggagtccccggcttaagggggcctccgtgcacgcaatctcgagttgcggggagacactgcctgggggtcctgcaggggtgctgggcagcgtcttggcgagggcagagccgcagggcgactccggagcccggcaagtttgtagcgggcaccgcacctcccagagctggagctgccacttgtgggaaagcctcgcgctggggctttcgc

SEQ ID NO: 112116 - DNA, 30 bp, Homo sapiens
  misc_feature 1..30: note = chr16:62070111-62070141
  misc_feature 1..30: note = Hyper
  source 1..30: mol_type = genomic DNA
tccgttcatgcctctcggagctacagggct

SEQ ID NO: 112117 - DNA, 43 bp, Homo sapiens; identical to SEQ ID NO: 36217
  misc_feature 1..43: note = chr16:62070743-62070786
  misc_feature 1..43: note = Hyper
  source 1..43: mol_type = genomic DNA

SEQ ID NO: 112118 - DNA, 28 bp, Homo sapiens
  misc_feature 1..28: note = chr16:62670669-62670697
  misc_feature 1..28: note = Hypo
  source 1..28: mol_type = genomic DNA
ccagtggcgctatcccggctcactgcaa

SEQ ID NO: 112119 - DNA, 30 bp, Homo sapiens; identical to SEQ ID NO: 79196
  misc_feature 1..30: note = chr16:64407177-64407207
  misc_feature 1..30: note = Hypo
  source 1..30: mol_type = genomic DNA

SEQ ID NO: 112120 - DNA, 767 bp, Homo sapiens; identical to SEQ ID NO: 79197
  misc_feature 1..767: note = chr16:65154509-65155276
  misc_feature 1..767: note = Hyper
  source 1..767: mol_type = genomic DNA

SEQ ID NO: 112121 - DNA, 1640 bp, Homo sapiens
  misc_feature 1..1640: note = chr16:65155677-65157317
  misc_feature 1..1640: note = Hyper
  source 1..1640: mol_type = genomic DNA
ctcaccaccccgccccgccaagacattctcttcctgagaaaatcctgccccccattccaagaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctggccaggctgggctctcgcctggcgggccgggatggtggttgggggaaggtatcgtccaagtgagggaagcaattgggaattcgggagcgcgttctattctttctcactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagctctcctctcgtctagtgccccccacgcaacgcctcggagaggggtgcgcggggagcgcttcgccggggtcggcctcgctccagcttttgggagggtgccttggcccctaccccagccaggtatcagtggcccccgccggtagtgtcacttgttgccactccctcgctacagacccgccagggcccggtggagtgtgcgtttctacgggagaaagggcctaatggggcgcagcgccggagtcctagctccttcctccgctgttcccctcactgacgactcgctaccgtgagggttccccgggcctgcttcctgccctccctccccgagtcgccgggagaaagggctggcagggccggggcttaggaatcacgccaaggactgggcggggcgctcgcggtaccgggaacggcgtggggatccgcacacccagcagggaacaaccatgcctgtgtggggacccctggcttgaacaagtttgcagggtgggaggtggaggcaagagaggaggcggaggaaggtggagacgccagtgggtgaaggctaaaaaggaaccgcctagggggacggggatgaggctgggaaaggagaagagatggacccgcgaaaaagacggggaaggaggctgcggagggaaagctgggcgccacagccaagca

SEQ ID NO: 112122 - DNA, 544 bp, Homo sapiens
  misc_feature 1..544: note = chr16:65157522-65158066
  misc_feature 1..544: note = Hyper
  source 1..544: mol_type = genomic DNA
gcttggggagacgcccgcgggggcgggtgccggcgaggctgccccgggacctaccctcttcggcctgcgcgcccgcgtttttcttgacgactccaggatccgggtggcgctgcgtgcctgcccccagtccgcgtcctgcgcggagaggatgcctctgtcaccctctgtgtggacgtggcctttgaactcctcattcctccactgcgggggaagagctgtaagtttccagctgcccggttatcttactcctcagccttccccccaccataggtgtccaaggtgatagccccctgggtctccagtaaccccccaacctcgcaccacactctgcgcaagggacgcgcgaggacattgactcccggtgctttcctgtagagcgccagagagcagatcgtggtgcctgccactcctgcctccccctgtgggtccctggccctgaaccttttcagagctctaccctgcttcctctgtctgcctttttggcctctgctgtaacccctaaaactttgggtacttcccaagccaccgccgaaagtccccactc

SEQ ID NO: 112123 - DNA, 581 bp, Homo sapiens
  misc_feature 1..581: note = chr16:66461408-66461989
  misc_feature 1..581: note = Hyper
  source 1..581: mol_type = genomic DNA
ggtggtaccggcgaacgacacacccgggggcgcgccgcgcggagcctcggtgcgcggggcgggcggatgcgcggtccggaacggaaccgcagcgcgctcggaacggagcgggatcccgggtctcccgcggaccctcgaccccgggctggccactgggatctgcgcgagccgaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaaggggctggggcttcacggagtttggagtttgaacccacccgcacccctttgagctaggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggac

SEQ ID NO: 112124 - DNA, 30 bp, Homo sapiens; identical to SEQ ID NO: 79204
  misc_feature 1..30: note = chr16:66512694-66512724
  misc_feature 1..30: note = Hyper
  source 1..30: mol_type = genomic DNA

SEQ ID NO: 112125 - DNA, 530 bp, Homo sapiens
  misc_feature 1..530: note = chr16:66612734-66613264
  misc_feature 1..530: note = Hyper
  source 1..530: mol_type = genomic DNA
ccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccgacgccccgcagaggcccgcctgaagccagcccggcgccctagcagatgcacgtgtctgtcgaatcgctgcctccgagcccacccccgagctcgcatgctgtcacccattccagcctaaatgtgaccataaaattagggctgctgcttttatcgagaacacctgcttcctctcgttgccttgtgtgaaagtcgcgttgtattttcctgcgcttggcgctgcgcccgcggagctcagggccgtgacccggtgctcgcagccccccgaccccgcagcggagcggcggcttacagacctggggccacctggagacgccgggatgggaccgcgagggcagctccgcgcggaggtgggaccggcgggttgggaacggagttggggcccg

SEQ ID NO: 112126 - DNA, 377 bp, Homo sapiens
  misc_feature 1..377: note = chr16:66638075-66638452
  misc_feature 1..377: note = Hyper
  source 1..377: mol_type = genomic DNA
gcgcttgcaggtctgagagtcctctgagaatgggttgggggaggcgggtgcaggaccgaggcctggaacagccaacaaagaggccctggaggagggtggggctggccggggacaggaggggtggccaagaaagtcgcaagaaaactccggcccccaagaaaaagagagggcatgggttgcggagccgacatcacggccggggtctttgctgtttagacgcctgggttcccggatcccagacacgcgcacgggcaggaagttagaccggagacagcgagtatagacagcccttctggataggggcagacgggtgggagctccgaaggggtgccggggcggtgatcgggaggtctccagcggcccgaaccagggtgaag

SEQ ID NO: 112127 - DNA, 810 bp, Homo sapiens; identical to SEQ ID NO: 79209
  misc_feature 1..810: note = chr16:66878235-66879045
  misc_feature 1..810: note = Hyper
  source 1..810: mol_type = genomic DNA

SEQ ID NO: 112128 - DNA, 273 bp, Homo sapiens; identical to SEQ ID NO: 79210
  misc_feature 1..273: note = chr16:66958730-66959003
  misc_feature 1..273: note = Hyper
  source 1..273: mol_type = genomic DNA

SEQ ID NO: 112129 - DNA, 167 bp, Homo sapiens; identical to SEQ ID NO: 79211
  misc_feature 1..167: note = chr16:66959249-66959416
  misc_feature 1..167: note = Hyper
  source 1..167: mol_type = genomic DNA

SEQ ID NO: 112130 - DNA, 226 bp, Homo sapiens; identical to SEQ ID NO: 79212
  misc_feature 1..226: note = chr16:66987397-66987623
  misc_feature 1..226: note = Hypo
  source 1..226: mol_type = genomic DNA

SEQ ID NO: 112131 - DNA, 30 bp, Homo sapiens; identical to SEQ ID NO: 79213
  misc_feature 1..30: note = chr16:67049292-67049322
  misc_feature 1..30: note = Hypo
  source 1..30: mol_type = genomic DNA

SEQ ID NO: 112132 - DNA, 269 bp, Homo sapiens; identical to SEQ ID NO: 79215
  misc_feature 1..269: note = chr16:67184148-67184417
  misc_feature 1..269: note = Hyper
  source 1..269: mol_type = genomic DNA

SEQ ID NO: 112133 - DNA, 91 bp, Homo sapiens; identical to SEQ ID NO: 79216
  misc_feature 1..91: note = chr16:67189168-67189259
  misc_feature 1..91: note = Hyper
  source 1..91: mol_type = genomic DNA

SEQ ID NO: 112134 - DNA, 689 bp, Homo sapiens; identical to SEQ ID NO: 79217
  misc_feature 1..689: note = chr16:67197593-67198282
  misc_feature 1..689: note = Hyper
  source 1..689: mol_type = genomic DNA

SEQ ID NO: 112135 - DNA, 980 bp, Homo sapiens; identical to SEQ ID NO: 79218
  misc_feature 1..980: note = chr16:67198552-67199532
  misc_feature 1..980: note = Hyper
  source 1..980: mol_type = genomic DNA

SEQ ID NO: 112136 - DNA, 30 bp, Homo sapiens; identical to SEQ ID NO: 79219
  misc_feature 1..30: note = chr16:67241204-67241234
  misc_feature 1..30: note = Hypo
  source 1..30: mol_type = genomic DNA

SEQ ID NO: 112137 - DNA, 277 bp, Homo sapiens; identical to SEQ ID NO: 79220
  misc_feature 1..277: note = chr16:67241603-67241880
  misc_feature 1..277: note = Hypo
  source 1..277: mol_type = genomic DNA

SEQ ID NO: 112138 - DNA, 30 bp, Homo sapiens; identical to SEQ ID NO: 79221
  misc_feature 1..30: note = chr16:67242338-67242368
  misc_feature 1..30: note = Hypo
  source 1..30: mol_type = genomic DNA

SEQ ID NO: 112139 - DNA, 101 bp, Homo sapiens; identical to SEQ ID NO: 79222
  misc_feature 1..101: note = chr16:67244020-67244121
  misc_feature 1..101: note = Hypo
  source 1..101: mol_type = genomic DNA

SEQ ID NO: 112140 - DNA, 48 bp, Homo sapiens; identical to SEQ ID NO: 79223
  misc_feature 1..48: note = chr16:67289799-67289847
  misc_feature 1..48: note = Hypo
  source 1..48: mol_type = genomic DNA

SEQ ID NO: 112141 - DNA, 102 bp, Homo sapiens; identical to SEQ ID NO: 79224
  misc_feature 1..102: note = chr16:67299098-67299200
  misc_feature 1..102: note = Hypo
  source 1..102: mol_type = genomic DNA

SEQ ID NO: 112142 - DNA, 106 bp, Homo sapiens; identical to SEQ ID NO: 79225
  misc_feature 1..106: note = chr16:67313852-67313958
  misc_feature 1..106: note = Hypo
  source 1..106: mol_type = genomic DNA

SEQ ID NO: 112143 - DNA, 83 bp, Homo sapiens; identical to SEQ ID NO: 79226
  misc_feature 1..83: note = chr16:67320453-67320536
  misc_feature 1..83: note = Hypo
  source 1..83: mol_type = genomic DNA

SEQ ID NO: 112144 - DNA, 348 bp, Homo sapiens; identical to SEQ ID NO: 79227
  misc_feature 1..348: note = chr16:67360535-67360883
  misc_feature 1..348: note = Hyper
  source 1..348: mol_type = genomic DNA

SEQ ID NO: 112145 - DNA, 162 bp, Homo sapiens; identical to SEQ ID NO: 79228
  misc_feature 1..162: note = chr16:67427310-67427472
  misc_feature 1..162: note = Hyper
  source 1..162: mol_type = genomic DNA

SEQ ID NO: 112146 - DNA, 30 bp, Homo sapiens; identical to SEQ ID NO: 79229
  misc_feature 1..30: note = chr16:67427854-67427884
  misc_feature 1..30: note = Hyper
  source 1..30: mol_type = genomic DNA

SEQ ID NO: 112147 - DNA, 137 bp, Homo sapiens; identical to SEQ ID NO: 79230
  misc_feature 1..137: note = chr16:67433335-67433472
  misc_feature 1..137: note = Hyper
  source 1..137: mol_type = genomic DNA

SEQ ID NO: 112148 - DNA, 30 bp, Homo sapiens; identical to SEQ ID NO: 79231
  misc_feature 1..30: note = chr16:67478638-67478668
  misc_feature 1..30: note = Hypo
  source 1..30: mol_type = genomic DNA

SEQ ID NO: 112149 - DNA, 30 bp, Homo sapiens; identical to SEQ ID NO: 79232
  misc_feature 1..30: note = chr16:67496823-67496853
  misc_feature 1..30: note = Hypo
  source 1..30: mol_type = genomic DNA

SEQ ID NO: 112150 - DNA, 38 bp, Homo sapiens; identical to SEQ ID NO: 79233
  misc_feature 1..38: note = chr16:67571498-67571536
  misc_feature 1..38: note = Hyper
  source 1..38: mol_type = genomic DNA

SEQ ID NO: 112151 - DNA, 74 bp, Homo sapiens; identical to SEQ ID NO: 79234
  misc_feature 1..74: note = chr16:67572364-67572438
  misc_feature 1..74: note = Hyper
  source 1..74: mol_type = genomic DNA

SEQ ID NO: 112152 - DNA, 81 bp, Homo sapiens; identical to SEQ ID NO: 79235
  misc_feature 1..81: note = chr16:67578633-67578714
  misc_feature 1..81: note = Hypo
  source 1..81: mol_type = genomic DNA

SEQ ID NO: 112153 - DNA, 77 bp, Homo sapiens; identical to SEQ ID NO: 79236
  misc_feature 1..77: note = chr16:67678709-67678786
  misc_feature 1..77: note = Hyper
  source 1..77: mol_type = genomic DNA

SEQ ID NO: 112154 - DNA, 117 bp, Homo sapiens; identical to SEQ ID NO: 79237
  misc_feature 1..117: note = chr16:67679041-67679158
  misc_feature 1..117: note = Hyper
  source 1..117: mol_type = genomic DNA

SEQ ID NO: 112155 - DNA, 41 bp, Homo sapiens; identical to SEQ ID NO: 79238
  misc_feature 1..41: note = chr16:67683741-67683782
  misc_feature 1..41: note = Hypo
  source 1..41: mol_type = genomic DNA

SEQ ID NO: 112156 - DNA, 259 bp, Homo sapiens; identical to SEQ ID NO: 79239
  misc_feature 1..259: note = chr16:67700832-67701091
  misc_feature 1..259: note = Hyper
  source 1..259: mol_type = genomic DNA

SEQ ID NO: 112157 - DNA, 18 bp, Homo sapiens
  misc_feature 1..18: note = chr16:67730391-67730409
  misc_feature 1..18: note = Hypo
  source 1..18: mol_type = genomic DNA
tttttgagacagtctcgc

SEQ ID NO: 112158 - DNA, 100 bp, Homo sapiens; identical to SEQ ID NO: 79243
  misc_feature 1..100: note = chr16:67854142-67854242
  misc_feature 1..100: note = Hypo
  source 1..100: mol_type = genomic DNA

SEQ ID NO: 112159 - DNA, 129 bp, Homo sapiens; identical to SEQ ID NO: 79244
  misc_feature 1..129: note = chr16:67877005-67877134
  misc_feature 1..129: note = Hyper
  source 1..129: mol_type = genomic DNA

SEQ ID NO: 112160 - DNA, 270 bp, Homo sapiens; identical to SEQ ID NO: 79245
  misc_feature 1..270: note = chr16:67982004-67982274
  misc_feature 1..270: note = Hypo
  source 1..270: mol_type = genomic DNA

SEQ ID NO: 112161 - DNA, 157 bp, Homo sapiens; identical to SEQ ID NO: 79246
  misc_feature 1..157: note = chr16:68002842-68002999
  misc_feature 1..157: note = Hyper
  source 1..157: mol_type = genomic DNA

SEQ ID NO: 112162 - DNA, 30 bp, Homo sapiens; identical to SEQ ID NO: 79247
  misc_feature 1..30: note = chr16:68012551-68012581
  misc_feature 1..30: note = Hypo
  source 1..30: mol_type = genomic DNA

SEQ ID NO: 112163 - DNA, 691 bp, Homo sapiens
  misc_feature 1..691: note = chr16:68118224-68118915
  misc_feature 1..691: note = Hyper
  source 1..691: mol_type = genomic DNA
tccctgtccaccttgcgcctcagcggagccttaggtaaacaagccaggctcccagtccccaaggacggccttcaccccagaccccaggaggaggcgtcttgggccatctcgggaaggctagcttgctcgggaggggcagatcacgaaaacggttctttaggcagtgtcacttcctctccactgccagccacccaatttaggcggctccatccctcccgctttcatggatatgcagcaggatgcagagagcacagagctgtgattggcacgagctcacaacgggctttcccgctcaatctactcaacttccagcaagggacaggccctgcccattggggttcgctgaggcctcaaacgcgcatgctgtcaagggagcagctgcgggggcccgctagtggggacaaaggcgcagccaccggggcgaaagctccgccccgcagagggtgggcctgcggcgaccgcgagctcagagtccggacttgtcgcgcaatctgtctccttcggttccaccccaacctagctggactctcggtccggtccctgccctctggagactcagccattaaagttgaggtggggggatgaggatgtgggcggcgtccaggtaactctgaggggccctgatgccttccctagagccagccatcaggagtaacacgatgcgcccccacatcaccgaacccagaacctc

SEQ ID NO: 112164 - DNA, 30 bp, Homo sapiens; identical to SEQ ID NO: 79252
  misc_feature 1..30: note = chr16:68270127-68270157
  misc_feature 1..30: note = Hyper
  source 1..30: mol_type = genomic DNA

SEQ ID NO: 112165 - DNA, 84 bp, Homo sapiens; identical to SEQ ID NO: 79253
  misc_feature 1..84: note = chr16:68273891-68273975
  misc_feature 1..84: note = Hyper
  source 1..84: mol_type = genomic DNA

SEQ ID NO: 112166 - DNA, 30 bp, Homo sapiens; identical to SEQ ID NO: 79254
  misc_feature 1..30: note = chr16:68362039-68362069
  misc_feature 1..30: note = Hypo
  source 1..30: mol_type = genomic DNA

SEQ ID NO: 112167 - DNA, 183 bp, Homo sapiens; identical to SEQ ID NO: 79255
  misc_feature 1..183: note = chr16:68385408-68385591
  misc_feature 1..183: note = Hypo
  source 1..183: mol_type = genomic DNA

SEQ ID NO: 112168 - DNA, 35 bp, Homo sapiens; identical to SEQ ID NO: 79256
  misc_feature 1..35: note = chr16:68386152-68386187
  misc_feature 1..35: note = Hypo
  source 1..35: mol_type = genomic DNA

SEQ ID NO: 112169 - DNA, 41 bp, Homo sapiens; identical to SEQ ID NO: 79258
  misc_feature 1..41: note = chr16:68480923-68480964
  misc_feature 1..41: note = Hyper
  source 1..41: mol_type = genomic DNA

SEQ ID NO: 112170 - DNA, 265 bp, Homo sapiens; identical to SEQ ID NO: 79259
  misc_feature 1..265: note = chr16:68504027-68504292
  misc_feature 1..265: note = Hyper
  source 1..265: mol_type = genomic DNA

SEQ ID NO: 112171 - DNA, 236 bp, Homo sapiens; identical to SEQ ID NO: 79260
  misc_feature 1..236: note = chr16:68544142-68544378
  misc_feature 1..236: note = Hyper
  source 1..236: mol_type = genomic DNA

SEQ ID NO: 112172 - DNA, 60 bp, Homo sapiens; identical to SEQ ID NO: 79261
  misc_feature 1..60: note = chr16:68572648-68572708
  misc_feature 1..60: note = Hypo
  source 1..60: mol_type = genomic DNA

SEQ ID NO: 112173 - DNA, 679 bp, Homo sapiens
  misc_feature 1..679: note = chr16:68676360-68677039
  misc_feature 1..679: note = Hyper
  source 1..679: mol_type = genomic DNA
aagtggttggcacatcgccggctgtcagcaaatgtttttgaaatgaatgaatgagtgaatgaccgacaaggggagctaaggggaaggcagcggtgcggtccgcgtcgcaggcagaagagctgactctccaatctccgctcctctctccgcccccgtccggaatgctgagtgcccgagaaggaggcggaaatgagcgcgctcaacagcccaccagccgggtgtttacttaattagggcctgcatcccgaggctcgtttgtgtttaaccgtccgcctaatggcttcgtctggctccgggcgggcgcgggggaacctgcgaggcgagcgtaggcctggccaccctgtcccgccgggggcccactccattgcgccgcgcgggtgcgcgtagacctgacctcccctcgggcataaaaagcgccctgcgggagatccaggccgggagggcgcggagctcagcgagcagccccaggctttcccaaccgcgtggtccacccccagcctcagtcccagccccagctgctgggctcacccgccggctaagggaatgctcccgagataccagatgccagttgctcgttgtaccctcagccatgaaattggaggattacaacgcttctcattctcttaattcaggggatgtggggatgctagaaagagagacggctcgccagacatctgag

SEQ ID NO: 112174 - DNA, 174 bp, Homo sapiens; identical to SEQ ID NO: 79264
  misc_feature 1..174: note = chr16:68678982-68679156
  misc_feature 1..174: note = Hyper
  source 1..174: mol_type = genomic DNA

SEQ ID NO: 112175 - DNA, 108 bp, Homo sapiens; identical to SEQ ID NO: 79265
  misc_feature 1..108: note = chr16:68679959-68680067
  misc_feature 1..108: note = Hyper
  source 1..108: mol_type = genomic DNA

SEQ ID NO: 112176 - DNA, 80 bp, Homo sapiens; identical to SEQ ID NO: 79266
  misc_feature 1..80: note = chr16:68759191-68759271
  misc_feature 1..80: note = Hypo
  source 1..80: mol_type = genomic DNA

SEQ ID NO: 112177 - DNA, 120 bp, Homo sapiens; identical to SEQ ID NO: 79267
  misc_feature 1..120: note = chr16:68770606-68770726
  misc_feature 1..120: note = Hypo
  source 1..120: mol_type = genomic DNA

SEQ ID NO: 112178 - DNA, 149 bp, Homo sapiens; identical to SEQ ID NO: 79268
  misc_feature 1..149: note = chr16:68770846-68770995
  misc_feature 1..149: note = Hypo
  source 1..149: mol_type = genomic DNA

SEQ ID NO: 112179 - DNA, 76 bp, Homo sapiens; identical to SEQ ID NO: 79269
  misc_feature 1..76: note = chr16:68771248-68771324
  misc_feature 1..76: note = Hyper
  source 1..76: mol_type = genomic DNA

SEQ ID NO: 112180 - DNA, 45 bp, Homo sapiens; identical to SEQ ID NO: 44724
  misc_feature 1..45: note = chr16:68787504-68787549
  misc_feature 1..45: note = Hypo
  source 1..45: mol_type = genomic DNA

SEQ ID NO: 112181 - DNA, 42 bp, Homo sapiens; identical to SEQ ID NO: 79271
  misc_feature 1..42: note = chr16:68876805-68876847
  misc_feature 1..42: note = Hypo
  source 1..42: mol_type = genomic DNA

SEQ ID NO: 112182 - DNA, 30 bp, Homo sapiens; identical to SEQ ID NO: 79272
  misc_feature 1..30: note = chr16:69106048-69106078
  misc_feature 1..30: note = Hypo
  source 1..30: mol_type = genomic DNA

SEQ ID NO: 112183 - DNA, 25 bp, Homo sapiens
  misc_feature 1..25: note = chr16:69107559-69107584
  misc_feature 1..25: note = Hypo
  source 1..25: mol_type = genomic DNA
gttagaaagggcactcgaagccagg

SEQ ID NO: 112184 - DNA, 48 bp, Homo sapiens; identical to SEQ ID NO: 79274
  misc_feature 1..48: note = chr16:69133585-69133633
  misc_feature 1..48: note = Hypo
  source 1..48: mol_type = genomic DNA

SEQ ID NO: 112185 - DNA, 30 bp, Homo sapiens; identical to SEQ ID NO: 79275
  misc_feature 1..30: note = chr16:69139552-69139582
  misc_feature 1..30: note = Hyper
  source 1..30: mol_type = genomic DNA

SEQ ID NO: 112186 - DNA, 136 bp, Homo sapiens; identical to SEQ ID NO: 79276
  misc_feature 1..136: note = chr16:69352213-69352349
  misc_feature 1..136: note = Hypo
  source 1..136: mol_type = genomic DNA

SEQ ID NO: 112187 - DNA, 30 bp, Homo sapiens; identical to SEQ ID NO: 44727
  misc_feature 1..30: note = chr16:69352566-69352596
  misc_feature 1..30: note = Hypo
  source 1..30: mol_type = genomic DNA

SEQ ID NO: 112188 - DNA, 21 bp, Homo sapiens
  misc_feature 1..21: note = chr16:69359280-69359301
  misc_feature 1..21: note = Hypo
  source 1..21: mol_type = genomic DNA
tcgagagttgctgggcgcggt

SEQ ID NO: 112189 - DNA, 30 bp, Homo sapiens; identical to SEQ ID NO: 79279
  misc_feature 1..30: note = chr16:69372480-69372510
  misc_feature 1..30: note = Hypo
  source 1..30: mol_type = genomic DNA

SEQ ID NO: 112190 - DNA, 36 bp, Homo sapiens; identical to SEQ ID NO: 79280
  misc_feature 1..36: note = chr16:69563669-69563705
  misc_feature 1..36: note = Hypo
  source 1..36: mol_type = genomic DNA

SEQ ID NO: 112191 - DNA, 19 bp, Homo sapiens
  misc_feature 1..19: note = chr16:69564030-69564049
  misc_feature 1..19: note = Hypo
  source 1..19: mol_type = genomic DNA
agtcttggccgggcgcgat

SEQ ID NO: 112192 - DNA, 30 bp, Homo sapiens; identical to SEQ ID NO: 79282
  misc_feature 1..30: note = chr16:69776566-69776596
  misc_feature 1..30: note = Hypo
  source 1..30: mol_type = genomic DNA

SEQ ID NO: 112193 - DNA, 187 bp, Homo sapiens; identical to SEQ ID NO: 79283
  misc_feature 1..187: note = chr16:69791463-69791650
  misc_feature 1..187: note = Hypo
  source 1..187: mol_type = genomic DNA

SEQ ID NO: 112194 - DNA, 140 bp, Homo sapiens; identical to SEQ ID NO: 79287
  misc_feature 1..140: note = chr16:70379985-70380125
  misc_feature 1..140: note = Hypo
  source 1..140: mol_type = genomic DNA

SEQ ID NO: 112195 - DNA, 136 bp, Homo sapiens; identical to SEQ ID NO: 79288
  misc_feature 1..136: note = chr16:70416085-70416221
  misc_feature 1..136: note = Hypo
  source 1..136: mol_type = genomic DNA

SEQ ID NO: 112196 - DNA, 126 bp, Homo sapiens; identical to SEQ ID NO: 44730
  misc_feature 1..126: note = chr16:70427606-70427732
  misc_feature 1..126: note = Hypo
  source 1..126: mol_type = genomic DNA

SEQ ID NO: 112197 - DNA, 19 bp, Homo sapiens
  misc_feature 1..19: note = chr16:70439156-70439175
  misc_feature 1..19: note = Hypo
  source 1..19: mol_type = genomic DNA
aggcacagcctggtgcggt

SEQ ID NO: 112198 - DNA, 30 bp, Homo sapiens; identical to SEQ ID NO: 79291
  misc_feature 1..30: note = chr16:70514821-70514851
  misc_feature 1..30: note = Hypo
  source 1..30: mol_type = genomic DNA

SEQ ID NO: 112199 - DNA, 28 bp, Homo sapiens
  misc_feature 1..28: note = chr16:70522735-70522763
  misc_feature 1..28: note = Hypo
  source 1..28: mol_type = genomic DNA
gagccaccacacccggcccagctactgt

SEQ ID NO: 112200 - DNA, 77 bp, Homo sapiens; identical to SEQ ID NO: 44731
  misc_feature 1..77: note = chr16:70595623-70595700
  misc_feature 1..77: note = Hypo
  source 1..77: mol_type = genomic DNA

SEQ ID NO: 112201 - DNA, 140 bp, Homo sapiens; identical to SEQ ID NO: 79294
  misc_feature 1..140: note = chr16:70610992-70611132
  misc_feature 1..140: note = Hypo
  source 1..140: mol_type = genomic DNA

SEQ ID NO: 112202 - DNA, 50 bp, Homo sapiens; identical to SEQ ID NO: 44732
  misc_feature 1..50: note = chr16:70680482-70680532
  misc_feature 1..50: note = Hypo
  source 1..50: mol_type = genomic DNA

SEQ ID NO: 112203 - DNA, 32 bp, Homo sapiens; identical to SEQ ID NO: 79296
  misc_feature 1..32: note = chr16:70719509-70719541
  misc_feature 1..32: note = Hyper
  source 1..32: mol_type = genomic DNA

SEQ ID NO: 112204 - DNA, 30 bp, Homo sapiens; identical to SEQ ID NO: 79297
  misc_feature 1..30: note = chr16:70769908-70769938
  misc_feature 1..30: note = Hypo
  source 1..30: mol_type = genomic DNA

SEQ ID NO: 112205 - DNA, 69 bp, Homo sapiens; identical to SEQ ID NO: 79298
  misc_feature 1..69: note = chr16:70795276-70795345
  misc_feature 1..69: note = Hypo
  source 1..69: mol_type = genomic DNA

SEQ ID NO: 112206 - DNA, 96 bp, Homo sapiens
  misc_feature 1..96: note = chr16:71264576-71264672
  misc_feature 1..96: note = Hyper
  source 1..96: mol_type = genomic DNA
cccgcactctccatgcgccgcccgagctgttgccgtccgttgccacggtaaccacggagccgcacagcctagcaagccgcgcgatgattggaggag

SEQ ID NO: 112207 - DNA, 23 bp, Homo sapiens
  misc_feature 1..23: note = chr16:71266650-71266673
  misc_feature 1..23: note = Hypo
  source 1..23: mol_type = genomic DNA
gggtgcagtggctcacgcctgta

SEQ ID NO: 112208 - DNA, 30 bp, Homo sapiens; identical to SEQ ID NO: 79303
  misc_feature 1..30: note = chr16:71418717-71418747
  misc_feature 1..30: note = Hypo
  source 1..30: mol_type = genomic DNA

SEQ ID NO: 112209 - DNA, 22 bp, Homo sapiens
  misc_feature 1..22: note = chr16:71433525-71433547
  misc_feature 1..22: note = Hypo
  source 1..22: mol_type = genomic DNA
cgcgccccgcagctgtggttaa

SEQ ID NO: 112210 - DNA, 663 bp, Homo sapiens
  misc_feature 1..663: note = chr16:71459854-71460517
  misc_feature 1..663: note = Hyper
  source 1..663: mol_type = genomic DNA
tgcatttggcagccacgagagcccatctcccgcccaatcaagaggccgtcgccctggagacggaggaccccagctggggtcaccccttgcagcctcctctcccgtgcttgccggttcttgccaccctccgccgcttgcaccggacccaggcgctcatcccccgcttcccccgcgccccagcccggtcacgcctcggagcttgtccccacctggccgtgctcagagtctgcctgcccggcgtcccacacgcaccgcagggccccaccgcctcttggtgagccgcggtggctcgggtcccgggtccccaataggctgcgctcccggcaggcagctttcttcccggcgcggggctcgttccctgaggccaggccgctcagtggccgcaagagcgaccttcccacatgtccccaggtgtgcgcacaagcccggggtgagaccagaagctgctgcctgcagagcccgaccttgcgtagatgactccgcgagtgcaaggggctgcaggcattttcttacaggaggtagcaagcttgtctaagcagaggccctcttagcgcagtgggcagcgcgtcagtctcataatctgaaggtcctgagttcgagcctcagagagggcagctgttttgttgtgctacgaatgcagcaaatgttcggatgtaacccagc

SEQ ID NO: 112211 - DNA, 167 bp, Homo sapiens; identical to SEQ ID NO: 79307
  misc_feature 1..167: note = chr16:71715744-71715911
  misc_feature 1..167: note = Hypo
  source 1..167: mol_type = genomic DNA

SEQ ID NO: 112212 - DNA, 45 bp, Homo sapiens; identical to SEQ ID NO: 79308
  misc_feature 1..45: note = chr16:71841040-71841085
  misc_feature 1..45: note = Hypo
  source 1..45: mol_type = genomic DNA

SEQ ID NO: 112213 - DNA, 104 bp, Homo sapiens; identical to SEQ ID NO: 79309
  misc_feature 1..104: note = chr16:71841325-71841429
  misc_feature 1..104: note = Hypo
  source 1..104: mol_type = genomic DNA

SEQ ID NO: 112214 - DNA, 23 bp, Homo sapiens
  misc_feature 1..23: note = chr16:71919058-71919081
  misc_feature 1..23: note = Hypo
  source 1..23: mol_type = genomic DNA
tggttggacgcacttctagtcaa

SEQ ID NO: 112215 - DNA, 140 bp, Homo sapiens; identical to SEQ ID NO: 79311
  misc_feature 1..140: note = chr16:72038633-72038773
  misc_feature 1..140: note = Hypo
  source 1..140: mol_type = genomic DNA

SEQ ID NO: 112216 - DNA, 44 bp, Homo sapiens
  misc_feature 1..44: note = chr16:72459645-72459689
  misc_feature 1..44: note = Hypo
  source 1..44: mol_type = genomic DNA
taaaatcaattaacccgagtgttaattaacgtcaagtcgacggg

SEQ ID NO: 112217 - DNA, 30 bp, Homo sapiens; identical to SEQ ID NO: 79313
  misc_feature 1..30: note = chr16:72461127-72461157
  misc_feature 1..30: note = Hypo
  source 1..30: mol_type = genomic DNA

SEQ ID NO: 112218 - DNA, 114 bp, Homo sapiens; identical to SEQ ID NO: 79314
  misc_feature 1..114: note = chr16:72461587-72461701
  misc_feature 1..114: note = Hypo
  source 1..114: mol_type = genomic DNA

SEQ ID NO: 112219 - DNA, 30 bp, Homo sapiens; identical to SEQ ID NO: 79317
  misc_feature 1..30: note = chr16:72697029-72697059
  misc_feature 1..30: note = Hypo
  source 1..30: mol_type = genomic DNA

SEQ ID NO: 112220 - DNA, 121 bp, Homo sapiens; identical to SEQ ID NO: 79318
  misc_feature 1..121: note = chr16:72835621-72835742
  misc_feature 1..121: note = Hypo
  source 1..121: mol_type = genomic DNA

SEQ ID NO: 112221 - DNA, 70 bp, Homo sapiens; identical to SEQ ID NO: 79319
  misc_feature 1..70: note = chr16:72957744-72957814
  misc_feature 1..70: note = Hypo
  source 1..70: mol_type = genomic DNA

SEQ ID NO: 112222 - DNA, 30 bp, Homo sapiens; identical to SEQ ID NO: 79320
  misc_feature 1..30: note = chr16:72963559-72963589
  misc_feature 1..30: note = Hypo
  source 1..30: mol_type = genomic DNA

SEQ ID NO: 112223 - DNA, 30 bp, Homo sapiens; identical to SEQ ID NO: 79321
  misc_feature 1..30: note = chr16:72995364-72995394
  misc_feature 1..30: note = Hypo
  source 1..30: mol_type = genomic DNA

SEQ ID NO: 112224 - DNA, 30 bp, Homo sapiens; identical to SEQ ID NO: 44739
  misc_feature 1..30: note = chr16:73033457-73033487
  misc_feature 1..30: note = Hypo
  source 1..30: mol_type = genomic DNA

SEQ ID NO: 112225 - DNA, 82 bp, Homo sapiens; identical to SEQ ID NO: 79323
  misc_feature 1..82: note = chr16:73062471-73062553
  misc_feature 1..82: note = Hypo
  source 1..82: mol_type = genomic DNA

SEQ ID NO: 112226 - DNA, 52 bp, Homo sapiens
  misc_feature 1..52: note = chr16:73096999-73097051
  misc_feature 1..52: note = Hyper
  source 1..52: mol_type = genomic DNA
cgggatccaaggtgccgcgcggaggaggcgggctgctcgcagtgccggggtc

SEQ ID NO: 112227 - DNA, 704 bp, Homo sapiens
  misc_feature 1..704: note = chr16:73099886-73100590
  misc_feature 1..704: note = Hyper
  source 1..704: mol_type = genomic DNA
cagggcgtggccccacggccggcaggagtccggcgcacactgggcctggagcgcactgactggggctctggctagccgggctacccgtggggtggcctagggcccagcctgtgtcaaggctgcgggcagggcactggtcccctgtggactcggggcgcgccctctcagccgcctccctgtttaattccagagctcagcgggctgcagggacattcgacgccagtttcctcaggcccgggcgtgagacgcgcccttctcgtgtctgctcttccgtccctctgcgctggatgttgtatagcgcaggccccttccctccccgcctctcgttcccaaaaccttatcattgagaattcgacagttgccccgagatgctgatcccagttcacggagccagcgtgcgcgtccctaatgcccggcacacccatctccatttcgggacccttttttttcctgcgggctctggactcccgggaggaagcctcgggccctccggctccccggagacaccggctgaggcgcttaggccagtgcagagtcgccgcactgggacccaggcgcccctcacaggtgcacgtagggcatggcccaacggcccctcggatgggcggggaaacaggcccgggcggagcaattcgatcaccccattatgcccctgcggatgcccagaaaagccacgaggcccgggggaccgccccagcagtggt

SEQ ID NO: 112228 - DNA, 43 bp, Homo sapiens; identical to SEQ ID NO: 79328
  misc_feature 1..43: note = chr16:73397226-73397269
  misc_feature 1..43: note = Hypo
  source 1..43: mol_type = genomic DNA

SEQ ID NO: 112229 - DNA, 33 bp, Homo sapiens; identical to SEQ ID NO: 79329
  misc_feature 1..33: note = chr16:73422838-73422871
  misc_feature 1..33: note = Hypo
  source 1..33: mol_type = genomic DNA

SEQ ID NO: 112230 - DNA, 25 bp, Homo sapiens
  misc_feature 1..25: note = chr16:73450459-73450484
  misc_feature 1..25: note = Hypo
  source 1..25: mol_type = genomic DNA
actcaatttagcagacgaaagttga

SEQ ID NO: 112231 - DNA, 30 bp, Homo sapiens; identical to SEQ ID NO: 79334
  misc_feature 1..30: note = chr16:73558881-73558911
  misc_feature 1..30: note = Hypo
  source 1..30: mol_type = genomic DNA

SEQ ID NO: 112232 - DNA, 205 bp, Homo sapiens; identical to SEQ ID NO: 79335
  misc_feature 1..205: note = chr16:73693831-73694036
  misc_feature 1..205: note = Hypo
  source 1..205: mol_type = genomic DNA

SEQ ID NO: 112233 - DNA, 17 bp, Homo sapiens
  misc_feature 1..17: note = chr16:73984305-73984322
  misc_feature 1..17: note = Hypo
  source 1..17: mol_type = genomic DNA
gagtcgcaggcaggccg

SEQ ID NO: 112234 - DNA, 30 bp, Homo sapiens; identical to SEQ ID NO: 44742
  misc_feature 1..30: note = chr16:74331835-74331865
  misc_feature 1..30: note = Hypo
  source 1..30: mol_type = genomic DNA

SEQ ID NO: 112235 - DNA, 30 bp, Homo sapiens; identical to SEQ ID NO: 79340
  misc_feature 1..30: note = chr16:74401355-74401385
  misc_feature 1..30: note = Hyper
  source 1..30: mol_type = genomic DNA

SEQ ID NO: 112236 - DNA, 20 bp, Homo sapiens
  misc_feature 1..20: note = chr16:74490343-74490363
  misc_feature 1..20: note = Hypo
  source 1..20: mol_type = genomic DNA
caccgcgcccggccctgacc

SEQ ID NO: 112237 - DNA, 30 bp, Homo sapiens; identical to SEQ ID NO: 79342
  misc_feature 1..30: note = chr16:74702004-74702034
  misc_feature 1..30: note = Hypo
  source 1..30: mol_type = genomic DNA

SEQ ID NO: 112238 - DNA, 152 bp, Homo sapiens; identical to SEQ ID NO: 79344
  misc_feature 1..152: note = chr16:74901411-74901563
  misc_feature 1..152: note = Hypo
  source 1..152: mol_type = genomic DNA

SEQ ID NO: 112239 - DNA, 240 bp, Homo sapiens; identical to SEQ ID NO: 79345
  misc_feature 1..240: note = chr16:75019623-75019863
  misc_feature 1..240: note = Hypo
  source 1..240: mol_type = genomic DNA

SEQ ID NO: 112240 - DNA, 30 bp, Homo sapiens; identical to SEQ ID NO: 79347
  misc_feature 1..30: note = chr16:75112923-75112953
  misc_feature 1..30: note = Hypo
  source 1..30: mol_type = genomic DNA

SEQ ID NO: 112241 - DNA, 598 bp, Homo sapiens; identical to SEQ ID NO: 79348
  misc_feature 1..598: note = chr16:75148553-75149151
  misc_feature 1..598: note = Hypo
  source 1..598: mol_type = genomic DNA

SEQ ID NO: 112242 - DNA, 37 bp, Homo sapiens; identical to SEQ ID NO: 44746
  misc_feature 1..37: note = chr16:75171636-75171673
  misc_feature 1..37: note = Hypo
  source 1..37: mol_type = genomic DNA

SEQ ID NO: 112243 - DNA, 38 bp, Homo sapiens; identical to SEQ ID NO: 79350
  misc_feature 1..38: note = chr16:75178915-75178953
  misc_feature 1..38: note = Hypo
  source 1..38: mol_type = genomic DNA

SEQ ID NO: 112244 - DNA, 120 bp, Homo sapiens; identical to SEQ ID NO: 79351
  misc_feature 1..120: note = chr16:75183609-75183729
  misc_feature 1..120: note = Hypo
  source 1..120: mol_type = genomic DNA

SEQ ID NO: 112245 - DNA, 30 bp, Homo sapiens; identical to SEQ ID NO: 79352
  misc_feature 1..30: note = chr16:75227098-75227128
  misc_feature 1..30: note = Hypo
  source 1..30: mol_type = genomic DNA

SEQ ID NO: 112246 - DNA, 87 bp, Homo sapiens; identical to SEQ ID NO: 79353
  misc_feature 1..87: note = chr16:75403259-75403346
  misc_feature 1..87: note = Hypo
  source 1..87: mol_type = genomic DNA

SEQ ID NO: 112247 - DNA, 35 bp, Homo sapiens; identical to SEQ ID NO: 79354
  misc_feature 1..35: note = chr16:75465061-75465096
  misc_feature 1..35: note = Hypo
  source 1..35: mol_type = genomic DNA

SEQ ID NO: 112248 - DNA, 34 bp, Homo sapiens; identical to SEQ ID NO: 79355
  misc_feature 1..34: note = chr16:75465516-75465550
  misc_feature 1..34: note = Hypo
  source 1..34: mol_type = genomic DNA

SEQ ID NO: 112249 - DNA, 39 bp, Homo sapiens; identical to SEQ ID NO: 79356
  misc_feature 1..39: note = chr16:75469080-75469119
  misc_feature 1..39: note = Hypo
  source 1..39: mol_type = genomic DNA

SEQ ID NO: 112250 - DNA, 702 bp, Homo sapiens
  misc_feature 1..702: note = chr16:75528671-75529373
  misc_feature 1..702: note = Hyper
  source 1..702: mol_type = genomic DNA
gcgatgccctttccacgttgctgatggaaaagccactcccagctcttcccgccaccccaggtccccggtgcaggacagaggagcgtccccagctgtgccaccagcccggcccccagccgacccgagtgtggggacatcccccgcggagaatgaagaaccaacgtaccccaaagcttggcggctctgcccgagctgcagcggcacggtgggggacgcctctctccctggactcagcaaaggctcccaaacgtcgtctcttccaaattccaccgcacagccagctctttctcttcactgggagggtccgcaggggctgacttgctccttaaggtcccaagactattaagcgacacccggtgaggccgggaaaggggctctaagaggcatggacgagagttggcggtgaccaagccactggaagctcctggagactcgaggtagaacgaatgtgggaacagggcaggagtcccagaatgggatgttgaggctgggggtgtcctggggctaccacagggaaggacccggcgcagagctccctctggaacccggcactgcggcccgcgccctctactccccgcgcgccggccggcaaccctcggcgctgcccggtgcagcccgcccgagcgcacacaatgaggcgctttcagacgtggctgcggtcccgaggtggccagcgggagctagcgccgtgggggaaggaag

SEQ ID NO: 112251 - DNA, 32 bp, Homo sapiens; identical to SEQ ID NO: 79359
  misc_feature 1..32: note = chr16:75549843-75549875
  misc_feature 1..32: note = Hypo
  source 1..32: mol_type = genomic DNA

SEQ ID NO: 112252 - DNA, 99 bp, Homo sapiens; identical to SEQ ID NO: 79362
  misc_feature 1..99: note = chr16:75658303-75658402
  misc_feature 1..99: note = Hypo
  source 1..99: mol_type = genomic DNA

SEQ ID NO: 112253 - DNA, 120 bp, Homo sapiens; identical to SEQ ID NO: 79363
  misc_feature 1..120: note = chr16:75666903-75667023
  misc_feature 1..120: note = Hypo
  source 1..120: mol_type = genomic DNA

SEQ ID NO: 112254 - DNA, 99 bp, Homo sapiens; identical to SEQ ID NO: 79364
  misc_feature 1..99: note = chr16:75680068-75680167
  misc_feature 1..99: note = Hypo
  source 1..99: mol_type = genomic DNA

SEQ ID NO: 112255 - DNA, 30 bp, Homo sapiens; identical to SEQ ID NO: 44750
  misc_feature 1..30: note = chr16:75733411-75733441
  misc_feature 1..30: note = Hypo
  source 1..30: mol_type = genomic DNA

SEQ ID NO: 112256 - DNA, 32 bp, Homo sapiens; identical to SEQ ID NO: 79367
  misc_feature 1..32: note = chr16:75787877-75787909
  misc_feature 1..32: note = Hypo
  source 1..32: mol_type = genomic DNA

SEQ ID NO: 112257 - DNA, 41 bp, Homo sapiens; identical to SEQ ID NO: 36256
  misc_feature 1..41: note = chr16:76311161-76311202
  misc_feature 1..41: note = Hyper
  source 1..41: mol_type = genomic DNA

SEQ ID NO: 112258 - DNA, 30 bp, Homo sapiens; identical to SEQ ID NO: 79370
  misc_feature 1..30: note = chr16:76685067-76685097
  misc_feature 1..30: note = Hypo
  source 1..30: mol_type = genomic DNA

SEQ ID NO: 112259 - DNA, 955 bp, Homo sapiens; identical to SEQ ID NO: 79372
  misc_feature 1..955: note = chr16:77245975-77246930
  misc_feature 1..955: note = Hyper
  source 1..955: mol_type = genomic DNA

SEQ ID NO: 112260 - DNA, 129 bp, Homo sapiens; identical to SEQ ID NO: 79373
  misc_feature 1..129: note = chr16:77247382-77247511
  misc_feature 1..129: note = Hypo
  source 1..129: mol_type = genomic DNA

SEQ ID NO: 112261 - DNA, 67 bp, Homo sapiens; identical to SEQ ID NO: 79374
  misc_feature 1..67: note = chr16:77247715-77247782
  misc_feature 1..67: note = Hypo
  source 1..67: mol_type = genomic DNA

SEQ ID NO: 112262 - DNA, 25 bp, Homo sapiens
  misc_feature 1..25: note = chr16:77372556-77372581
  misc_feature 1..25: note = Hypo
  source 1..25: mol_type = genomic DNA
agtaagtggcttggccgggcgcggt

SEQ ID NO: 112263 - DNA, 859 bp, Homo sapiens
  misc_feature 1..859: note = chr16:77468261-77469120
  misc_feature 1..859: note = Hyper
  source 1..859: mol_type = genomic DNA
agggtcaaagtgctgcgaaaggcccttcttggggatggggggcaaatacgaaccatcatttaatccgctggcgccgctgctgctgtcactggctaaggccgcggcgaccgacgcacagcagaggcagcacagctggagcgcctgcaagagaaaaggtgacatcgcgcgtgaggggcgcggcggggctggcgtcgggcgccccctgccacccgctctcggagctccgctcggcggcacctgccttggccacgcgccccagtcccgccaggcccctcggcgggcccgaacccgcagccgggaaggcacacgcgagcaggagggcgcactccatggtcaggtgcggacgcggcggctgcgggtggccagacgcggcaggcggagcgcacgggcggcgcgcattctttccgcggccccggagctcggcgccccaggtgcggctccaggtgagagccgccgccgttcacatcgcagcgggggcgcgctgggacctcccctcctccggccgcctgcgcgccctcccttctcccggcgcgggcctgccgagctgcagtttgcggcaccccagagggtacggggggctccctgggccgggactggagcgcaaacggttgggagactgtcggtgtctgcccgcccgtctgtgcgtctgtctgtgtcggtgtgagcgtctgaggcgatggggaagacagcgccagctggctcccccagcgcgccggagccgagcgcccgcctctccaccgcgcggtgattggcgaccagcggctcccgggctcgtccgagcccccgggctggtgcaagggcgtgggattcccggctccagctctgagggagggggcgaagggggcggggaggctgggtg

SEQ ID NO: 112264 - DNA, 30 bp, Homo sapiens; identical to SEQ ID NO: 79379
  misc_feature 1..30: note = chr16:77753074-77753104
  misc_feature 1..30: note = Hypo
  source 1..30: mol_type = genomic DNA

SEQ ID NO: 112265 - DNA, 200 bp, Homo sapiens; identical to SEQ ID NO: 79380
  misc_feature 1..200: note = chr16:77753871-77754071
  misc_feature 1..200: note = Hypo
  source 1..200: mol_type = genomic DNA

SEQ ID NO: 112266 - DNA, 1203 bp, Homo sapiens
  misc_feature 1..1203: note = chr16:77822117-77823320
  misc_feature 1..1203: note = Hyper
  source 1..1203: mol_type = genomic DNA
agagggcaaccttgtcgcggtaaggcatcctccaggcccagacattagtctcggtccatttcaaggcacccgagcctgtgccgtatataaccaagtactgggcccacaggaagggggatgacagggtggtctctctaggctcgttttagtcacagatcttcggcaaatttgggtttagggccgcgatcccgaccctaacttgggactatttcaggaactggagttgaggcttcgttgggacaggaaagaagggtggggcgggggtgaagcgcttagggcacggctcttgtgaggattacggcggaggctgtggaccgcggcggcgctcgcagaggctgcagccattgcacagccgagcatcccacattcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctggtccagtatccgcgcctttctcgctttctctctttttgcgcgctgggcgctggggagggggtgggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgcttaacagaattaaaaatatatgtattaagaaccgcaagcccactgtgtgccagccgccgttggtagttttacacgtgcgatcttatttaatacttcctgggacctaatgagtcaggtgccatcatgatccgtttacaggtaagaaagccgccgctcagcgagaatgagtgatt

SEQ ID NO: 112267 - DNA, 30 bp, Homo sapiens; identical to SEQ ID NO: 79383
  misc_feature 1..30: note = chr16:78057993-78058023
  misc_feature 1..30: note = Hypo
  source 1..30: mol_type = genomic DNA

SEQ ID NO: 112268 - DNA, 408 bp, Homo sapiens; identical to SEQ ID NO: 79384
  misc_feature 1..408: note = chr16:78079769-78080177
  misc_feature 1..408: note = Hyper
  source 1..408: mol_type = genomic DNA

SEQ ID NO: 112269 - DNA, 30 bp, Homo sapiens; identical to SEQ ID NO: 79386
  misc_feature 1..30: note = chr16:79253226-79253256
  misc_feature 1..30: note = Hypo
  source 1..30: mol_type = genomic DNA

SEQ ID NO: 112270 - DNA, 48 bp, Homo sapiens; identical to SEQ ID NO: 79387
  misc_feature 1..48: note = chr16:79253546-79253594
  misc_feature 1..48: note = Hypo
  source 1..48: mol_type = genomic DNA

SEQ ID NO: 112271 - DNA, 174 bp, Homo sapiens
  misc_feature 1..174: note = chr16:79263326-79263500
  misc_feature 1..174: note = Hypo
  source 1..174: mol_type = genomic DNA
atagagctgcctttccgttgtccgtggaattcactgcacatttcgagggaccgcctgtcctggcagagagcaagggactcataaaagtgtcagaacattatgaacagcccgaagatgggctgtgagcggggataagtgaagcgcggcgtggaggccgttcggtaactccatcca

SEQ ID NO: 112272 - DNA, 52 bp, Homo sapiens; identical to SEQ ID NO: 79388
  misc_feature 1..52: note = chr16:79623822-79623874
  misc_feature 1..52: note = Hyper
  source 1..52: mol_type = genomic DNA

SEQ ID NO: 112273 - DNA, 976 bp, Homo sapiens
  misc_feature 1..976: note = chr16:79632604-79633580
  misc_feature 1..976: note = Hyper
  source 1..976: mol_type = genomic DNA
tagcaagcccacacccgagccggacccccgcggagcacttatcagggtggctagctggaatcgcgtgtcagactcacatgaaaaactcgggagaggacgggttgtcgctgctcgagccgttttctcggaagccgctgctcaccaacttctcgtatttctccttgtacgcgtccctctcgcgcaccagcctggagatctcctgcttgaggtggtcgacttgctgcagcagctggttcttctccgactccaggacgtgtctctgctgcaccctcttgaagcggcaggactgggcatagccgcggtttttcagggtccgcctcttctgcttcagccggatcacctcctccttgctgaccccgcgcagctgccggttcagctcgcgcacagacatggtcaccagctgctcgtcggagaagcggtcgtcgaagtgcaggccgccggcggcgtggtgcgggtgcagggcgccccccgcccccgccgcgcccccgccgcctccgccgccgccgccgccgccgccgcccccagcgctggccgggccaccgccgcccgcgcccccagcgccaccggccgaggcggccgcgctgcccgcggcgccgggcgcgccggccgtcgggtggtggtggtggccggcggcgtggtggtggtggtggtggtagtgcgggcccgcgccgctctgcgcggcggccgcggcgatcacggcggacaccacggcggcggcggggcccatctcctcgccgctgccgcccaaggaggcgccggcaccggccccggccgccgcggccagctgctgcgccccgcgcgcgtagccatcgaagccgccctggagctggtggctgttgctgatgagcgcctcgaccgcgtcctcggggctgaagcccagcgcctcggggttcagctgctgcgggtagccggtcatccagtagtagtcttccaggtgcgccttctgctcgctgcccgagcccgggctgggcgccga

SEQ ID NO: 112274 - DNA, 51 bp, Homo sapiens; identical to SEQ ID NO: 36268
  misc_feature 1..51: note = chr16:79633792-79633843
  misc_feature 1..51: note = Hyper
  source 1..51: mol_type = genomic DNA

SEQ ID NO: 112275 - DNA, 30 bp, Homo sapiens; identical to SEQ ID NO: 79392
  misc_feature 1..30: note = chr16:79634334-79634364
  misc_feature 1..30: note = Hyper
  source 1..30: mol_type = genomic DNA

SEQ ID NO: 112276 - DNA, 936 bp, Homo sapiens; identical to SEQ ID NO: 79393
  misc_feature 1..936: note = chr16:79634758-79635694
  misc_feature 1..936: note = Hyper
  source 1..936: mol_type = genomic DNA

SEQ ID NO: 112277 - DNA, 30 bp, Homo sapiens; identical to SEQ ID NO: 79394
  misc_feature 1..30: note = chr16:79635937-79635967
  misc_feature 1..30: note = Hyper
  source 1..30: mol_type = genomic DNA

SEQ ID NO: 112278 - DNA, 36 bp, Homo sapiens; identical to SEQ ID NO: 79395
  misc_feature 1..36: note = chr16:79674118-79674154
  misc_feature 1..36: note = Hypo
  source 1..36: mol_type = genomic DNA

SEQ ID NO: 112279 - DNA, 215 bp, Homo sapiens; identical to SEQ ID NO: 79396
  misc_feature 1..215: note = chr16:79804242-79804457
  misc_feature 1..215: note = Hyper
  source 1..215: mol_type = genomic DNA

SEQ ID NO: 112280 - DNA, 194 bp, Homo sapiens; identical to SEQ ID NO: 79398
  misc_feature 1..194: note = chr16:79880975-79881169
  misc_feature 1..194: note = Hypo
  source 1..194: mol_type = genomic DNA

SEQ ID NO: 112281 - DNA, 30 bp, Homo sapiens; identical to SEQ ID NO: 79399
  misc_feature 1..30: note = chr16:80015013-80015043
  misc_feature 1..30: note = Hypo
  source 1..30: mol_type = genomic DNA

SEQ ID NO: 112282 - DNA, 444 bp, Homo sapiens; identical to SEQ ID NO: 79400
  misc_feature 1..444: note = chr16:80574608-80575052
  misc_feature 1..444: note = Hyper
  source 1..444: mol_type = genomic DNA

SEQ ID NO: 112283 - DNA, 225 bp, Homo sapiens; identical to SEQ ID NO: 79401
  misc_feature 1..225: note = chr16:80641678-80641903
  misc_feature 1..225: note = Hypo
  source 1..225: mol_type = genomic DNA

SEQ ID NO: 112284 - DNA, 135 bp, Homo sapiens; identical to SEQ ID NO: 79402
  misc_feature 1..135: note = chr16:80644760-80644895
  misc_feature 1..135: note = Hypo
  source 1..135: mol_type = genomic DNA

SEQ ID NO: 112285 - DNA, 116 bp, Homo sapiens; identical to SEQ ID NO: 79403
  misc_feature 1..116: note = chr16:80654735-80654851
  misc_feature 1..116: note = Hypo
  source 1..116: mol_type = genomic DNA

SEQ ID NO: 112286 - DNA, 30 bp, Homo sapiens; identical to SEQ ID NO: 79404
  misc_feature 1..30: note = chr16:80671402-80671432
  misc_feature 1..30: note = Hypo
  source 1..30: mol_type = genomic DNA

SEQ ID NO: 112287 - DNA, 181 bp, Homo sapiens; identical to SEQ ID NO: 79405
  misc_feature 1..181: note = chr16:80704532-80704713
  misc_feature 1..181: note = Hypo
  source 1..181: mol_type = genomic DNA

SEQ ID NO: 112288 - DNA, 115 bp, Homo sapiens; identical to SEQ ID NO: 79406
  misc_feature 1..115: note = chr16:80718633-80718748
  misc_feature 1..115: note = Hypo
  source 1..115: mol_type = genomic DNA

SEQ ID NO: 112289 - DNA, 61 bp, Homo sapiens
  misc_feature 1..61: note = chr16:80837363-80837424
  misc_feature 1..61: note = Hyper
  source 1..61: mol_type = genomic DNA
caagggccacccccacgcccgagcccggagggcgtccgagctggtgcgggggcagcaggtg

SEQ ID NO: 112290 - DNA, 44 bp, Homo sapiens; identical to SEQ ID NO: 79408
  misc_feature 1..44: note = chr16:80838149-80838193
  misc_feature 1..44: note = Hyper
  source 1..44: mol_type = genomic DNA

SEQ ID NO: 112291 - DNA, 189 bp, Homo sapiens; identical to SEQ ID NO: 79409
  misc_feature 1..189: note = chr16:80871876-80872065
  misc_feature 1..189: note = Hypo
  source 1..189: mol_type = genomic DNA

SEQ ID NO: 112292 - DNA, 30 bp, Homo sapiens; identical to SEQ ID NO: 79411
  misc_feature 1..30: note = chr16:80965838-80965868
  misc_feature 1..30: note = Hyper
  source 1..30: mol_type = genomic DNA

SEQ ID NO: 112293 - DNA, 32 bp, Homo sapiens; identical to SEQ ID NO: 36273
  misc_feature 1..32: note = chr16:80966399-80966431
  misc_feature 1..32: note = Hyper
  source 1..32: mol_type = genomic DNA

SEQ ID NO: 112294 - DNA, 90 bp, Homo sapiens; identical to SEQ ID NO: 79414
  misc_feature 1..90: note = chr16:81042175-81042265
  misc_feature 1..90: note = Hypo
  source 1..90: mol_type = genomic DNA

SEQ ID NO: 112295 - DNA, 22 bp, Homo sapiens
  misc_feature 1..22: note = chr16:81111435-81111457
  misc_feature 1..22: note = Hypo
  source 1..22: mol_type = genomic DNA
aggcgcggtggctcacgcctgt

SEQ ID NO: 112296 - DNA, 100 bp, Homo sapiens; identical to SEQ ID NO: 79416
  misc_feature 1..100: note = chr16:81230844-81230944
  misc_feature 1..100: note = Hypo
  source 1..100: mol_type = genomic DNA

SEQ ID NO: 112297 - DNA, 30 bp, Homo sapiens; identical to SEQ ID NO: 16070
  misc_feature 1..30: note = chr16:81533258-81533288
  misc_feature 1..30: note = Hypo
  source 1..30: mol_type = genomic DNA

SEQ ID NO: 112298 - DNA, 52 bp, Homo sapiens; identical to SEQ ID NO: 79418
  misc_feature 1..52: note = chr16:81557303-81557355
  misc_feature 1..52: note = Hypo
  source 1..52: mol_type = genomic DNA

SEQ ID NO: 112299 - DNA, 150 bp, Homo sapiens; identical to SEQ ID NO: 79419
  misc_feature 1..150: note = chr16:81564391-81564541
  misc_feature 1..150: note = Hypo
  source 1..150: mol_type = genomic DNA

SEQ ID NO: 112300 - DNA, 151 bp, Homo sapiens; identical to SEQ ID NO: 44759
  misc_feature 1..151: note = chr16:81569552-81569703
  misc_feature 1..151: note = Hypo
  source 1..151: mol_type = genomic DNA

SEQ ID NO: 112301 - DNA, 30 bp, Homo sapiens; identical to SEQ ID NO: 79424
  misc_feature 1..30: note = chr16:81615132-81615162
  misc_feature 1..30: note = Hypo
  source 1..30: mol_type = genomic DNA

SEQ ID NO: 112302 - DNA, 30 bp, Homo sapiens; identical to SEQ ID NO: 79425
  misc_feature 1..30: note = chr16:81619949-81619979
  misc_feature 1..30: note = Hypo
  source 1..30: mol_type = genomic DNA

SEQ ID NO: 112303 - DNA, 120 bp, Homo sapiens; identical to SEQ ID NO: 79426
  misc_feature 1..120: note = chr16:81627222-81627342
  misc_feature 1..120: note = Hypo
  source 1..120: mol_type = genomic DNA

SEQ ID NO: 112304 - DNA, 200 bp, Homo sapiens; identical to SEQ ID NO: 79427
  misc_feature 1..200: note = chr16:81632912-81633112
  misc_feature 1..200: note = Hypo
  source 1..200: mol_type = genomic DNA

SEQ ID NO: 112305 - DNA, 30 bp, Homo sapiens; identical to SEQ ID NO: 79428
  misc_feature 1..30: note = chr16:81694683-81694713
  misc_feature 1..30: note = Hypo
  source 1..30: mol_type = genomic DNA

SEQ ID NO: 112306 - DNA, 30 bp, Homo sapiens; identical to SEQ ID NO: 79429
  misc_feature 1..30: note = chr16:81700035-81700065
  misc_feature 1..30: note = Hypo
  source 1..30: mol_type = genomic DNA

SEQ ID NO: 112307 - DNA, 30 bp, Homo sapiens; identical to SEQ ID NO: 79430
  misc_feature 1..30: note = chr16:81739542-81739572
  misc_feature 1..30: note = Hypo
  source 1..30: mol_type = genomic DNA

SEQ ID NO: 112308 - DNA, 165 bp, Homo sapiens; identical to SEQ ID NO: 79431
  misc_feature 1..165: note = chr16:81779848-81780013
  misc_feature 1..165: note = Hyper
  source 1..165: mol_type = genomic DNA

SEQ ID NO: 112309 - DNA, 197 bp, Homo sapiens; identical to SEQ ID NO: 79432
  misc_feature 1..197: note = chr16:81813400-81813597
  misc_feature 1..197: note = Hyper
  source 1..197: mol_type = genomic DNA

SEQ ID NO: 112310 - DNA, 30 bp, Homo sapiens; identical to SEQ ID NO: 79433
  misc_feature 1..30: note = chr16:81901263-81901293
  misc_feature 1..30: note = Hypo
  source 1..30: mol_type = genomic DNA

SEQ ID NO: 112311 - DNA, 218 bp, Homo sapiens
  misc_feature 1..218: note = chr16:81929174-81929392
  misc_feature 1..218: note = Hypo
  source 1..218: mol_type = genomic DNA
aaaatgaaaaaaaaagcagcattgaaactagcttgtcttggacagctgcacttgcattatgtaagcgcacagggaaccctgcggatacagggaaagccatgtcctcgtgttggcagccgaatggagggagtgtgggtgtccttgtctagtaactgaactggtgtgtgggccgggggctgacctcggggctgtcagtgaacacacgtggtattgaggct

SEQ ID NO: 112312 - DNA, 30 bp, Homo sapiens; identical to SEQ ID NO: 79438
  misc_feature 1..30: note = chr16:82336003-82336033
  misc_feature 1..30: note = Hypo
  source 1..30: mol_type = genomic DNA

SEQ ID NO: 112313 - DNA, 194 bp, Homo sapiens; identical to SEQ ID NO: 79442
  misc_feature 1..194: note = chr16:82540089-82540283
  misc_feature 1..194: note = Hypo
  source 1..194: mol_type = genomic DNA

SEQ ID NO: 112314 - DNA, 603 bp, Homo sapiens
  misc_feature 1..603: note = chr16:82660301-82660904
  misc_feature 1..603: note = Hyper
  source 1..603: mol_type = genomic DNA
taggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcc

SEQ ID NO: 112315 - DNA, 616 bp, Homo sapiens
  misc_feature 1..616: note = chr16:82661179-82661795
  misc_feature 1..616: note = Hyper
  source 1..616: mol_type = genomic DNA
ctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtccccca

SEQ ID NO: 112316 - DNA, 181 bp, Homo sapiens; identical to SEQ ID NO: 79447
  misc_feature 1..181: note = chr16:83151734-83151915
  misc_feature 1..181: note = Hypo
  source 1..181: mol_type = genomic DNA

SEQ ID NO: 112317 - DNA, 169 bp, Homo sapiens; identical to SEQ ID NO: 79448
  misc_feature 1..169: note = chr16:83197025-83197194
  misc_feature 1..169: note = Hypo
  source 1..169: mol_type = genomic DNA

SEQ ID NO: 112318 - DNA, 30 bp, Homo sapiens; identical to SEQ ID NO: 79450
  misc_feature 1..30: note = chr16:83566510-83566540
  misc_feature 1..30: note = Hypo
  source 1..30: mol_type = genomic DNA

SEQ ID NO: 112319 - DNA, 28 bp, Homo sapiens
  misc_feature 1..28: note = chr16:83670814-83670842
  misc_feature 1..28: note = Hypo
  source 1..28: mol_type = genomic DNA
ttaaaatatcaaaaacgtctaatagaaa

SEQ ID NO: 112320 - DNA, 32 bp, Homo sapiens; identical to SEQ ID NO: 79453
  misc_feature 1..32: note = chr16:83842937-83842969
  misc_feature 1..32: note = Hypo
  source 1..32: mol_type = genomic DNA

SEQ ID NO: 112321 - DNA, 343 bp, Homo sapiens; identical to SEQ ID NO: 79454
  misc_feature 1..343: note = chr16:83968763-83969106
  misc_feature 1..343: note = Hypo
  source 1..343: mol_type = genomic DNA

SEQ ID NO: 112322 - DNA, 162 bp, Homo sapiens; identical to SEQ ID NO: 79455
  misc_feature 1..162: note = chr16:83974810-83974972
  misc_feature 1..162: note = Hypo
  source 1..162: mol_type = genomic DNA

SEQ ID NO: 112323 - DNA, 125 bp, Homo sapiens; identical to SEQ ID NO: 79456
  misc_feature 1..125: note = chr16:84001778-84001903
  misc_feature 1..125: note = Hyper
  source 1..125: mol_type = genomic DNA

SEQ ID NO: 112324 - DNA, 66 bp, Homo sapiens; identical to SEQ ID NO: 79457
  misc_feature 1..66: note = chr16:84002378-84002444
  misc_feature 1..66: note = Hyper
  source 1..66: mol_type = genomic DNA

SEQ ID NO: 112325 - DNA, 30 bp, Homo sapiens; identical to SEQ ID NO: 79458
  misc_feature 1..30: note = chr16:84067071-84067101
  misc_feature 1..30: note = Hypo
  source 1..30: mol_type = genomic DNA

SEQ ID NO: 112326 - DNA, 30 bp, Homo sapiens; identical to SEQ ID NO: 79459
  misc_feature 1..30: note = chr16:84074841-84074871
  misc_feature 1..30: note = Hypo
  source 1..30: mol_type = genomic DNA

SEQ ID NO: 112327 - DNA, 41 bp, Homo sapiens; identical to SEQ ID NO: 16073
  misc_feature 1..41: note = chr16:84075186-84075227
  misc_feature 1..41: note = Hypo
  source 1..41: mol_type = genomic DNA

SEQ ID NO: 112328 - DNA, 30 bp, Homo sapiens; identical to SEQ ID NO: 44764
  misc_feature 1..30: note = chr16:84129364-84129394
  misc_feature 1..30: note = Hypo
  source 1..30: mol_type = genomic DNA

SEQ ID NO: 112329 - DNA, 30 bp, Homo sapiens; identical to SEQ ID NO: 79462
  misc_feature 1..30: note = chr16:84131007-84131037
  misc_feature 1..30: note = Hypo
  source 1..30: mol_type = genomic DNA

SEQ ID NO: 112330 - DNA, 39 bp, Homo sapiens; identical to SEQ ID NO: 79463
  misc_feature 1..39: note = chr16:84148968-84149007
  misc_feature 1..39: note = Hypo
  source 1..39: mol_type = genomic DNA

SEQ ID NO: 112331 - DNA, 30 bp, Homo sapiens; identical to SEQ ID NO: 44765
  misc_feature 1..30: note = chr16:84152910-84152940
  misc_feature 1..30: note = Hypo
  source 1..30: mol_type = genomic DNA

SEQ ID NO: 112332 - DNA, 58 bp, Homo sapiens; identical to SEQ ID NO: 79465
  misc_feature 1..58: note = chr16:84153336-84153394
  misc_feature 1..58: note = Hypo
  source 1..58: mol_type = genomic DNA

SEQ ID NO: 112333 - DNA, 102 bp, Homo sapiens; identical to SEQ ID NO: 79466
  misc_feature 1..102: note = chr16:84328322-84328424
  misc_feature 1..102: note = Hyper
  source 1..102: mol_type = genomic DNA

SEQ ID NO: 112334 - DNA, 398 bp, Homo sapiens; identical to SEQ ID NO: 79467
  misc_feature 1..398: note = chr16:84402023-84402421
  misc_feature 1..398: note = Hyper
  source 1..398: mol_type = genomic DNA

SEQ ID NO: 112335 - DNA, 30 bp, Homo sapiens; identical to SEQ ID NO: 79468
  misc_feature 1..30: note = chr16:84483442-84483472
  misc_feature 1..30: note = Hypo
  source 1..30: mol_type = genomic DNA

SEQ ID NO: 112336 - DNA, 168 bp, Homo sapiens; identical to SEQ ID NO: 79469
  misc_feature 1..168: note = chr16:84573769-84573937
  misc_feature 1..168: note = Hypo
  source 1..168: mol_type = genomic DNA

SEQ ID NO: 112337 - DNA, 30 bp, Homo sapiens; identical to SEQ ID NO: 44767
  misc_feature 1..30: note = chr16:84593218-84593248
  misc_feature 1..30: note = Hypo
  source 1..30: mol_type = genomic DNA

SEQ ID NO: 112338 - DNA, 122 bp, Homo sapiens; identical to SEQ ID NO: 79472
  misc_feature 1..122: note = chr16:84593455-84593577
  misc_feature 1..122: note = Hypo
  source 1..122: mol_type = genomic DNA

SEQ ID NO: 112339 - DNA, 194 bp, Homo sapiens; identical to SEQ ID NO: 79473
  misc_feature 1..194: note = chr16:84633325-84633519
  misc_feature 1..194: note = Hyper
  source 1..194: mol_type = genomic DNA

SEQ ID NO: 112340 - DNA, 142 bp, Homo sapiens; identical to SEQ ID NO: 79475
  misc_feature 1..142: note = chr16:84765227-84765369
  misc_feature 1..142: note = Hypo
  source 1..142: mol_type = genomic DNA

SEQ ID NO: 112341 - DNA, 48 bp, Homo sapiens; identical to SEQ ID NO: 79476
  misc_feature 1..48: note = chr16:84780623-84780671
  misc_feature 1..48: note = Hypo
  source 1..48: mol_type = genomic DNA

SEQ ID NO: 112342 - DNA, 18 bp, Homo sapiens
  misc_feature 1..18: note = chr16:84852343-84852361
  misc_feature 1..18: note = Hypo
  source 1..18: mol_type = genomic DNA
gcccggccagtctgcatt

SEQ ID NO: 112343 - DNA, 297 bp, Homo sapiens; identical to SEQ ID NO: 36283
  misc_feature 1..297: note = chr16:84853364-84853661
  misc_feature 1..297: note = Hyper
  source 1..297: mol_type = genomic DNA

SEQ ID NO: 112344 - DNA, 30 bp, Homo sapiens; identical to SEQ ID NO: 79479
  misc_feature 1..30: note = chr16:84933190-84933220
  misc_feature 1..30: note = Hypo
  source 1..30: mol_type = genomic DNA

SEQ ID NO: 112345 - DNA, 30 bp, Homo sapiens; identical to SEQ ID NO: 79480
  misc_feature 1..30: note = chr16:84998014-84998044
  misc_feature 1..30: note = Hypo
  source 1..30: mol_type = genomic DNA

SEQ ID NO: 112346 - DNA, 60 bp, Homo sapiens; identical to SEQ ID NO: 79481
  misc_feature 1..60: note = chr16:85001619-85001679
  misc_feature 1..60: note = Hypo
  source 1..60: mol_type = genomic DNA

SEQ ID NO: 112347 - DNA, 426 bp, Homo sapiens; identical to SEQ ID NO: 79482
  misc_feature 1..426: note = chr16:85007493-85007919
  misc_feature 1..426: note = Hypo
  source 1..426: mol_type = genomic DNA

SEQ ID NO: 112348 - DNA, 30 bp, Homo sapiens; identical to SEQ ID NO: 44770
  misc_feature 1..30: note = chr16:85010139-85010169
  misc_feature 1..30: note = Hypo
  source 1..30: mol_type = genomic DNA

SEQ ID NO: 112349 - DNA, 173 bp, Homo sapiens; identical to SEQ ID NO: 16076
  misc_feature 1..173: note = chr16:85028164-85028337
  misc_feature 1..173: note = Hypo
  source 1..173: mol_type = genomic DNA

SEQ ID NO: 112350 - DNA, 30 bp, Homo sapiens; identical to SEQ ID NO: 44772
  misc_feature 1..30: note = chr16:85028787-85028817
  misc_feature 1..30: note = Hypo
  source 1..30: mol_type = genomic DNA

SEQ ID NO: 112351 - DNA, 75 bp, Homo sapiens; identical to SEQ ID NO: 79486
  misc_feature 1..75: note = chr16:85033827-85033902
  misc_feature 1..75: note = Hypo
  source 1..75: mol_type = genomic DNA

SEQ ID NO: 112352 - DNA, 212 bp, Homo sapiens; identical to SEQ ID NO: 79487
  misc_feature 1..212: note = chr16:85043907-85044119
  misc_feature 1..212: note = Hypo
  source 1..212: mol_type = genomic DNA

SEQ ID NO: 112353 - DNA, 66 bp, Homo sapiens; identical to SEQ ID NO: 79488
  misc_feature 1..66: note = chr16:85075504-85075570
  misc_feature 1..66: note = Hypo
  source 1..66: mol_type = genomic DNA

SEQ ID NO: 112354 - DNA, 243 bp, Homo sapiens; identical to SEQ ID NO: 79489
  misc_feature 1..243: note = chr16:85083548-85083791
  misc_feature 1..243: note = Hypo
  source 1..243: mol_type = genomic DNA

SEQ ID NO: 112355 - DNA, 72 bp, Homo sapiens; identical to SEQ ID NO: 79490
  misc_feature 1..72: note = chr16:85136820-85136892
  misc_feature 1..72: note = Hypo
  source 1..72: mol_type = genomic DNA

SEQ ID NO: 112356 - DNA, 47 bp, Homo sapiens; identical to SEQ ID NO: 79491
  misc_feature 1..47: note = chr16:85141797-85141844
  misc_feature 1..47: note = Hypo
  source 1..47: mol_type = genomic DNA

SEQ ID NO: 112357 - DNA, 135 bp, Homo sapiens; identical to SEQ ID NO: 79492
  misc_feature 1..135: note = chr16:85147716-85147851
  misc_feature 1..135: note = Hypo
  source 1..135: mol_type = genomic DNA

SEQ ID NO: 112358 - DNA, 207 bp, Homo sapiens; identical to SEQ ID NO: 79494
  misc_feature 1..207: note = chr16:85203399-85203606
  misc_feature 1..207: note = Hyper
  source 1..207: mol_type = genomic DNA

SEQ ID NO: 112359 - DNA, 39 bp, Homo sapiens; identical to SEQ ID NO: 79495
  misc_feature 1..39: note = chr16:85255435-85255474
  misc_feature 1..39: note = Hypo
  source 1..39: mol_type = genomic DNA

SEQ ID NO: 112360 - DNA, 42 bp, Homo sapiens; identical to SEQ ID NO: 79496
  misc_feature 1..42: note = chr16:85264292-85264334
  misc_feature 1..42: note = Hypo
  source 1..42: mol_type = genomic DNA

SEQ ID NO: 112361 - DNA, 137 bp, Homo sapiens; identical to SEQ ID NO: 79497
  misc_feature 1..137: note = chr16:85317660-85317797
  misc_feature 1..137: note = Hypo
  source 1..137: mol_type = genomic DNA

SEQ ID NO: 112362 - DNA, 48 bp, Homo sapiens; identical to SEQ ID NO: 79498
  misc_feature 1..48: note = chr16:85318173-85318221
  misc_feature 1..48: note = Hypo
  source 1..48: mol_type = genomic DNA

SEQ ID NO: 112363 - DNA, 32 bp, Homo sapiens; identical to SEQ ID NO: 79499
  misc_feature 1..32: note = chr16:85328962-85328994
  misc_feature 1..32: note = Hypo
  source 1..32: mol_type = genomic DNA

SEQ ID NO: 112364 - DNA, 239 bp, Homo sapiens; identical to SEQ ID NO: 44779
  misc_feature 1..239: note = chr16:85336342-85336581
  misc_feature 1..239: note = Hypo
  source 1..239: mol_type = genomic DNA

SEQ ID NO: 112365 - DNA, 30 bp, Homo sapiens; identical to SEQ ID NO: 79501
  misc_feature 1..30: note = chr16:85337464-85337494
  misc_feature 1..30: note = Hypo
  source 1..30: mol_type = genomic DNA

SEQ ID NO: 112366 - DNA, 30 bp, Homo sapiens; identical to SEQ ID NO: 79502
  misc_feature 1..30: note = chr16:85369520-85369550
  misc_feature 1..30: note = Hypo
  source 1..30: mol_type = genomic DNA

SEQ ID NO: 112367 - DNA, 30 bp, Homo sapiens; identical to SEQ ID NO: 79503
  misc_feature 1..30: note = chr16:85399740-85399770
  misc_feature 1..30: note = Hypo
  source 1..30: mol_type = genomic DNA

SEQ ID NO: 112368 - DNA, 30 bp, Homo sapiens; identical to SEQ ID NO: 79504
  misc_feature 1..30: note = chr16:85401274-85401304
  misc_feature 1..30: note = Hypo
  source 1..30: mol_type = genomic DNA

SEQ ID NO: 112369 - DNA, 221 bp, Homo sapiens; identical to SEQ ID NO: 79505
  misc_feature 1..221: note = chr16:85427749-85427970
  misc_feature 1..221: note = Hypo
  source 1..221: mol_type = genomic DNA

SEQ ID NO: 112370 - DNA, 100 bp, Homo sapiens; identical to SEQ ID NO: 79506
  misc_feature 1..100: note = chr16:85455150-85455250
  misc_feature 1..100: note = Hypo
  source 1..100: mol_type = genomic DNA

SEQ ID NO: 112371 - DNA, 30 bp, Homo sapiens; identical to SEQ ID NO: 79507
  misc_feature 1..30: note = chr16:85455735-85455765
  misc_feature 1..30: note = Hypo
  source 1..30: mol_type = genomic DNA

SEQ ID NO: 112372 - DNA, 30 bp, Homo sapiens; identical to SEQ ID NO: 79508
  misc_feature 1..30: note = chr16:85462609-85462639
  misc_feature 1..30: note = Hypo
  source 1..30: mol_type = genomic DNA

SEQ ID NO: 112373 - DNA, 82 bp, Homo sapiens; identical to SEQ ID NO: 79509
  misc_feature 1..82: note = chr16:85464220-85464302
  misc_feature 1..82: note = Hypo
  source 1..82: mol_type = genomic DNA

SEQ ID NO: 112374 - DNA, 30 bp, Homo sapiens; identical to SEQ ID NO: 79510
  misc_feature 1..30: note = chr16:85464926-85464956
  misc_feature 1..30: note = Hypo
  source 1..30: mol_type = genomic DNA

SEQ ID NO: 112375 - DNA, 30 bp, Homo sapiens; identical to SEQ ID NO: 79511
  misc_feature 1..30: note = chr16:85478405-85478435
  misc_feature 1..30: note = Hypo
  source 1..30: mol_type = genomic DNA

SEQ ID NO: 112376 - DNA, 30 bp, Homo sapiens; identical to SEQ ID NO: 79512
  misc_feature 1..30: note = chr16:85479322-85479352
  misc_feature 1..30: note = Hypo
  source 1..30: mol_type = genomic DNA

SEQ ID NO: 112377 - DNA, 108 bp, Homo sapiens; identical to SEQ ID NO: 79513
  misc_feature 1..108: note = chr16:85485747-85485855
  misc_feature 1..108: note = Hypo
  source 1..108: mol_type = genomic DNA

SEQ ID NO: 112378 - DNA, 54 bp, Homo sapiens; identical to SEQ ID NO: 79514
  misc_feature 1..54: note = chr16:85496643-85496697
  misc_feature 1..54: note = Hyper
  source 1..54: mol_type = genomic DNA

SEQ ID NO: 112379 - DNA, 30 bp, Homo sapiens; identical to SEQ ID NO: 79515
  misc_feature 1..30: note = chr16:85498216-85498246
  misc_feature 1..30: note = Hypo
  source 1..30: mol_type = genomic DNA

SEQ ID NO: 112380 - DNA, 42 bp, Homo sapiens; identical to SEQ ID NO: 79516
  misc_feature 1..42: note = chr16:85515663-85515705
  misc_feature 1..42: note = Hypo
  source 1..42: mol_type = genomic DNA

SEQ ID NO: 112381 - DNA, 45 bp, Homo sapiens; identical to SEQ ID NO: 44783
  misc_feature 1..45: note = chr16:85516822-85516867
  misc_feature 1..45: note = Hypo
  source 1..45: mol_type = genomic DNA

SEQ ID NO: 112382 - DNA, 402 bp, Homo sapiens; identical to SEQ ID NO: 79518
  misc_feature 1..402: note = chr16:85517218-85517620
  misc_feature 1..402: note = Hypo
  source 1..402: mol_type = genomic DNA

SEQ ID NO: 112383 - DNA, 141 bp, Homo sapiens; identical to SEQ ID NO: 79519
  misc_feature 1..141: note = chr16:85537491-85537632
  misc_feature 1..141: note = Hypo
  source 1..141: mol_type = genomic DNA

SEQ ID NO: 112384 - DNA, 26 bp, Homo sapiens
  misc_feature 1..26: note = chr16:85586238-85586264
  misc_feature 1..26: note = Hypo
  source 1..26: mol_type = genomic DNA
caggtggacctcgatggctgtctcca

SEQ ID NO: 112385 - DNA, 30 bp, Homo sapiens; identical to SEQ ID NO: 79521
  misc_feature 1..30: note = chr16:85612527-85612557
  misc_feature 1..30: note = Hypo
  source 1..30: mol_type = genomic DNA

SEQ ID NO: 112386 - DNA, 70 bp, Homo sapiens; identical to SEQ ID NO: 44786
  misc_feature 1..70: note = chr16:85617748-85617818
  misc_feature 1..70: note = Hypo
  source 1..70: mol_type = genomic DNA

SEQ ID NO: 112387 - DNA, 61 bp, Homo sapiens; identical to SEQ ID NO: 79523
  misc_feature 1..61: note = chr16:85618591-85618652
  misc_feature 1..61: note = Hypo
  source 1..61: mol_type = genomic DNA

SEQ ID NO: 112388 - DNA, 59 bp, Homo sapiens; identical to SEQ ID NO: 79524
  misc_feature 1..59: note = chr16:85627887-85627946
  misc_feature 1..59: note = Hypo
  source 1..59: mol_type = genomic DNA

SEQ ID NO: 112389 - DNA, 30 bp, Homo sapiens; identical to SEQ ID NO: 79525
  misc_feature 1..30: note = chr16:85628473-85628503
  misc_feature 1..30: note = Hypo
  source 1..30: mol_type = genomic DNA

SEQ ID NO: 112390 - DNA, 88 bp, Homo sapiens; identical to SEQ ID NO: 79526
  misc_feature 1..88: note = chr16:85668900-85668988
  misc_feature 1..88: note = Hypo
  source 1..88: mol_type = genomic DNA

SEQ ID NO: 112391 - DNA, 30 bp, Homo sapiens; identical to SEQ ID NO: 79527
  misc_feature 1..30: note = chr16:85669859-85669889
  misc_feature 1..30: note = Hypo
  source 1..30: mol_type = genomic DNA

SEQ ID NO: 112392 - DNA, 347 bp, Homo sapiens; identical to SEQ ID NO: 79528
  misc_feature 1..347: note = chr16:85670998-85671345
  misc_feature 1..347: note = Hypo
  source 1..347: mol_type = genomic DNA

SEQ ID NO: 112393 - DNA, 30 bp, Homo sapiens; identical to SEQ ID NO: 79529
  misc_feature 1..30: note = chr16:85671745-85671775
  misc_feature 1..30: note = Hypo
  source 1..30: mol_type = genomic DNA

SEQ ID NO: 112394 - DNA, 44 bp, Homo sapiens; identical to SEQ ID NO: 79530
  misc_feature 1..44: note = chr16:85672034-85672078
  misc_feature 1..44: note = Hypo
  source 1..44: mol_type = genomic DNA

SEQ ID NO: 112395 - DNA, 55 bp, Homo sapiens; identical to SEQ ID NO: 44789
  misc_feature 1..55: note = chr16:85673184-85673239
  misc_feature 1..55: note = Hypo
  source 1..55: mol_type = genomic DNA

SEQ ID NO: 112396 - DNA, 48 bp, Homo sapiens; identical to SEQ ID NO: 44790
  misc_feature 1..48: note = chr16:85673838-85673886
  misc_feature 1..48: note = Hypo
  source 1..48: mol_type = genomic DNA

SEQ ID NO: 112397 - DNA, 211 bp, Homo sapiens; identical to SEQ ID NO: 79533
  misc_feature 1..211: note = chr16:85674123-85674334
  misc_feature 1..211: note = Hypo
  source 1..211: mol_type = genomic DNA

SEQ ID NO: 112398 - DNA, 644 bp, Homo sapiens; identical to SEQ ID NO: 79534
  misc_feature 1..644: note = chr16:85678117-85678761
  misc_feature 1..644: note = Hypo
  source 1..644: mol_type = genomic DNA

SEQ ID NO: 112399 - DNA, 309 bp, Homo sapiens; identical to SEQ ID NO: 79535
  misc_feature 1..309: note = chr16:85679146-85679455
  misc_feature 1..309: note = Hypo
  source 1..309: mol_type = genomic DNA

SEQ ID NO: 112400 - DNA, 43 bp, Homo sapiens; identical to SEQ ID NO: 79536
  misc_feature 1..43: note = chr16:85679829-85679872
  misc_feature 1..43: note = Hypo
  source 1..43: mol_type = genomic DNA

SEQ ID NO: 112401 - DNA, 624 bp, Homo sapiens; identical to SEQ ID NO: 79537
  misc_feature 1..624: note = chr16:85683970-85684594
  misc_feature 1..624: note = Hypo
  source 1..624: mol_type = genomic DNA

SEQ ID NO: 112402 - DNA, 79 bp, Homo sapiens; identical to SEQ ID NO: 79538
  misc_feature 1..79: note = chr16:85693778-85693857
  misc_feature 1..79: note = Hypo
  source 1..79: mol_type = genomic DNA

SEQ ID NO: 112403 - DNA, 30 bp, Homo sapiens; identical to SEQ ID NO: 79539
  misc_feature 1..30: note = chr16:85698705-85698735
  misc_feature 1..30: note = Hypo
  source 1..30: mol_type = genomic DNA

SEQ ID NO: 112404 - DNA, 200 bp, Homo sapiens; identical to SEQ ID NO: 79540
  misc_feature 1..200: note = chr16:85699645-85699845
  misc_feature 1..200: note = Hypo
  source 1..200: mol_type = genomic DNA

SEQ ID NO: 112405 - DNA, 208 bp, Homo sapiens; identical to SEQ ID NO: 79541
  misc_feature 1..208: note = chr16:85721429-85721637
  misc_feature 1..208: note = Hypo
  source 1..208: mol_type = genomic DNA

SEQ ID NO: 112406 - DNA, 163 bp, Homo sapiens; identical to SEQ ID NO: 44796
  misc_feature 1..163: note = chr16:85731450-85731613
  misc_feature 1..163: note = Hypo
  source 1..163: mol_type = genomic DNA

SEQ ID NO: 112407 - DNA, 234 bp, Homo sapiens; identical to SEQ ID NO: 79543
  misc_feature 1..234: note = chr16:85741334-85741568
  misc_feature 1..234: note = Hypo
  source 1..234: mol_type = genomic DNA

SEQ ID NO: 112408 - DNA, 35 bp, Homo sapiens; identical to SEQ ID NO: 79544
  misc_feature 1..35: note = chr16:85752258-85752293
  misc_feature 1..35: note = Hypo
  source 1..35: mol_type = genomic DNA

SEQ ID NO: 112409 - DNA, 30 bp, Homo sapiens; identical to SEQ ID NO: 44799
  misc_feature 1..30: note = chr16:85758266-85758296
  misc_feature 1..30: note = Hypo
  source 1..30: mol_type = genomic DNA

SEQ ID NO: 112410 - DNA, 32 bp, Homo sapiens; identical to SEQ ID NO: 79546
  misc_feature 1..32: note = chr16:85799033-85799065
  misc_feature 1..32: note = Hypo
  source 1..32: mol_type = genomic DNA

SEQ ID NO: 112411 - DNA, 35 bp, Homo sapiens; identical to SEQ ID NO: 79548
  misc_feature 1..35: note = chr16:85869217-85869252
  misc_feature 1..35: note = Hypo
  source 1..35: mol_type = genomic DNA

SEQ ID NO: 112412 - DNA, 174 bp, Homo sapiens; identical to SEQ ID NO: 79549
  misc_feature 1..174: note = chr16:85873671-85873845
  misc_feature 1..174: note = Hypo
  source 1..174: mol_type = genomic DNA

SEQ ID NO: 112413 - DNA, 30 bp, Homo sapiens; identical to SEQ ID NO: 79550
  misc_feature 1..30: note = chr16:85919965-85919995
  misc_feature 1..30: note = Hypo
  source 1..30: mol_type = genomic DNA

SEQ ID NO: 112414 - DNA, 747 bp, Homo sapiens
  misc_feature 1..747: note = chr16:85932298-85933045
  misc_feature 1..747: note = Hyper
  source 1..747: mol_type = genomic DNA
ccaatatccagcgctcgtgaaggcggagaccggcggggcagctagtttctggctgtggattctgattaatgggccgcaggcgcacggtctgcaccgtccggctcgttgctagtggctcgctcgggagccgccgcactcccggggctgtccgcccgagccggcctggaaggcggaggacgcctccaggtcgctccgcggggcctccggaattcctgggaaagcccccctgcagcgccgcccctggaccccaggtgtgaggagcggggctcggccagcggctccagaagaggcccggaccccactgccgtggctgccgggggcgggaaagtgatttctcggaaagcagagcacttcgaagaaggcgggccgcgcgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggcaggtaggcacagtgggcgggtagggcgcccgtgtcccgcgcggtccggtcccgcggggtccccgacgccaggcggggcgtgggggtggaactacctaccgtaatgtccccgggcgcagctcagtggccacccgtgtccctctctgctttttgcctattttccagccacctaagtccaatctgaatgcccaagtcgttgattgtcgtttgcctgtttcc

SEQ ID NO: 112415 - DNA, 101 bp, Homo sapiens; identical to SEQ ID NO: 79554
  misc_feature 1..101: note = chr16:85952205-85952306
  misc_feature 1..101: note = Hypo
  source 1..101: mol_type = genomic DNA

SEQ ID NO: 112416 - DNA, 30 bp, Homo sapiens; identical to SEQ ID NO: 79555
  misc_feature 1..30: note = chr16:86068336-86068366
  misc_feature 1..30: note = Hypo
  source 1..30: mol_type = genomic DNA

SEQ ID NO: 112417 - DNA, 54 bp, Homo sapiens; identical to SEQ ID NO: 79557
  misc_feature 1..54: note = chr16:86081901-86081955
  misc_feature 1..54: note = Hyper
  source 1..54: mol_type = genomic DNA

SEQ ID NO: 112418 - DNA, 198 bp, Homo sapiens; identical to SEQ ID NO: 79558
  misc_feature 1..198: note = chr16:86092017-86092215
  misc_feature 1..198: note = Hypo
  source 1..198: mol_type = genomic DNA

SEQ ID NO: 112419 - DNA, 30 bp, Homo sapiens; identical to SEQ ID NO: 79559
  misc_feature 1..30: note = chr16:86101131-86101161
  misc_feature 1..30: note = Hypo
  source 1..30: mol_type = genomic DNA

SEQ ID NO: 112420 - DNA, 55 bp, Homo sapiens; identical to SEQ ID NO: 79560
  misc_feature 1..55: note = chr16:86102059-86102114
  misc_feature 1..55: note = Hypo
  source 1..55: mol_type = genomic DNA

SEQ ID NO: 112421 - DNA, 38 bp, Homo sapiens; identical to SEQ ID NO: 79561
  misc_feature 1..38: note = chr16:86115722-86115760
  misc_feature 1..38: note = Hypo
  source 1..38: mol_type = genomic DNA

SEQ ID NO: 112422 - DNA, 55 bp, Homo sapiens; identical to SEQ ID NO: 44800
  misc_feature 1..55: note = chr16:86119064-86119119
  misc_feature 1..55: note = Hypo
  source 1..55: mol_type = genomic DNA

SEQ ID NO: 112423 - DNA, 30 bp, Homo sapiens; identical to SEQ ID NO: 79563
  misc_feature 1..30: note = chr16:86133147-86133177
  misc_feature 1..30: note = Hypo
  source 1..30: mol_type = genomic DNA

SEQ ID NO: 112424 - DNA, 35 bp, Homo sapiens; identical to SEQ ID NO: 79564
  misc_feature 1..35: note = chr16:86141209-86141244
  misc_feature 1..35: note = Hypo
  source 1..35: mol_type = genomic DNA

SEQ ID NO: 112425 - DNA, 30 bp, Homo sapiens; identical to SEQ ID NO: 79565
  misc_feature 1..30: note = chr16:86149152-86149182
  misc_feature 1..30: note = Hypo
  source 1..30: mol_type = genomic DNA

SEQ ID NO: 112426 - DNA, 96 bp, Homo sapiens; identical to SEQ ID NO: 79566
  misc_feature 1..96: note = chr16:86215311-86215407
  misc_feature 1..96: note = Hypo
  source 1..96: mol_type = genomic DNA

SEQ ID NO: 112427 - DNA, 30 bp, Homo sapiens; identical to SEQ ID NO: 79567
  misc_feature 1..30: note = chr16:86216291-86216321
  misc_feature 1..30: note = Hypo
  source 1..30: mol_type = genomic DNA

SEQ ID NO: 112428 - DNA, 803 bp, Homo sapiens
  misc_feature 1..803: note = chr16:86320265-86321068
  misc_feature 1..803: note = Hyper
  source 1..803: mol_type = genomic DNA
aaggggagcccagtgcgcagggctccagaaaccccgaccctcgcaggggagagccagccgaaccagacgtgtgggggcagcagccgccgcggcggtctgggacgcgggtgtcgccttccacgggacttgggtccagggacccaagacggggatctgggaggagggggatgcccttggggcctgagacccgggcggtttccgaagcgaagtagttacccagaaccgctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctccctctgttttctgccccgctcctcagttctgcgctctcctcttctccaggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtctcccttcagagctcctcgtcgtcgtcggagtcatcggaggaccaggaag

SEQ ID NO: 112429 - DNA, 37 bp, Homo sapiens; identical to SEQ ID NO: 79570
  misc_feature 1..37: note = chr16:86334870-86334907
  misc_feature 1..37: note = Hyper
  source 1..37: mol_type = genomic DNA

SEQ ID NO: 112430 - DNA, 789 bp, Homo sapiens
  misc_feature 1..789: note = chr16:86530884-86531673
  misc_feature 1..789: note = Hyper
  source 1..789: mol_type = genomic DNA
cacggccacctacttcgtcgggaaagacagtccagcgcccaccggcccgtgctcgcccgcctgccgagccccgagtcccggcaacgcgccccgggtgctccggtccactcggcacacgccgcgcgcggggctcggccgaggtggcttcgggtggctctgaagcctcggtcttcccggctcccaggacgccccccccgcccccgcccctccattcagcctgtcatctcggccctccgccgcctccggagccccgacggaggtgctgagttgtcaacgcaaattcctagttaagccacttgttgataaaccctctaggcaaattggttccgtctttacctgcccgccccgcccccgcccccggccccagccggcgcgcccctaattgctggaggagctcgacgccggcggcggcctctgcagcgagctaattgagttggaacccgagcggtcttcgttaagccggacgcaaggcggggacgggggaagggggcgggaggtgagacgcagcctgggacctccggcctggggttggaggcccacgcttgctggggtgggcttttggtggaggaagagcaatcatgcggagggctctgccgccgggttaagtggacgcagcgactatctggcggttctcgggggtctgcgttccctggttcacaaccaccccacccccacgcgcctgtgcacatgtccctcccgccgcgcagggtctccgcgggcgcgccccgccccaaatagagcttactacagtaacccgggagtctcacatctgcgcgtcccccacccgcc

SEQ ID NO: 112431 - DNA, 71 bp, Homo sapiens
  misc_feature 1..71: note = chr16:86531946-86532017
  misc_feature 1..71: note = Hyper
  source 1..71: mol_type = genomic DNA
cgccccaaccaatctcgcactgtaagtgcatttcttgggttttccggggaaaagcacggttccagcacccc

SEQ ID NO: 112432 - DNA, 157 bp, Homo sapiens; identical to SEQ ID NO: 79577
  misc_feature 1..157: note = chr16:86537937-86538094
  misc_feature 1..157: note = Hyper
  source 1..157: mol_type = genomic DNA

SEQ ID NO: 112433 - DNA, 526 bp, Homo sapiens
  misc_feature 1..526: note = chr16:86539103-86539629
  misc_feature 1..526: note = Hyper
  source 1..526: mol_type = genomic DNA
cacaaatatccctcccgcgctcctccggcagccgtgaagtttcgtttcccccggccgggtcctccttccctcccttccgaagccccgaggacaggccgcttccctcccgcccagctcccgcgtcgggtcctggctggccgccctaccttgaggcgtcgtttgaacctcgcctcgcggggggttggagggagcgggggcgggcgaggagggcgcgggcccggcgttaatgcggagcgggggcggcggcggccggcggggcggctgccctcgcggtgggtggtcggcggccccctgccccgcccgcgcggccggcctgggctccctcggagcgggatctggttccccgctcgggttacggcgcgctctcggcccgggcggcttcgcttaagcaattagctagtaaaaataccttgggcctggggagtgggagacgttgcagtcgtgtccgtttttacacacccacccccgccctgctcggccagtttcaggattcctggggccagagatggggcgcagatttgttttg

SEQ ID NO: 112434 - DNA, 226 bp, Homo sapiens; identical to SEQ ID NO: 36297
  misc_feature 1..226: note = chr16:86541633-86541859
  misc_feature 1..226: note = Hyper
  source 1..226: mol_type = genomic DNA

SEQ ID NO: 112435 - DNA, 466 bp, Homo sapiens
  misc_feature 1..466: note = chr16:86542207-86542673
  misc_feature 1..466: note = Hyper
  source 1..466: mol_type = genomic DNA
cctggagggagaggccgcgcccggccagcagtcgctgcgagagcagcactcacctgggtctgtgcgcgccgcgatgcgccggggctcctgcgctgtcctgcgctccgctctcggcaccacctttcgtggctccaccgcccccagcccgcacccgagcgctgaggtggcaagggcaggtctgcgtgcgagccccctgcgggctggcagccaggtgcgcgagggccgcccttgccggcgctcccagcccgcgctgtctgctctcaggaacctggcctggcgcgcagtgtcagaggccccgcggcggcggcaggccgagcccacaggggcattaggccaactcccccctcccgccctgcgcacgcggaattctctattattattattaaagaatcccccagaacttgtttacgttaaaccctgtaaacttcctgccagggcctttgccatctctcgggaaatcggaacc

SEQ ID NO: 112436 - DNA, 33 bp, Homo sapiens; identical to SEQ ID NO: 79583
  misc_feature 1..33: note = chr16:86543017-86543050
  misc_feature 1..33: note = Hyper
  source 1..33: mol_type = genomic DNA

SEQ ID NO: 112437 - DNA, 30 bp, Homo sapiens; identical to SEQ ID NO: 79584
  misc_feature 1..30: note = chr16:86543320-86543350
  misc_feature 1..30: note = Hyper
  source 1..30: mol_type = genomic DNA

SEQ ID NO: 112438 - DNA, 199 bp, Homo sapiens; identical to SEQ ID NO: 79585
  misc_feature 1..199: note = chr16:86543623-86543822
  misc_feature 1..199: note = Hyper
  source 1..199: mol_type = genomic DNA

SEQ ID NO: 112439 - DNA, 984 bp, Homo sapiens
  misc_feature 1..984: note = chr16:86544174-86545158
  misc_feature 1..984: note = Hyper
  source 1..984: mol_type = genomic DNA
gatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggtga

SEQ ID NO: 112440 - DNA, 30 bp, Homo sapiens
  misc_feature 1..30: note = chr16:86549567-86549597
  misc_feature 1..30: note = Hyper
  source 1..30: mol_type = genomic DNA
tcatctccttgccttcgcttcagcgggatc

SEQ ID NO: 112441 - DNA, 30 bp, Homo sapiens; identical to SEQ ID NO: 79588
  misc_feature 1..30: note = chr16:86556449-86556479
  misc_feature 1..30: note = Hypo
  source 1..30: mol_type = genomic DNA

SEQ ID NO: 112442 - DNA, 30 bp, Homo sapiens; identical to SEQ ID NO: 79589
  misc_feature 1..30: note = chr16:86564966-86564996
  misc_feature 1..30: note = Hypo
  source 1..30: mol_type = genomic DNA

SEQ ID NO: 112443 - DNA, 30 bp, Homo sapiens; identical to SEQ ID NO: 79590
  misc_feature 1..30: note = chr16:86589626-86589656
  misc_feature 1..30: note = Hypo
  source 1..30: mol_type = genomic DNA

SEQ ID NO: 112444 - DNA, 844 bp, Homo sapiens
  misc_feature 1..844: note = chr16:86599203-86600047
  misc_feature 1..844: note = Hyper
  source 1..844: mol_type = genomic DNA
ccgtttgcaatcaaccgctcacccagtcttcccacggagcgcgctccctaactcaccctacccacccaacaaaacaaaaaaaaggctgaaatatagaaaagcaacttggaggctcccagggggacgttgccaggagcaggaggcagggacagcgccctagggtcggtgttagcggccggcgccggcctgggccacgggaaacgtccacgcttggtgcccgcggtgcgcggcgctcattgcgcgcgccttcgagccaagcccccgcggaaaacaggctcgggtttctcctcgcagggcccaggaactcggctctgcctggcccgggtgggtcgctgcattgtcccggtcttctgggagtgcggggtcagcttgttagagggaatttctacctgggaaaagggagacgagtttcgaagctgaagttggtaggctgcgagtgtccacgcgggagacgaaagggggaaatagcagagtcacttcacccttttccccaaaccccacaaaactgctcgcagcgacgcggatgatctaccgaattccccgcgaattcggaggattaagttgtcagtcagcacgttgctaccttcccctctatgcactccgctgcctggctcctcggcggggagcgagggaaactcagtttgtagggtttacctctaaaacctcgataggttatccttgacgaccccgagcctggaaactccctgttgatgattaattatttgattaaataagtataacatccaggagaggccctgccattccaatccagcgcgtttgctttgaatccattacacctgggcccccataattaggaaatctaattattcgcttcatcactcat

SEQ ID NO: 112445 - DNA, 2264 bp, Homo sapiens
  misc_feature 1..2264: note = chr16:86600250-86602514
  misc_feature 1..2264: note = Hyper
  source 1..2264: mol_type = genomic DNA
gttttcaagtgaagacggagtcgccgcggaggccggggcggcggggtcttagagccgacggattcctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctcagcggggcagccgctcggaccccggcgcgctgaccctcggggctgccgattcgctgggggcttggagagcctcctgcgcccctcctcgcgcgggccgagggtccacctgggtccccaggccgcggcgtctccgctgggtccgcggccgcccgcctgcccgcgctgccgccgccgggtcctggagccagcgaggagcggggccggcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactgacgtgtcccgggacctcccctccccggcccgctccggcttcgcttcccagccccgacccaaccagaca

SEQ ID NO: 112446 - DNA, 36 bp, Homo sapiens
  misc_feature 1..36: note = chr16:86612879-86612915
  misc_feature 1..36: note = Hyper
  source 1..36: mol_type = genomic DNA
cccgcctgcaggcagcgcccgcgggcccctcgcccc

SEQ ID NO: 112447 - DNA, 30 bp, Homo sapiens; identical to SEQ ID NO: 79595
  misc_feature 1..30: note = chr16:86740720-86740750
  misc_feature 1..30: note = Hypo
  source 1..30: mol_type = genomic DNA

SEQ ID NO: 112448 - DNA, 36 bp, Homo sapiens; identical to SEQ ID NO: 79596
  misc_feature 1..36: note = chr16:86741248-86741284
  misc_feature 1..36: note = Hypo
  source 1..36: mol_type = genomic DNA

SEQ ID NO: 112449 - DNA, 91 bp, Homo sapiens; identical to SEQ ID NO: 79597
  misc_feature 1..91: note = chr16:86775015-86775106
  misc_feature 1..91: note = Hyper
  source 1..91: mol_type = genomic DNA

SEQ ID NO: 112450 - DNA, 42 bp, Homo sapiens; identical to SEQ ID NO: 79598
  misc_feature 1..42: note = chr16:86824590-86824632
  misc_feature 1..42: note = Hypo
  source 1..42: mol_type = genomic DNA

SEQ ID NO: 112451 - DNA, 30 bp, Homo sapiens; identical to SEQ ID NO: 79599
  misc_feature 1..30: note = chr16:86828224-86828254
  misc_feature 1..30: note = Hypo
  source 1..30: mol_type = genomic DNA

SEQ ID NO: 112452 - DNA, 279 bp, Homo sapiens; identical to SEQ ID NO: 79600
  misc_feature 1..279: note = chr16:86878223-86878502
  misc_feature 1..279: note = Hypo
  source 1..279: mol_type = genomic DNA

SEQ ID NO: 112453 - DNA, 38 bp, Homo sapiens; identical to SEQ ID NO: 44803
  misc_feature 1..38: note = chr16:86903475-86903513
  misc_feature 1..38: note = Hypo
  source 1..38: mol_type = genomic DNA

SEQ ID NO: 112454 - DNA, 85 bp, Homo sapiens; identical to SEQ ID NO: 79602
  misc_feature 1..85: note = chr16:86950939-86951024
  misc_feature 1..85: note = Hypo
  source 1..85: mol_type = genomic DNA

SEQ ID NO: 112455 - DNA, 30 bp, Homo sapiens; identical to SEQ ID NO: 79603
  misc_feature 1..30: note = chr16:86951460-86951490
  misc_feature 1..30: note = Hypo
  source 1..30: mol_type = genomic DNA

SEQ ID NO: 112456 - DNA, 72 bp, Homo sapiens; identical to SEQ ID NO: 79604
  misc_feature 1..72: note = chr16:86981285-86981357
  misc_feature 1..72: note = Hypo
  source 1..72: mol_type = genomic DNA

SEQ ID NO: 112457 - DNA, 30 bp, Homo sapiens; identical to SEQ ID NO: 79605
  misc_feature 1..30: note = chr16:87020868-87020898
  misc_feature 1..30: note = Hypo
  source 1..30: mol_type = genomic DNA

SEQ ID NO: 112458 - DNA, 88 bp, Homo sapiens; identical to SEQ ID NO: 79606
  misc_feature 1..88: note = chr16:87022637-87022725
  misc_feature 1..88: note = Hypo
  source 1..88: mol_type = genomic DNA

SEQ ID NO: 112459 - DNA, 164 bp, Homo sapiens; identical to SEQ ID NO: 79607
  misc_feature 1..164: note = chr16:87052288-87052452
  misc_feature 1..164: note = Hypo
  source 1..164: mol_type = genomic DNA

SEQ ID NO: 112460 - DNA, 30 bp, Homo sapiens; identical to SEQ ID NO: 79608
  misc_feature 1..30: note = chr16:87091202-87091232
  misc_feature 1..30: note = Hypo
  source 1..30: mol_type = genomic DNA

SEQ ID NO: 112461 - DNA, 245 bp, Homo sapiens; identical to SEQ ID NO: 79609
  misc_feature 1..245: note = chr16:87092376-87092621
  misc_feature 1..245: note = Hypo
  source 1..245: mol_type = genomic DNA

SEQ ID NO: 112462 - DNA, 30 bp, Homo sapiens; identical to SEQ ID NO: 79611
  misc_feature 1..30: note = chr16:87100260-87100290
  misc_feature 1..30: note = Hypo
  source 1..30: mol_type = genomic DNA

SEQ ID NO: 112463 - DNA, 30 bp, Homo sapiens; identical to SEQ ID NO: 79612
  misc_feature 1..30: note = chr16:87106180-87106210
  misc_feature 1..30: note = Hypo
  source 1..30: mol_type = genomic DNA

SEQ ID NO: 112464 - DNA, 54 bp, Homo sapiens; identical to SEQ ID NO: 79613
  misc_feature 1..54: note = chr16:87158485-87158539
  misc_feature 1..54: note = Hypo
  source 1..54: mol_type = genomic DNA

SEQ ID NO: 112465 - DNA, 77 bp, Homo sapiens; identical to SEQ ID NO: 79614
  misc_feature 1..77: note = chr16:87178999-87179076
  misc_feature 1..77: note = Hypo
  source 1..77: mol_type = genomic DNA

SEQ ID NO: 112466 - DNA, 131 bp, Homo sapiens; identical to SEQ ID NO: 79615
  misc_feature 1..131: note = chr16:87186183-87186314
  misc_feature 1..131: note = Hypo
  source 1..131: mol_type = genomic DNA

SEQ ID NO: 112467 - DNA, 247 bp, Homo sapiens; identical to SEQ ID NO: 79616
  misc_feature 1..247: note = chr16:87187799-87188046
  misc_feature 1..247: note = Hypo
  source 1..247: mol_type = genomic DNA

SEQ ID NO: 112468 - DNA, 194 bp, Homo sapiens; identical to SEQ ID NO: 79617
  misc_feature 1..194: note = chr16:87215623-87215817
  misc_feature 1..194: note = Hypo
  source 1..194: mol_type = genomic DNA

SEQ ID NO: 112469 - DNA, 30 bp, Homo sapiens; identical to SEQ ID NO: 79618
  misc_feature 1..30: note = chr16:87221538-87221568
  misc_feature 1..30: note = Hypo
  source 1..30: mol_type = genomic DNA

SEQ ID NO: 112470 - DNA, 30 bp, Homo sapiens; identical to SEQ ID NO: 79619
  misc_feature 1..30: note = chr16:87249934-87249964
  misc_feature 1..30: note = Hypo
  source 1..30: mol_type = genomic DNA

SEQ ID NO: 112471 - DNA, 33 bp, Homo sapiens; identical to SEQ ID NO: 79620
  misc_feature 1..33: note = chr16:87253357-87253390
  misc_feature 1..33: note = Hypo
  source 1..33: mol_type = genomic DNA

SEQ ID NO: 112472 - DNA, 104 bp, Homo sapiens; identical to SEQ ID NO: 79621
  misc_feature 1..104: note = chr16:87262420-87262524
  misc_feature 1..104: note = Hypo
  source 1..104: mol_type = genomic DNA

SEQ ID NO: 112473 - DNA, 30 bp, Homo sapiens; identical to SEQ ID NO: 79622
  misc_feature 1..30: note = chr16:87273793-87273823
  misc_feature 1..30: note = Hypo
  source 1..30: mol_type = genomic DNA

SEQ ID NO: 112474 - DNA, 30 bp, Homo sapiens; identical to SEQ ID NO: 79623
  misc_feature 1..30: note = chr16:87284714-87284744
  misc_feature 1..30: note = Hypo
  source 1..30: mol_type = genomic DNA

SEQ ID NO: 112475 - DNA, 147 bp, Homo sapiens; identical to SEQ ID NO: 16090
  misc_feature 1..147: note = chr16:87296936-87297083
  misc_feature 1..147: note = Hypo
  source 1..147: mol_type = genomic DNA

SEQ ID NO: 112476 - DNA, 40 bp, Homo sapiens; identical to SEQ ID NO: 79625
  misc_feature 1..40: note = chr16:87300104-87300144
  misc_feature 1..40: note = Hypo
  source 1..40: mol_type = genomic DNA

SEQ ID NO: 112477 - DNA, 30 bp, Homo sapiens; identical to SEQ ID NO: 79626
  misc_feature 1..30: note = chr16:87311858-87311888
  misc_feature 1..30: note = Hypo
  source 1..30: mol_type = genomic DNA

SEQ ID NO: 112478 - DNA, 36 bp, Homo sapiens; identical to SEQ ID NO: 79627
  misc_feature 1..36: note = chr16:87312099-87312135
  misc_feature 1..36: note = Hypo
  source 1..36: mol_type = genomic DNA

SEQ ID NO: 112479 - DNA, 135 bp, Homo sapiens; identical to SEQ ID NO: 44808
  misc_feature 1..135: note = chr16:87354991-87355126
  misc_feature 1..135: note = Hypo
  source 1..135: mol_type = genomic DNA

SEQ ID NO: 112480 - DNA, 202 bp, Homo sapiens; identical to SEQ ID NO: 79629
  misc_feature 1..202: note = chr16:87356769-87356971
  misc_feature 1..202: note = Hypo
  source 1..202: mol_type = genomic DNA

SEQ ID NO: 112481 - DNA, 32 bp, Homo sapiens; identical to SEQ ID NO: 79630
  misc_feature 1..32: note = chr16:87418168-87418200
  misc_feature 1..32: note = Hyper
  source 1..32: mol_type = genomic DNA

SEQ ID NO: 112482 - DNA, 85 bp, Homo sapiens; identical to SEQ ID NO: 44810
  misc_feature 1..85: note = chr16:87421370-87421455
  misc_feature 1..85: note = Hypo
  source 1..85: mol_type = genomic DNA

SEQ ID NO: 112483 - DNA, 207 bp, Homo sapiens; identical to SEQ ID NO: 79632
  misc_feature 1..207: note = chr16:87583661-87583868
  misc_feature 1..207: note = Hypo
  source 1..207: mol_type = genomic DNA

SEQ ID NO: 112484 - DNA, 78 bp, Homo sapiens; identical to SEQ ID NO: 79633
  misc_feature 1..78: note = chr16:87584344-87584422
  misc_feature 1..78: note = Hypo
  source 1..78: mol_type = genomic DNA

SEQ ID NO: 112485 - DNA, 146 bp, Homo sapiens; identical to SEQ ID NO: 79634
  misc_feature 1..146: note = chr16:87594957-87595103
  misc_feature 1..146: note = Hypo
  source 1..146: mol_type = genomic DNA

SEQ ID NO: 112486 - DNA, 40 bp, Homo sapiens; identical to SEQ ID NO: 79635
  misc_feature 1..40: note = chr16:87622634-87622674
  misc_feature 1..40: note = Hyper
  source 1..40: mol_type = genomic DNA

SEQ ID NO: 112487 - DNA, 391 bp, Homo sapiens; identical to SEQ ID NO: 79636
  misc_feature 1..391: note = chr16:87635070-87635461
  misc_feature 1..391: note = Hyper
  source 1..391: mol_type = genomic DNA

SEQ ID NO: 112488 - DNA, 87 bp, Homo sapiens; identical to SEQ ID NO: 79637
  misc_feature 1..87: note = chr16:87635740-87635827
  misc_feature 1..87: note = Hyper
  source 1..87: mol_type = genomic DNA

SEQ ID NO: 112489 - DNA, 1123 bp, Homo sapiens
  misc_feature 1..1123: note = chr16:87636197-87637320
  misc_feature 1..1123: note = Hyper
  source 1..1123: mol_type = genomic DNA
gccgccgccgccccgcgcccggcccgcggcccccaatatggtgcagccgccagcgccgccgcccgtgccgccgccgccgcccgcgggccccgccgccgccctcgggcgcccgcagcgcggcagccgcaggtggggggccgcggcccgggcctgagctgccccccgcccggcctcggcgcggcgccctccccgcggggctgccggcgaggggccctctcgccgctgaggtggagccgcgggccccgccgccgccgctcctgccccctccctccctcctcccctccccctcccctccggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtgggg

SEQ ID NO: 112490 - DNA, 193 bp, Homo sapiens; identical to SEQ ID NO: 79641
  misc_feature 1..193: note = chr16:87637541-87637734
  misc_feature 1..193: note = Hyper
  source 1..193: mol_type = genomic DNA

SEQ ID NO: 112491 - DNA, 138 bp, Homo sapiens; identical to SEQ ID NO: 79642
  misc_feature 1..138: note = chr16:87648265-87648403
  misc_feature 1..138: note = Hypo
  source 1..138: mol_type = genomic DNA

SEQ ID NO: 112492 - DNA, 30 bp, Homo sapiens; identical to SEQ ID NO: 79643
  misc_feature 1..30: note = chr16:87657914-87657944
  misc_feature 1..30: note = Hypo
  source 1..30: mol_type = genomic DNA

SEQ ID NO: 112493 - DNA, 36 bp, Homo sapiens; identical to SEQ ID NO: 79644
  misc_feature 1..36: note = chr16:87678053-87678089
  misc_feature 1..36: note = Hypo
  source 1..36: mol_type = genomic DNA

SEQ ID NO: 112494 - DNA, 30 bp, Homo sapiens; identical to SEQ ID NO: 79645
  misc_feature 1..30: note = chr16:87681285-87681315
  misc_feature 1..30: note = Hypo
  source 1..30: mol_type = genomic DNA

SEQ ID NO: 112495 - DNA, 281 bp, Homo sapiens; identical to SEQ ID NO: 79646
  misc_feature 1..281: note = chr16:87688422-87688703
  misc_feature 1..281: note = Hypo
  source 1..281: mol_type = genomic DNA

SEQ ID NO: 112496 - DNA, 30 bp, Homo sapiens; identical to SEQ ID NO: 44814
  misc_feature 1..30: note = chr16:87701846-87701876
  misc_feature 1..30: note = Hypo
  source 1..30: mol_type = genomic DNA

SEQ ID NO: 112497 - DNA, 232 bp, Homo sapiens; identical to SEQ ID NO: 79648
  misc_feature 1..232: note = chr16:87714174-87714406
  misc_feature 1..232: note = Hypo
  source 1..232: mol_type = genomic DNA

SEQ ID NO: 112498 - DNA, 32 bp, Homo sapiens; identical to SEQ ID NO: 79649
  misc_feature 1..32: note = chr16:87718103-87718135
  misc_feature 1..32: note = Hypo
  source 1..32: mol_type = genomic DNA

SEQ ID NO: 112499 - DNA, 30 bp, Homo sapiens; identical to SEQ ID NO: 79650
  misc_feature 1..30: note = chr16:87718416-87718446
  misc_feature 1..30: note = Hypo
  source 1..30: mol_type = genomic DNA

SEQ ID NO: 112500 - DNA, 103 bp, Homo sapiens; identical to SEQ ID NO: 79651
  misc_feature 1..103: note = chr16:87721480-87721583
  misc_feature 1..103: note = Hypo
  source 1..103: mol_type = genomic DNA

SEQ ID NO: 112501 - DNA, 30 bp, Homo sapiens; identical to SEQ ID NO: 79652
  misc_feature 1..30: note = chr16:87722716-87722746
  misc_feature 1..30: note = Hypo
  source 1..30: mol_type = genomic DNA

SEQ ID NO: 112502 - DNA, 1244 bp, Homo sapiens; identical to SEQ ID NO: 79653
  misc_feature 1..1244: note = chr16:87723113-87724357
  misc_feature 1..1244: note = Hypo
  source 1..1244: mol_type = genomic DNA

SEQ ID NO: 112503 - DNA, 20 bp, Homo sapiens
  misc_feature 1..20: note = chr16:87726991-87727011
  misc_feature 1..20: note = Hypo
  source 1..20: mol_type = genomic DNA
tttcttggccaggcacggtg

SEQ ID NO: 112504 - DNA, 30 bp, Homo sapiens; identical to SEQ ID NO: 79655
  misc_feature 1..30: note = chr16:87728594-87728624
  misc_feature 1..30: note = Hypo
  source 1..30: mol_type = genomic DNA

SEQ ID NO: 112505 - DNA, 30 bp, Homo sapiens; identical to SEQ ID NO: 79656
  misc_feature 1..30: note = chr16:87740397-87740427
  misc_feature 1..30: note = Hypo
  source 1..30: mol_type = genomic DNA

SEQ ID NO: 112506 - DNA, 30 bp, Homo sapiens; identical to SEQ ID NO: 79657
  misc_feature 1..30: note = chr16:87740741-87740771
  misc_feature 1..30: note = Hypo
  source 1..30: mol_type = genomic DNA

SEQ ID NO: 112507 - DNA, 78 bp, Homo sapiens; identical to SEQ ID NO: 79660
  misc_feature 1..78: note = chr16:87864575-87864653
  misc_feature 1..78: note = Hypo
  source 1..78: mol_type = genomic DNA

SEQ ID NO: 112508 - DNA, 81 bp, Homo sapiens; identical to SEQ ID NO: 79662
  misc_feature 1..81: note = chr16:87905808-87905889
  misc_feature 1..81: note = Hypo
  source 1..81: mol_type = genomic DNA

SEQ ID NO: 112509 - DNA, 59 bp, Homo sapiens; identical to SEQ ID NO: 79663
  misc_feature 1..59: note = chr16:87911217-87911276
  misc_feature 1..59: note = Hypo
  source 1..59: mol_type = genomic DNA

SEQ ID NO: 112510 - DNA, 60 bp, Homo sapiens; identical to SEQ ID NO: 79664
  misc_feature 1..60: note = chr16:87916269-87916329
  misc_feature 1..60: note = Hypo
  source 1..60: mol_type = genomic DNA

SEQ ID NO: 112511 - DNA, 30 bp, Homo sapiens; identical to SEQ ID NO: 79665
  misc_feature 1..30: note = chr16:87941554-87941584
  misc_feature 1..30: note = Hypo
  source 1..30: mol_type = genomic DNA

SEQ ID NO: 112512 - DNA, 30 bp, Homo sapiens; identical to SEQ ID NO: 79666
  misc_feature 1..30: note = chr16:87960551-87960581
  misc_feature 1..30: note = Hypo
  source 1..30: mol_type = genomic DNA

SEQ ID NO: 112513 - DNA, 30 bp, Homo sapiens; identical to SEQ ID NO: 79667
  misc_feature 1..30: note = chr16:87979832-87979862
  misc_feature 1..30: note = Hypo
  source 1..30: mol_type = genomic DNA

SEQ ID NO: 112514 - DNA, 30 bp, Homo sapiens; identical to SEQ ID NO: 79668
  misc_feature 1..30: note = chr16:88056313-88056343
  misc_feature 1..30: note = Hypo
  source 1..30: mol_type = genomic DNA

SEQ ID NO: 112515 - DNA, 81 bp, Homo sapiens; identical to SEQ ID NO: 79669
  misc_feature 1..81: note = chr16:88092513-88092594
  misc_feature 1..81: note = Hypo
  source 1..81: mol_type = genomic DNA

SEQ ID NO: 112516 - DNA, 30 bp, Homo sapiens; identical to SEQ ID NO: 79670
  misc_feature 1..30: note = chr16:88098353-88098383
  misc_feature 1..30: note = Hypo
  source 1..30: mol_type = genomic DNA

SEQ ID NO: 112517 - DNA, 48 bp, Homo sapiens; identical to SEQ ID NO: 44817
  misc_feature 1..48: note = chr16:88101496-88101544
  misc_feature 1..48: note = Hypo
  source 1..48: mol_type = genomic DNA

SEQ ID NO: 112518 - DNA, 158 bp, Homo sapiens; identical to SEQ ID NO: 79672
  misc_feature 1..158: note = chr16:88101811-88101969
  misc_feature 1..158: note = Hypo
  source 1..158: mol_type = genomic DNA

SEQ ID NO: 112519 - DNA, 66 bp, Homo sapiens; identical to SEQ ID NO: 79673
  misc_feature 1..66: note = chr16:88107013-88107079
  misc_feature 1..66: note = Hypo
  source 1..66: mol_type = genomic DNA

SEQ ID NO: 112520 - DNA, 30 bp, Homo sapiens; identical to SEQ ID NO: 79674
  misc_feature 1..30: note = chr16:88133222-88133252
  misc_feature 1..30: note = Hypo
  source 1..30: mol_type = genomic DNA

SEQ ID NO: 112521 - DNA, 99 bp, Homo sapiens; identical to SEQ ID NO: 79675
  misc_feature 1..99: note = chr16:88137279-88137378
  misc_feature 1..99: note = Hypo
  source 1..99: mol_type = genomic DNA

SEQ ID NO: 112522 - DNA, 47 bp, Homo sapiens; identical to SEQ ID NO: 79676
  misc_feature 1..47: note = chr16:88138197-88138244
  misc_feature 1..47: note = Hypo
  source 1..47: mol_type = genomic DNA

SEQ ID NO: 112523 - DNA, 237 bp, Homo sapiens; identical to SEQ ID NO: 79677
  misc_feature 1..237: note = chr16:88164335-88164572
  misc_feature 1..237: note = Hypo
  source 1..237: mol_type = genomic DNA

SEQ ID NO: 112524 - DNA, 215 bp, Homo sapiens; identical to SEQ ID NO: 79678
  misc_feature 1..215: note = chr16:88165545-88165760
  misc_feature 1..215: note = Hypo
  source 1..215: mol_type = genomic DNA

SEQ ID NO: 112525 - DNA, 30 bp, Homo sapiens; identical to SEQ ID NO: 79679
  misc_feature 1..30: note = chr16:88179063-88179093
  misc_feature 1..30: note = Hypo
  source 1..30: mol_type = genomic DNA

SEQ ID NO: 112526 - DNA, 30 bp, Homo sapiens; identical to SEQ ID NO: 79680
  misc_feature 1..30: note = chr16:88216917-88216947
  misc_feature 1..30: note = Hypo
  source 1..30: mol_type = genomic DNA

SEQ ID NO: 112527 - DNA, 40 bp, Homo sapiens; identical to SEQ ID NO: 79683
  misc_feature 1..40: note = chr16:88261467-88261507
  misc_feature 1..40: note = Hypo
  source 1..40: mol_type = genomic DNA

SEQ ID NO: 112528 - DNA, 30 bp, Homo sapiens; identical to SEQ ID NO: 79684
  misc_feature 1..30: note = chr16:88317274-88317304
  misc_feature 1..30: note = Hypo
  source 1..30: mol_type = genomic DNA

SEQ ID NO: 112529 - DNA, 150 bp, Homo sapiens; identical to SEQ ID NO: 79686
  misc_feature 1..150: note = chr16:88355986-88356136
  misc_feature 1..150: note = Hypo
  source 1..150: mol_type = genomic DNA

SEQ ID NO: 112530 - DNA, 138 bp, Homo sapiens; identical to SEQ ID NO: 79687
  misc_feature 1..138: note = chr16:88358687-88358825
  misc_feature 1..138: note = Hypo
  source 1..138: mol_type = genomic DNA

SEQ ID NO: 112531 - DNA, 30 bp, Homo sapiens; identical to SEQ ID NO: 79689
  misc_feature 1..30: note = chr16:88369078-88369108
  misc_feature 1..30: note = Hypo
  source 1..30: mol_type = genomic DNA

SEQ ID NO: 112532 - DNA, 45 bp, Homo sapiens; identical to SEQ ID NO: 79690
  misc_feature 1..45: note = chr16:88374282-88374327
  misc_feature 1..45: note = Hypo
  source 1..45: mol_type = genomic DNA

SEQ ID NO: 112533 - DNA, 85 bp, Homo sapiens; identical to SEQ ID NO: 44820
  misc_feature 1..85: note = chr16:88375259-88375344
  misc_feature 1..85: note = Hypo
  source 1..85: mol_type = genomic DNA

SEQ ID NO: 112534 - DNA, 180 bp, Homo sapiens; identical to SEQ ID NO: 79692
  misc_feature 1..180: note = chr16:88387108-88387288
  misc_feature 1..180: note = Hypo
  source 1..180: mol_type = genomic DNA

SEQ ID NO: 112535 - DNA, 87 bp, Homo sapiens; identical to SEQ ID NO: 79693
  misc_feature 1..87: note = chr16:88442772-88442859
  misc_feature 1..87: note = Hypo
  source 1..87: mol_type = genomic DNA

SEQ ID NO: 112536 - DNA, 1179 bp, Homo sapiens; identical to SEQ ID NO: 79694
  misc_feature 1..1179: note = chr16:88449274-88450453
  misc_feature 1..1179: note = Hyper
  source 1..1179: mol_type = genomic DNA

SEQ ID NO: 112537 - DNA, 42 bp, Homo sapiens; identical to SEQ ID NO: 79695
  misc_feature 1..42: note = chr16:88460646-88460688
  misc_feature 1..42: note = Hypo
  source 1..42: mol_type = genomic DNA

SEQ ID NO: 112538 - DNA, 39 bp, Homo sapiens; identical to SEQ ID NO: 79696
  misc_feature 1..39: note = chr16:88464766-88464805
  misc_feature 1..39: note = Hypo
  source 1..39: mol_type = genomic DNA

SEQ ID NO: 112539 - DNA, 32 bp, Homo sapiens; identical to SEQ ID NO: 79697
  misc_feature 1..32: note = chr16:88473761-88473793
  misc_feature 1..32: note = Hypo
  source 1..32: mol_type = genomic DNA

SEQ ID NO: 112540 - DNA, 210 bp, Homo sapiens; identical to SEQ ID NO: 79698
  misc_feature 1..210: note = chr16:88476104-88476314
  misc_feature 1..210: note = Hypo
  source 1..210: mol_type = genomic DNA

SEQ ID NO: 112541 - DNA, 41 bp, Homo sapiens; identical to SEQ ID NO: 79699
  misc_feature 1..41: note = chr16:88480893-88480934
  misc_feature 1..41: note = Hypo
  source 1..41: mol_type = genomic DNA

SEQ ID NO: 112542 - DNA, 30 bp, Homo sapiens; identical to SEQ ID NO: 79700
  misc_feature 1..30: note = chr16:88484563-88484593
  misc_feature 1..30: note = Hypo
  source 1..30: mol_type = genomic DNA

SEQ ID NO: 112543 - DNA, 170 bp, Homo sapiens; identical to SEQ ID NO: 44822
  misc_feature 1..170: note = chr16:88495551-88495721
  misc_feature 1..170: note = Hypo
  source 1..170: mol_type = genomic DNA

SEQ ID NO: 112544 - DNA, 112 bp, Homo sapiens
  misc_feature 1..112: note = chr16:88496986-88497098
  misc_feature 1..112: note = Hyper
  source 1..112: mol_type = genomic DNA
aggaagaggaaggctcggggcggcgcctggggcaaggagctcattctgaagatcgtgcagcagaagaacaggcgccaccggcggctggggcggcgggcgggcaggtgcggct

SEQ ID NO: 112545 - DNA, 52 bp, Homo sapiens
  misc_feature 1..52: note = chr16:88497335-88497387
  misc_feature 1..52: note = Hyper
  source 1..52: mol_type = genomic DNA
cgaaccccgaggagccgggcgggtctcgcccgggccccggcaggagccctca

SEQ ID NO: 112546 - DNA, 743 bp, Homo sapiens; identical to SEQ ID NO: 79703
  misc_feature 1..743: note = chr16:88498119-88498862
  misc_feature 1..743: note = Hypo
  source 1..743: mol_type = genomic DNA

SEQ ID NO: 112547 - DNA, 30 bp, Homo sapiens; identical to SEQ ID NO: 79704
  misc_feature 1..30: note = chr16:88501699-88501729
  misc_feature 1..30: note = Hypo
  source 1..30: mol_type = genomic DNA

SEQ ID NO: 112548 - DNA, 207 bp, Homo sapiens; identical to SEQ ID NO: 79705
  misc_feature 1..207: note = chr16:88502150-88502357
  misc_feature 1..207: note = Hypo
  source 1..207: mol_type = genomic DNA

SEQ ID NO: 112549 - DNA, 30 bp, Homo sapiens; identical to SEQ ID NO: 44826
  misc_feature 1..30: note = chr16:88502901-88502931
  misc_feature 1..30: note = Hypo
  source 1..30: mol_type = genomic DNA

SEQ ID NO: 112550 - DNA, 520 bp, Homo sapiens; identical to SEQ ID NO: 79707
  misc_feature 1..520: note = chr16:88503229-88503749
  misc_feature 1..520: note = Hypo
  source 1..520: mol_type = genomic DNA

SEQ ID NO: 112551 - DNA, 763 bp, Homo sapiens; identical to SEQ ID NO: 79708
  misc_feature 1..763: note = chr16:88504017-88504780
  misc_feature 1..763: note = Hypo
  source 1..763: mol_type = genomic DNA

SEQ ID NO: 112552 - DNA, 195 bp, Homo sapiens; identical to SEQ ID NO: 79709
  misc_feature 1..195: note = chr16:88506346-88506541
  misc_feature 1..195: note = Hypo
  source 1..195: mol_type = genomic DNA

SEQ ID NO: 112553 - DNA, 462 bp, Homo sapiens; identical to SEQ ID NO: 79710
  misc_feature 1..462: note = chr16:88506828-88507290
  misc_feature 1..462: note = Hypo
  source 1..462: mol_type = genomic DNA

SEQ ID NO: 112554 - DNA, 160 bp, Homo sapiens; identical to SEQ ID NO: 79711
  misc_feature 1..160: note = chr16:88507982-88508142
  misc_feature 1..160: note = Hypo
  source 1..160: mol_type = genomic DNA

SEQ ID NO: 112555 - DNA, 274 bp, Homo sapiens; identical to SEQ ID NO: 79712
  misc_feature 1..274: note = chr16:88512417-88512691
  misc_feature 1..274: note = Hypo
  source 1..274: mol_type = genomic DNA

SEQ ID NO: 112556 - DNA, 64 bp, Homo sapiens; identical to SEQ ID NO: 79713
  misc_feature 1..64: note = chr16:88534612-88534676
  misc_feature 1..64: note = Hypo
  source 1..64: mol_type = genomic DNA

SEQ ID NO: 112557 - DNA, 30 bp, Homo sapiens; identical to SEQ ID NO: 79714
  misc_feature 1..30: note = chr16:88548193-88548223
  misc_feature 1..30: note = Hypo
  source 1..30: mol_type = genomic DNA

SEQ ID NO: 112558 - DNA, 30 bp, Homo sapiens; identical to SEQ ID NO: 79715
  misc_feature 1..30: note = chr16:88550771-88550801
  misc_feature 1..30: note = Hypo
  source 1..30: mol_type = genomic DNA

SEQ ID NO: 112559 - DNA, 168 bp, Homo sapiens; identical to SEQ ID NO: 79716
  misc_feature 1..168: note = chr16:88551406-88551574
  misc_feature 1..168: note = Hypo
  source 1..168: mol_type = genomic DNA

SEQ ID NO: 112560 - DNA, 30 bp, Homo sapiens; identical to SEQ ID NO: 79717
  misc_feature 1..30: note = chr16:88594593-88594623
  misc_feature 1..30: note = Hypo
  source 1..30: mol_type = genomic DNA

SEQ ID NO: 112561 - DNA, 170 bp, Homo sapiens; identical to SEQ ID NO: 79718
  misc_feature 1..170: note = chr16:88601509-88601679
  misc_feature 1..170: note = Hypo
  source 1..170: mol_type = genomic DNA

SEQ ID NO: 112562 - DNA, 51 bp, Homo sapiens; identical to SEQ ID NO: 44837
  misc_feature 1..51: note = chr16:88602946-88602997
  misc_feature 1..51: note = Hypo
  source 1..51: mol_type = genomic DNA

SEQ ID NO: 112563 - DNA, 80 bp, Homo sapiens; identical to SEQ ID NO: 79720
  misc_feature 1..80: note = chr16:88603696-88603776
  misc_feature 1..80: note = Hypo
  source 1..80: mol_type = genomic DNA

SEQ ID NO: 112564 - DNA, 30 bp, Homo sapiens; identical to SEQ ID NO: 79721
  misc_feature 1..30: note = chr16:88622299-88622329
  misc_feature 1..30: note = Hypo
  source 1..30: mol_type = genomic DNA

SEQ ID NO: 112565 - DNA, 205 bp, Homo sapiens; identical to SEQ ID NO: 79722
  misc_feature 1..205: note = chr16:88623960-88624165
  misc_feature 1..205: note = Hypo
  source 1..205: mol_type = genomic DNA

SEQ ID NO: 112566 - DNA, 19 bp, Homo sapiens
  misc_feature 1..19: note = chr16:88624548-88624567
  misc_feature 1..19: note = Hypo
  source 1..19: mol_type = genomic DNA
aaaatacataaaaggcgga

SEQ ID NO: 112567 - DNA, 559 bp, Homo sapiens; identical to SEQ ID NO: 79724
  misc_feature 1..559: note = chr16:88624747-88625306
  misc_feature 1..559: note = Hypo
  source 1..559: mol_type = genomic DNA

SEQ ID NO: 112568 - DNA, 30 bp, Homo sapiens; identical to SEQ ID NO: 79725
  misc_feature 1..30: note = chr16:88627634-88627664
  misc_feature 1..30: note = Hypo
  source 1..30: mol_type = genomic DNA

SEQ ID NO: 112569 - DNA, 40 bp, Homo sapiens; identical to SEQ ID NO: 79726
  misc_feature 1..40: note = chr16:88629600-88629640
  misc_feature 1..40: note = Hypo
  source 1..40: mol_type = genomic DNA

SEQ ID NO: 112570 - DNA, 95 bp, Homo sapiens; identical to SEQ ID NO: 79727
  misc_feature 1..95: note = chr16:88633091-88633186
  misc_feature 1..95: note = Hypo
  source 1..95: mol_type = genomic DNA

SEQ ID NO: 112571 - DNA, 397 bp, Homo sapiens; identical to SEQ ID NO: 79728
  misc_feature 1..397: note = chr16:88683701-88684098
  misc_feature 1..397: note = Hypo
  source 1..397: mol_type = genomic DNA

SEQ ID NO: 112572 - DNA, 54 bp, Homo sapiens; identical to SEQ ID NO: 79730
  misc_feature 1..54: note = chr16:88709735-88709789
  misc_feature 1..54: note = Hypo
  source 1..54: mol_type = genomic DNA

SEQ ID NO: 112573 - DNA, 491 bp, Homo sapiens; identical to SEQ ID NO: 79731
  misc_feature 1..491: note = chr16:88722326-88722817
  misc_feature 1..491: note = Hypo
  source 1..491: mol_type = genomic DNA

SEQ ID NO: 112574 - DNA, 30 bp, Homo sapiens; identical to SEQ ID NO: 79732
  misc_feature 1..30: note = chr16:88725656-88725686
  misc_feature 1..30: note = Hypo
  source 1..30: mol_type = genomic DNA

SEQ ID NO: 112575 - DNA, 159 bp, Homo sapiens; identical to SEQ ID NO: 79733
  misc_feature 1..159: note = chr16:88757527-88757686
  misc_feature 1..159: note = Hypo
  source 1..159: mol_type = genomic DNA

SEQ ID NO: 112576 - DNA, 30 bp, Homo sapiens; identical to SEQ ID NO: 79734
  misc_feature 1..30: note = chr16:88760519-88760549
  misc_feature 1..30: note = Hypo
  source 1..30: mol_type = genomic DNA

SEQ ID NO: 112577 - DNA, 30 bp, Homo sapiens; identical to SEQ ID NO: 79735
  misc_feature 1..30: note = chr16:88780737-88780767
  misc_feature 1..30: note = Hypo
  source 1..30: mol_type = genomic DNA

SEQ ID NO: 112578 - DNA, 294 bp, Homo sapiens; identical to SEQ ID NO: 79736
  misc_feature 1..294: note = chr16:88791525-88791819
  misc_feature 1..294: note = Hypo
  source 1..294: mol_type = genomic DNA

SEQ ID NO: 112579 - DNA, 398 bp, Homo sapiens; identical to SEQ ID NO: 79737
  misc_feature 1..398: note = chr16:88793275-88793673
  misc_feature 1..398: note = Hypo
  source 1..398: mol_type = genomic DNA

SEQ ID NO: 112580 - DNA, 148 bp, Homo sapiens; identical to SEQ ID NO: 79738
  misc_feature 1..148: note = chr16:88794012-88794160
  misc_feature 1..148: note = Hypo
  source 1..148: mol_type = genomic DNA

SEQ ID NO: 112581 - DNA, 195 bp, Homo sapiens; identical to SEQ ID NO: 79739
  misc_feature 1..195: note = chr16:88794566-88794761
  misc_feature 1..195: note = Hypo
  source 1..195: mol_type = genomic DNA

SEQ ID NO: 112582 - DNA, 30 bp, Homo sapiens; identical to SEQ ID NO: 79740
  misc_feature 1..30: note = chr16:88797788-88797818
  misc_feature 1..30: note = Hypo
  source 1..30: mol_type = genomic DNA

SEQ ID NO: 112583 - DNA, 271 bp, Homo sapiens; identical to SEQ ID NO: 79741
  misc_feature 1..271: note = chr16:88798735-88799006
  misc_feature 1..271: note = Hypo
  source 1..271: mol_type = genomic DNA

SEQ ID NO: 112584 - DNA, 90 bp, Homo sapiens; identical to SEQ ID NO: 79742
  misc_feature 1..90: note = chr16:88800047-88800137
  misc_feature 1..90: note = Hypo
  source 1..90: mol_type = genomic DNA

SEQ ID NO: 112585 - DNA, 52 bp, Homo sapiens; identical to SEQ ID NO: 79743
  misc_feature 1..52: note = chr16:88801866-88801918
  misc_feature 1..52: note = Hypo
  source 1..52: mol_type = genomic DNA

SEQ ID NO: 112586 - DNA, 52 bp, Homo sapiens; identical to SEQ ID NO: 79744
  misc_feature 1..52: note = chr16:88802185-88802237
  misc_feature 1..52: note = Hypo
  source 1..52: mol_type = genomic DNA

SEQ ID NO: 112587 - DNA, 54 bp, Homo sapiens; identical to SEQ ID NO: 79745
  misc_feature 1..54: note = chr16:88802631-88802685
  misc_feature 1..54: note = Hypo
  source 1..54: mol_type = genomic DNA

SEQ ID NO: 112588 - DNA, 197 bp, Homo sapiens; identical to SEQ ID NO: 79746
  misc_feature 1..197: note = chr16:88803266-88803463
  misc_feature 1..197: note = Hypo
  source 1..197: mol_type = genomic DNA

SEQ ID NO: 112589 - DNA, 41 bp, Homo sapiens; identical to SEQ ID NO: 79747
  misc_feature 1..41: note = chr16:88804816-88804857
  misc_feature 1..41: note = Hypo
  source 1..41: mol_type = genomic DNA

SEQ ID NO: 112590 - DNA, 90 bp, Homo sapiens; identical to SEQ ID NO: 79748
  misc_feature 1..90: note = chr16:88805842-88805932
  misc_feature 1..90: note = Hypo
  source 1..90: mol_type = genomic DNA

SEQ ID NO: 112591 - DNA, 30 bp, Homo sapiens; identical to SEQ ID NO: 79749
  misc_feature 1..30: note = chr16:88822251-88822281
  misc_feature 1..30: note = Hypo
  source 1..30: mol_type = genomic DNA

SEQ ID NO: 112592 - DNA, 50 bp, Homo sapiens; identical to SEQ ID NO: 79750
  misc_feature 1..50: note = chr16:88827020-88827070
  misc_feature 1..50: note = Hypo
  source 1..50: mol_type = genomic DNA

SEQ ID NO: 112593 - DNA, 193 bp, Homo sapiens; identical to SEQ ID NO: 79751
  misc_feature 1..193: note = chr16:88827321-88827514
  misc_feature 1..193: note = Hypo
  source 1..193: mol_type = genomic DNA

SEQ ID NO: 112594 - DNA, 67 bp, Homo sapiens; identical to SEQ ID NO: 79752
  misc_feature 1..67: note = chr16:88831230-88831297
  misc_feature 1..67: note = Hypo
  source 1..67: mol_type = genomic DNA

SEQ ID NO: 112595 - DNA, 176 bp, Homo sapiens; identical to SEQ ID NO: 79753
  misc_feature 1..176: note = chr16:88832651-88832827
  misc_feature 1..176: note = Hypo
  source 1..176: mol_type = genomic DNA

SEQ ID NO: 112596 - DNA, 41 bp, Homo sapiens; identical to SEQ ID NO: 79754
  misc_feature 1..41: note = chr16:88871924-88871965
  misc_feature 1..41: note = Hypo
  source 1..41: mol_type = genomic DNA

SEQ ID NO: 112597 - DNA, 30 bp, Homo sapiens; identical to SEQ ID NO: 79755
  misc_feature 1..30: note = chr16:88875855-88875885
  misc_feature 1..30: note = Hypo
  source 1..30: mol_type = genomic DNA

SEQ ID NO: 112598 - DNA, 148 bp, Homo sapiens; identical to SEQ ID NO: 79756
  misc_feature 1..148: note = chr16:88879949-88880097
  misc_feature 1..148: note = Hypo
  source 1..148: mol_type = genomic DNA

SEQ ID NO: 112599 - DNA, 39 bp, Homo sapiens; identical to SEQ ID NO: 79757
  misc_feature 1..39: note = chr16:88880594-88880633
  misc_feature 1..39: note = Hypo
  source 1..39: mol_type = genomic DNA

SEQ ID NO: 112600 - DNA, 33 bp, Homo sapiens; identical to SEQ ID NO: 79758
  misc_feature 1..33: note = chr16:88881413-88881446
  misc_feature 1..33: note = Hypo
  source 1..33: mol_type = genomic DNA

SEQ ID NO: 112601 - DNA, 896 bp, Homo sapiens; identical to SEQ ID NO: 79759
  misc_feature 1..896: note = chr16:88882683-88883579
  misc_feature 1..896: note = Hypo
  source 1..896: mol_type = genomic DNA

SEQ ID NO: 112602 - DNA, 126 bp, Homo sapiens; identical to SEQ ID NO: 79761
  misc_feature 1..126: note = chr16:88884153-88884279
  misc_feature 1..126: note = Hypo
  source 1..126: mol_type = genomic DNA

SEQ ID NO: 112603 - DNA, 34 bp, Homo sapiens; identical to SEQ ID NO: 79762
  misc_feature 1..34: note = chr16:88898821-88898855
  misc_feature 1..34: note = Hypo
  source 1..34: mol_type = genomic DNA

SEQ ID NO: 112604 - DNA, 91 bp, Homo sapiens; identical to SEQ ID NO: 44857
  misc_feature 1..91: note = chr16:88931237-88931328
  misc_feature 1..91: note = Hypo
  source 1..91: mol_type = genomic DNA

SEQ ID NO: 112605 - DNA, 47 bp, Homo sapiens; identical to SEQ ID NO: 79764
  misc_feature 1..47: note = chr16:88933367-88933414
  misc_feature 1..47: note = Hypo
  source 1..47: mol_type = genomic DNA

SEQ ID NO: 112606 - DNA, 30 bp, Homo sapiens; identical to SEQ ID NO: 79765
  misc_feature 1..30: note = chr16:88934321-88934351
  misc_feature 1..30: note = Hypo
  source 1..30: mol_type = genomic DNA

SEQ ID NO: 112607 - DNA, 204 bp, Homo sapiens; identical to SEQ ID NO: 79766
  misc_feature 1..204: note = chr16:88935284-88935488
  misc_feature 1..204: note = Hypo
  source 1..204: mol_type = genomic DNA

SEQ ID NO: 112608 - DNA, 220 bp, Homo sapiens; identical to SEQ ID NO: 79767
  misc_feature 1..220: note = chr16:88941005-88941225
  misc_feature 1..220: note = Hypo
  source 1..220: mol_type = genomic DNA

SEQ ID NO: 112609 - DNA, 126 bp, Homo sapiens; identical to SEQ ID NO: 79768
  misc_feature 1..126: note = chr16:88941444-88941570
  misc_feature 1..126: note = Hypo
  source 1..126: mol_type = genomic DNA

SEQ ID NO: 112610 - DNA, 203 bp, Homo sapiens; identical to SEQ ID NO: 79769
  misc_feature 1..203: note = chr16:88941957-88942160
  misc_feature 1..203: note = Hypo
  source 1..203: mol_type = genomic DNA

SEQ ID NO: 112611 - DNA, 178 bp, Homo sapiens; identical to SEQ ID NO: 79770
  misc_feature 1..178: note = chr16:88943054-88943232
  misc_feature 1..178: note = Hypo
  source 1..178: mol_type = genomic DNA

SEQ ID NO: 112612 - DNA, 615 bp, Homo sapiens; identical to SEQ ID NO: 79771
  misc_feature 1..615: note = chr16:88943442-88944057
  misc_feature 1..615: note = Hypo
  source 1..615: mol_type = genomic DNA

SEQ ID NO: 112613 - DNA, 30 bp, Homo sapiens; identical to SEQ ID NO: 79772
  misc_feature 1..30: note = chr16:88944446-88944476
  misc_feature 1..30: note = Hypo
  source 1..30: mol_type = genomic DNA

SEQ ID NO: 112614 - DNA, 94 bp, Homo sapiens; identical to SEQ ID NO: 79773
  misc_feature 1..94: note = chr16:88944924-88945018
  misc_feature 1..94: note = Hypo
  source 1..94: mol_type = genomic DNA

SEQ ID NO: 112615 - DNA, 711 bp, Homo sapiens; identical to SEQ ID NO: 79774
  misc_feature 1..711: note = chr16:88945368-88946079
  misc_feature 1..711: note = Hypo
  source 1..711: mol_type = genomic DNA

SEQ ID NO: 112616 - DNA, 445 bp, Homo sapiens; identical to SEQ ID NO: 79775
  misc_feature 1..445: note = chr16:88948324-88948769
  misc_feature 1..445: note = Hypo
  source 1..445: mol_type = genomic DNA

SEQ ID NO: 112617 - DNA, 30 bp, Homo sapiens; identical to SEQ ID NO: 79776
  misc_feature 1..30: note = chr16:88951851-88951881
  misc_feature 1..30: note = Hypo
  source 1..30: mol_type = genomic DNA

SEQ ID NO: 112618 - DNA, 624 bp, Homo sapiens; identical to SEQ ID NO: 79777
  misc_feature 1..624: note = chr16:88952174-88952798
  misc_feature 1..624: note = Hypo
  source 1..624: mol_type = genomic DNA

SEQ ID NO: 112619 - DNA, 179 bp, Homo sapiens; identical to SEQ ID NO: 44867
  misc_feature 1..179: note = chr16:88955189-88955368
  misc_feature 1..179: note = Hypo
  source 1..179: mol_type = genomic DNA

SEQ ID NO: 112620 - DNA, 619 bp, Homo sapiens; identical to SEQ ID NO: 79779
  misc_feature 1..619: note = chr16:88956093-88956712
  misc_feature 1..619: note = Hypo
  source 1..619: mol_type = genomic DNA

SEQ ID NO: 112621 - DNA, 622 bp, Homo sapiens; identical to SEQ ID NO: 44870
  misc_feature 1..622: note = chr16:88957373-88957995
  misc_feature 1..622: note = Hypo
  source 1..622: mol_type = genomic DNA

SEQ ID NO: 112622 - DNA, 184 bp, Homo sapiens; identical to SEQ ID NO: 79781
  misc_feature 1..184: note = chr16:88958295-88958479
  misc_feature 1..184: note = Hypo
  source 1..184: mol_type = genomic DNA

SEQ ID NO: 112623 - DNA, 81 bp, Homo sapiens; identical to SEQ ID NO: 79782
  misc_feature 1..81: note = chr16:88958818-88958899
  misc_feature 1..81: note = Hypo
  source 1..81: mol_type = genomic DNA

SEQ ID NO: 112624 - DNA, 111 bp, Homo sapiens; identical to SEQ ID NO: 79783
  misc_feature 1..111: note = chr16:88960414-88960525
  misc_feature 1..111: note = Hypo
  source 1..111: mol_type = genomic DNA

SEQ ID NO: 112625 - DNA, 30 bp, Homo sapiens; identical to SEQ ID NO: 79784
  misc_feature 1..30: note = chr16:88961870-88961900
  misc_feature 1..30: note = Hypo
  source 1..30: mol_type = genomic DNA

SEQ ID NO: 112626 - DNA, 347 bp, Homo sapiens; identical to SEQ ID NO: 79785
  misc_feature 1..347: note = chr16:88962615-88962962
  misc_feature 1..347: note = Hypo
  source 1..347: mol_type = genomic DNA

SEQ ID NO: 112627 - DNA, 586 bp, Homo sapiens; identical to SEQ ID NO: 79786
  misc_feature 1..586: note = chr16:88963177-88963763
  misc_feature 1..586: note = Hypo
  source 1..586: mol_type = genomic DNA

SEQ ID NO: 112628 - DNA, 105 bp, Homo sapiens; identical to SEQ ID NO: 79787
  misc_feature 1..105: note = chr16:88964508-88964613
  misc_feature 1..105: note = Hypo
  source 1..105: mol_type = genomic DNA

SEQ ID NO: 112629 - DNA, 51 bp, Homo sapiens; identical to SEQ ID NO: 79788
  misc_feature 1..51: note = chr16:88965028-88965079
  misc_feature 1..51: note = Hypo
  source 1..51: mol_type = genomic DNA

SEQ ID NO: 112630 - DNA, 45 bp, Homo sapiens; identical to SEQ ID NO: 79789
  misc_feature 1..45: note = chr16:88965602-88965647
  misc_feature 1..45: note = Hypo
  source 1..45: mol_type = genomic DNA

SEQ ID NO: 112631 - DNA, 728 bp, Homo sapiens; identical to SEQ ID NO: 79790
  misc_feature 1..728: note = chr16:88966234-88966962
  misc_feature 1..728: note = Hypo
  source 1..728: mol_type = genomic DNA

SEQ ID NO: 112632 - DNA, 1111 bp, Homo sapiens; identical to SEQ ID NO: 79791
  misc_feature 1..1111: note = chr16:88967701-88968812
  misc_feature 1..1111: note = Hypo
  source 1..1111: mol_type = genomic DNA

SEQ ID NO: 112633 - DNA, 93 bp, Homo sapiens; identical to SEQ ID NO: 79792
  misc_feature 1..93: note = chr16:88970441-88970534
  misc_feature 1..93: note = Hypo
  source 1..93: mol_type = genomic DNA

SEQ ID NO: 112634 - DNA, 131 bp, Homo sapiens; identical to SEQ ID NO: 79793
  misc_feature 1..131: note = chr16:88976603-88976734
  misc_feature 1..131: note = Hypo
  source 1..131: mol_type = genomic DNA

SEQ ID NO: 112635 - DNA, 204 bp, Homo sapiens; identical to SEQ ID NO: 79794
  misc_feature 1..204: note = chr16:88977918-88978122
  misc_feature 1..204: note = Hypo
  source 1..204: mol_type = genomic DNA

SEQ ID NO: 112636 - DNA, 50 bp, Homo sapiens; identical to SEQ ID NO: 79795
  misc_feature 1..50: note = chr16:88978924-88978974
  misc_feature 1..50: note = Hypo
  source 1..50: mol_type = genomic DNA

SEQ ID NO: 112637 - DNA, 30 bp, Homo sapiens; identical to SEQ ID NO: 44881
  misc_feature 1..30: note = chr16:88980132-88980162
  misc_feature 1..30: note = Hypo
  source 1..30: mol_type = genomic DNA

SEQ ID NO: 112638 - DNA, 44 bp, Homo sapiens; identical to SEQ ID NO: 79797
  misc_feature 1..44: note = chr16:88990078-88990122
  misc_feature 1..44: note = Hypo
  source 1..44: mol_type = genomic DNA

SEQ ID NO: 112639 - DNA, 30 bp, Homo sapiens; identical to SEQ ID NO: 79798
  misc_feature 1..30: note = chr16:88990804-88990834
  misc_feature 1..30: note = Hypo
  source 1..30: mol_type = genomic DNA

SEQ ID NO: 112640 - DNA, 30 bp, Homo sapiens; identical to SEQ ID NO: 79799
  misc_feature 1..30: note = chr16:88992350-88992380
  misc_feature 1..30: note = Hypo
  source 1..30: mol_type = genomic DNA

SEQ ID NO: 112641 - DNA, 152 bp, Homo sapiens; identical to SEQ ID NO: 79800
  misc_feature 1..152: note = chr16:88993078-88993230
  misc_feature 1..152: note = Hypo
  source 1..152: mol_type = genomic DNA

SEQ ID NO: 112642 - DNA, 380 bp, Homo sapiens; identical to SEQ ID NO: 79801
  misc_feature 1..380: note = chr16:88994340-88994720
  misc_feature 1..380: note = Hypo
  source 1..380: mol_type = genomic DNA

SEQ ID NO: 112643 - DNA, 71 bp, Homo sapiens; identical to SEQ ID NO: 79802
  misc_feature 1..71: note = chr16:88997925-88997996
  misc_feature 1..71: note = Hypo
  source 1..71: mol_type = genomic DNA

SEQ ID NO: 112644 - DNA, 84 bp, Homo sapiens; identical to SEQ ID NO: 79803
  misc_feature 1..84: note = chr16:88999377-88999461
  misc_feature 1..84: note = Hypo
  source 1..84: mol_type = genomic DNA

SEQ ID NO: 112645 - DNA, 29 bp, Homo sapiens
  misc_feature 1..29: note = chr16:88999664-88999693
  misc_feature 1..29: note = Hypo
  source 1..29: mol_type = genomic DNA
cctcacagtgccacacgtctgcacgcctc

SEQ ID NO: 112646 - DNA, 136 bp, Homo sapiens; identical to SEQ ID NO: 79805
  misc_feature 1..136: note = chr16:89000126-89000262
  misc_feature 1..136: note = Hypo
  source 1..136: mol_type = genomic DNA

SEQ ID NO: 112647 - DNA, 199 bp, Homo sapiens; identical to SEQ ID NO: 79806
  misc_feature 1..199: note = chr16:89000985-89001184
  misc_feature 1..199: note = Hypo
  source 1..199: mol_type = genomic DNA

SEQ ID NO: 112648 - DNA, 249 bp, Homo sapiens; identical to SEQ ID NO: 79807
  misc_feature 1..249: note = chr16:89006347-89006596
  misc_feature 1..249: note = Hyper
  source 1..249: mol_type = genomic DNA

SEQ ID NO: 112649 - DNA, 90 bp, Homo sapiens; identical to SEQ ID NO: 79808
  misc_feature 1..90: note = chr16:89006819-89006909
  misc_feature 1..90: note = Hyper
  source 1..90: mol_type = genomic DNA

SEQ ID NO: 112650 - DNA, 481 bp, Homo sapiens; identical to SEQ ID NO: 79809
  misc_feature 1..481: note = chr16:89007308-89007789
  misc_feature 1..481: note = Hyper
  source 1..481: mol_type = genomic DNA

SEQ ID NO: 112651 - DNA, 224 bp, Homo sapiens; identical to SEQ ID NO: 79810
  misc_feature 1..224: note = chr16:89008368-89008592
  misc_feature 1..224: note = Hyper
  source 1..224: mol_type = genomic DNA

SEQ ID NO: 112652 - DNA, 196 bp, Homo sapiens; identical to SEQ ID NO: 79811
  misc_feature 1..196: note = chr16:89010286-89010482
  misc_feature 1..196: note = Hypo
  source 1..196: mol_type = genomic DNA

SEQ ID NO: 112653 - DNA, 41 bp, Homo sapiens; identical to SEQ ID NO: 79812
  misc_feature 1..41: note = chr16:89015672-89015713
  misc_feature 1..41: note = Hypo
  source 1..41: mol_type = genomic DNA

SEQ ID NO: 112654 - DNA, 30 bp, Homo sapiens; identical to SEQ ID NO: 79813
  misc_feature 1..30: note = chr16:89016452-89016482
  misc_feature 1..30: note = Hypo
  source 1..30: mol_type = genomic DNA

SEQ ID NO: 112655 - DNA, 30 bp, Homo sapiens; identical to SEQ ID NO: 79814
  misc_feature 1..30: note = chr16:89022691-89022721
  misc_feature 1..30: note = Hypo
  source 1..30: mol_type = genomic DNA

SEQ ID NO: 112656 - DNA, 412 bp, Homo sapiens; identical to SEQ ID NO: 79815
  misc_feature 1..412: note = chr16:89025720-89026132
  misc_feature 1..412: note = Hypo
  source 1..412: mol_type = genomic DNA

SEQ ID NO: 112657 - DNA, 114 bp, Homo sapiens; identical to SEQ ID NO: 79816
  misc_feature 1..114: note = chr16:89028699-89028813
  misc_feature 1..114: note = Hypo
  source 1..114: mol_type = genomic DNA

SEQ ID NO: 112658 - DNA, 81 bp, Homo sapiens; identical to SEQ ID NO: 79817
  misc_feature 1..81: note = chr16:89029708-89029789
  misc_feature 1..81: note = Hypo
  source 1..81: mol_type = genomic DNA

SEQ ID NO: 112659 - DNA, 201 bp, Homo sapiens; identical to SEQ ID NO: 79818
  misc_feature 1..201: note = chr16:89029849-89030050
  misc_feature 1..201: note = Hypo
  source 1..201: mol_type = genomic DNA

SEQ ID NO: 112660 - DNA, 163 bp, Homo sapiens; identical to SEQ ID NO: 79819
  misc_feature 1..163: note = chr16:89047584-89047747
  misc_feature 1..163: note = Hypo
  source 1..163: mol_type = genomic DNA

SEQ ID NO: 112661 - DNA, 601 bp, Homo sapiens; identical to SEQ ID NO: 79820
  misc_feature 1..601: note = chr16:89055344-89055945
  misc_feature 1..601: note = Hypo
  source 1..601: mol_type = genomic DNA

SEQ ID NO: 112662 - DNA, 364 bp, Homo sapiens; identical to SEQ ID NO: 79821
  misc_feature 1..364: note = chr16:89072463-89072827
  misc_feature 1..364: note = Hypo
  source 1..364: mol_type = genomic DNA

SEQ ID NO: 112663 - DNA, 192 bp, Homo sapiens; identical to SEQ ID NO: 79822
  misc_feature 1..192: note = chr16:89084022-89084214
  misc_feature 1..192: note = Hypo
  source 1..192: mol_type = genomic DNA

SEQ ID NO: 112664 - DNA, 116 bp, Homo sapiens; identical to SEQ ID NO: 79823
  misc_feature 1..116: note = chr16:89086081-89086197
  misc_feature 1..116: note = Hypo
  source 1..116: mol_type = genomic DNA

SEQ ID NO: 112665 - DNA, 37 bp, Homo sapiens; identical to SEQ ID NO: 79824
  misc_feature 1..37: note = chr16:89088526-89088563
  misc_feature 1..37: note = Hypo
  source 1..37: mol_type = genomic DNA

SEQ ID NO: 112666 - DNA, 30 bp, Homo sapiens; identical to SEQ ID NO: 79825
  misc_feature 1..30: note = chr16:89090173-89090203
  misc_feature 1..30: note = Hypo
  source 1..30: mol_type = genomic DNA

SEQ ID NO: 112667 - DNA, 81 bp, Homo sapiens; identical to SEQ ID NO: 79826
  misc_feature 1..81: note = chr16:89103448-89103529
  misc_feature 1..81: note = Hypo
  source 1..81: mol_type = genomic DNA

SEQ ID NO: 112668 - DNA, 30 bp, Homo sapiens; identical to SEQ ID NO: 79827
  misc_feature 1..30: note = chr16:89103807-89103837
  misc_feature 1..30: note = Hypo
  source 1..30: mol_type = genomic DNA

SEQ ID NO: 112669 - DNA, 59 bp, Homo sapiens; identical to SEQ ID NO: 79828
  misc_feature 1..59: note = chr16:89104048-89104107
  misc_feature 1..59: note = Hyper
  source 1..59: mol_type = genomic DNA

SEQ ID NO: 112670 - DNA, 183 bp, Homo sapiens; identical to SEQ ID NO: 79829
  misc_feature 1..183: note = chr16:89105500-89105683
  misc_feature 1..183: note = Hypo
  source 1..183: mol_type = genomic DNA

SEQ ID NO: 112671 - DNA, 184 bp, Homo sapiens; identical to SEQ ID NO: 79830
  misc_feature 1..184: note = chr16:89107642-89107826
  misc_feature 1..184: note = Hypo
  source 1..184: mol_type = genomic DNA

SEQ ID NO: 112672 - DNA, 39 bp, Homo sapiens; identical to SEQ ID NO: 79831
  misc_feature 1..39: note = chr16:89108941-89108980
  misc_feature 1..39: note = Hypo
  source 1..39: mol_type = genomic DNA

SEQ ID NO: 112673 - DNA, 211 bp, Homo sapiens; identical to SEQ ID NO: 79832
  misc_feature 1..211: note = chr16:89109448-89109659
  misc_feature 1..211: note = Hypo
  source 1..211: mol_type = genomic DNA

SEQ ID NO: 112674 - DNA, 30 bp, Homo sapiens; identical to SEQ ID NO: 44896
  misc_feature 1..30: note = chr16:89110091-89110121
  misc_feature 1..30: note = Hypo
  source 1..30: mol_type = genomic DNA

SEQ ID NO: 112675 - DNA, 116 bp, Homo sapiens; identical to SEQ ID NO: 79834
  misc_feature 1..116: note = chr16:89115281-89115397
  misc_feature 1..116: note = Hypo
  source 1..116: mol_type = genomic DNA

SEQ ID NO: 112676 - DNA, 30 bp, Homo sapiens; identical to SEQ ID NO: 79835
  misc_feature 1..30: note = chr16:89116859-89116889
  misc_feature 1..30: note = Hypo
  source 1..30: mol_type = genomic DNA

SEQ ID NO: 112677 - DNA, 943 bp, Homo sapiens; identical to SEQ ID NO: 79836
  misc_feature 1..943: note = chr16:89119921-89120864
  misc_feature 1..943: note = Hypo
  source 1..943: mol_type = genomic DNA

SEQ ID NO: 112678 - DNA, 30 bp, Homo sapiens; identical to SEQ ID NO: 79837
  misc_feature 1..30: note = chr16:89121266-89121296
  misc_feature 1..30: note = Hypo
  source 1..30: mol_type = genomic DNA

SEQ ID NO: 112679 - DNA, 50 bp, Homo sapiens; identical to SEQ ID NO: 79838
  misc_feature 1..50: note = chr16:89122497-89122547
  misc_feature 1..50: note = Hypo
  source 1..50: mol_type = genomic DNA

SEQ ID NO: 112680 - DNA, 30 bp, Homo sapiens; identical to SEQ ID NO: 79839
  misc_feature 1..30: note = chr16:89131236-89131266
  misc_feature 1..30: note = Hypo
  source 1..30: mol_type = genomic DNA

SEQ ID NO: 112681 - DNA, 192 bp, Homo sapiens; identical to SEQ ID NO: 79840
  misc_feature 1..192: note = chr16:89134608-89134800
  misc_feature 1..192: note = Hypo
  source 1..192: mol_type = genomic DNA

SEQ ID NO: 112682 - DNA, 152 bp, Homo sapiens; identical to SEQ ID NO: 79841
  misc_feature 1..152: note = chr16:89138016-89138168
  misc_feature 1..152: note = Hypo
  source 1..152: mol_type = genomic DNA

SEQ ID NO: 112683 - DNA, 43 bp, Homo sapiens; identical to SEQ ID NO: 79842
  misc_feature 1..43: note = chr16:89139238-89139281
  misc_feature 1..43: note = Hypo
  source 1..43: mol_type = genomic DNA

SEQ ID NO: 112684 - DNA, 25 bp, Homo sapiens
  misc_feature 1..25: note = chr16:89139536-89139561
  misc_feature 1..25: note = Hypo
  source 1..25: mol_type = genomic DNA
cacttacctggagtgcggtggcccc

SEQ ID NO: 112685 - DNA, 104 bp, Homo sapiens; identical to SEQ ID NO: 79844
  misc_feature 1..104: note = chr16:89139951-89140055
  misc_feature 1..104: note = Hypo
  source 1..104: mol_type = genomic DNA

SEQ ID NO: 112686 - DNA, 67 bp, Homo sapiens; identical to SEQ ID NO: 79845
  misc_feature 1..67: note = chr16:89140367-89140434
  misc_feature 1..67: note = Hypo
  source 1..67: mol_type = genomic DNA

SEQ ID NO: 112687 - DNA, 30 bp, Homo sapiens; identical to SEQ ID NO: 44903
  misc_feature 1..30: note = chr16:89141923-89141953
  misc_feature 1..30: note = Hypo
  source 1..30: mol_type = genomic DNA

SEQ ID NO: 112688 - DNA, 88 bp, Homo sapiens; identical to SEQ ID NO: 79847
  misc_feature 1..88: note = chr16:89146026-89146114
  misc_feature 1..88: note = Hypo
  source 1..88: mol_type = genomic DNA

SEQ ID NO: 112689 - DNA, 30 bp, Homo sapiens; identical to SEQ ID NO: 79848
  misc_feature 1..30: note = chr16:89146902-89146932
  misc_feature 1..30: note = Hypo
  source 1..30: mol_type = genomic DNA

SEQ ID NO: 112690 - DNA, 30 bp, Homo sapiens; identical to SEQ ID NO: 79849
  misc_feature 1..30: note = chr16:89156566-89156596
  misc_feature 1..30: note = Hypo
  source 1..30: mol_type = genomic DNA

SEQ ID NO: 112691 - DNA, 30 bp, Homo sapiens; identical to SEQ ID NO: 79851
  misc_feature 1..30: note = chr16:89165849-89165879
  misc_feature 1..30: note = Hypo
  source 1..30: mol_type = genomic DNA

SEQ ID NO: 112692 - DNA, 402 bp, Homo sapiens; identical to SEQ ID NO: 44904
  misc_feature 1..402: note = chr16:89172134-89172536
  misc_feature 1..402: note = Hypo
  source 1..402: mol_type = genomic DNA

SEQ ID NO: 112693 - DNA, 37 bp, Homo sapiens; identical to SEQ ID NO: 79853
  misc_feature 1..37: note = chr16:89184300-89184337
  misc_feature 1..37: note = Hypo
  source 1..37: mol_type = genomic DNA

SEQ ID NO: 112694 - DNA, 81 bp, Homo sapiens; identical to SEQ ID NO: 79854
  misc_feature 1..81: note = chr16:89188334-89188415
  misc_feature 1..81: note = Hypo
  source 1..81: mol_type = genomic DNA

SEQ ID NO: 112695 - DNA, 224 bp, Homo sapiens; identical to SEQ ID NO: 79855
  misc_feature 1..224: note = chr16:89189759-89189983
  misc_feature 1..224: note = Hypo
  source 1..224: mol_type = genomic DNA

SEQ ID NO: 112696 - DNA, 19 bp, Homo sapiens
  misc_feature 1..19: note = chr16:89202477-89202496
  misc_feature 1..19: note = Hypo
  source 1..19: mol_type = genomic DNA
tggccggttcttgtatttt

SEQ ID NO: 112697 - DNA, 192 bp, Homo sapiens
  misc_feature 1..192: note = chr16:89203023-89203215
  misc_feature 1..192: note = Hypo
  source 1..192: mol_type = genomic DNA
acagctgaggatggccgaggccggcctgcagctccccaacggcctcctccgggtcaggatgagaggagaggttgccagctttgatgccagccgctcctgcctcccccacctgcctctgtgcctacagcccgcttctgcctcaagatcacacagcgggcttgtgaggccaggggtctccgctgctgctcaagg

SEQ ID NO: 112698 - DNA, 30 bp, Homo sapiens; identical to SEQ ID NO: 79858
  misc_feature 1..30: note = chr16:89216656-89216686
  misc_feature 1..30: note = Hypo
  source 1..30: mol_type = genomic DNA

SEQ ID NO: 112699 - DNA, 54 bp, Homo sapiens; identical to SEQ ID NO: 44906
  misc_feature 1..54: note = chr16:89219318-89219372
  misc_feature 1..54: note = Hypo
  source 1..54: mol_type = genomic DNA

SEQ ID NO: 112700 - DNA, 94 bp, Homo sapiens; identical to SEQ ID NO: 79860
  misc_feature 1..94: note = chr16:89219597-89219691
  misc_feature 1..94: note = Hypo
  source 1..94: mol_type = genomic DNA

SEQ ID NO: 112701 - DNA, 707 bp, Homo sapiens; identical to SEQ ID NO: 44907
  misc_feature 1..707: note = chr16:89220327-89221034
  misc_feature 1..707: note = Hypo
  source 1..707: mol_type = genomic DNA

SEQ ID NO: 112702 - DNA, 179 bp, Homo sapiens; identical to SEQ ID NO: 79862
  misc_feature 1..179: note = chr16:89225868-89226047
  misc_feature 1..179: note = Hypo
  source 1..179: mol_type = genomic DNA

SEQ ID NO: 112703 - DNA, 458 bp, Homo sapiens; identical to SEQ ID NO: 79863
  misc_feature 1..458: note = chr16:89226262-89226720
  misc_feature 1..458: note = Hypo
  source 1..458: mol_type = genomic DNA

SEQ ID NO: 112704 - DNA, 279 bp, Homo sapiens; identical to SEQ ID NO: 79864
  misc_feature 1..279: note = chr16:89242783-89243062
  misc_feature 1..279: note = Hypo
  source 1..279: mol_type = genomic DNA

SEQ ID NO: 112705 - DNA, 151 bp, Homo sapiens; identical to SEQ ID NO: 44911
  misc_feature 1..151: note = chr16:89245291-89245442
  misc_feature 1..151: note = Hypo
  source 1..151: mol_type = genomic DNA

SEQ ID NO: 112706 - DNA, 143 bp, Homo sapiens; identical to SEQ ID NO: 79866
  misc_feature 1..143: note = chr16:89245643-89245786
  misc_feature 1..143: note = Hypo
  source 1..143: mol_type = genomic DNA

SEQ ID NO: 112707 - DNA, 156 bp, Homo sapiens; identical to SEQ ID NO: 79867
  misc_feature 1..156: note = chr16:89254608-89254764
  misc_feature 1..156: note = Hypo
  source 1..156: mol_type = genomic DNA

SEQ ID NO: 112708 - DNA, 713 bp, Homo sapiens
  misc_feature 1..713: note = chr16:89267222-89267935
  misc_feature 1..713: note = Hyper
  source 1..713: mol_type = genomic DNA
ctagcccagcctctgcgcacctcactgatgggaagcccaccttccccagtctgtgctgaccacgtcagtccctccaagcagagactctgccttggaaagccagcccaaagccacggtctgctgaagacgctggtggtcctgaagcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcaggagcaggcaggggctcgcggctcgcgtgggccccaggcgcgggatggcggcgtccagcagcgcgggtccgcgcagggcgcgcagcgctgggggcaacagcgtggggtccggtcggcagtggggcgcg

SEQ ID NO: 112709 - DNA, 182 bp, Homo sapiens; identical to SEQ ID NO: 79869
  misc_feature 1..182: note = chr16:89268351-89268533
  misc_feature 1..182: note = Hyper
  source 1..182: mol_type = genomic DNA

SEQ ID NO: 112710 - DNA, 178 bp, Homo sapiens; identical to SEQ ID NO: 79870
  misc_feature 1..178: note = chr16:89268813-89268991
  misc_feature 1..178: note = Hyper
  source 1..178: mol_type = genomic DNA

SEQ ID NO: 112711 - DNA, 30 bp, Homo sapiens; identical to SEQ ID NO: 44914
  misc_feature 1..30: note = chr16:89311109-89311139
  misc_feature 1..30: note = Hypo
  source 1..30: mol_type = genomic DNA

SEQ ID NO: 112712 - DNA, 90 bp, Homo sapiens; identical to SEQ ID NO: 79872
  misc_feature 1..90: note = chr16:89313564-89313654
  misc_feature 1..90: note = Hyper
  source 1..90: mol_type = genomic DNA

SEQ ID NO: 112713 - DNA, 39 bp, Homo sapiens; identical to SEQ ID NO: 79873
  misc_feature 1..39: note = chr16:89321968-89322007
  misc_feature 1..39: note = Hypo
  source 1..39: mol_type = genomic DNA

SEQ ID NO: 112714 - DNA, 274 bp, Homo sapiens; identical to SEQ ID NO: 79874
  misc_feature 1..274: note = chr16:89323313-89323587
  misc_feature 1..274: note = Hyper
  source 1..274: mol_type = genomic DNA

SEQ ID NO: 112715 - DNA, 35 bp, Homo sapiens; identical to SEQ ID NO: 79875
  misc_feature 1..35: note = chr16:89360320-89360355
  misc_feature 1..35: note = Hypo
  source 1..35: mol_type = genomic DNA

SEQ ID NO: 112716 - DNA, 121 bp, Homo sapiens; identical to SEQ ID NO: 79876
  misc_feature 1..121: note = chr16:89410313-89410434
  misc_feature 1..121: note = Hypo
  source 1..121: mol_type = genomic DNA

SEQ ID NO: 112717 - DNA, 64 bp, Homo sapiens; identical to SEQ ID NO: 79879
  misc_feature 1..64: note = chr16:89531790-89531854
  misc_feature 1..64: note = Hypo
  source 1..64: mol_type = genomic DNA

SEQ ID NO: 112718 - DNA, 134 bp, Homo sapiens; identical to SEQ ID NO: 44916
  misc_feature 1..134: note = chr16:89558631-89558765
  misc_feature 1..134: note = Hypo
  source 1..134: mol_type = genomic DNA

SEQ ID NO: 112719 - DNA, 42 bp, Homo sapiens; identical to SEQ ID NO: 79881
  misc_feature 1..42: note = chr16:89575654-89575696
  misc_feature 1..42: note = Hypo
  source 1..42: mol_type = genomic DNA

SEQ ID NO: 112720 - DNA, 162 bp, Homo sapiens; identical to SEQ ID NO: 79882
  misc_feature 1..162: note = chr16:89575936-89576098
  misc_feature 1..162: note = Hypo
  source 1..162: mol_type = genomic DNA

SEQ ID NO: 112721 - DNA, 30 bp, Homo sapiens; identical to SEQ ID NO: 79883
  misc_feature 1..30: note = chr16:89622358-89622388
  misc_feature 1..30: note = Hypo
  source 1..30: mol_type = genomic DNA

SEQ ID NO: 112722 - DNA, 27 bp, Homo sapiens
  misc_feature 1..27: note = chr16:89637111-89637138
  misc_feature 1..27: note = Hypo
  source 1..27: mol_type = genomic DNA
acaggaggaggtgagcggggattggag

SEQ ID NO: 112723 - DNA, 287 bp, Homo sapiens; identical to SEQ ID NO: 79886
  misc_feature 1..287: note = chr16:89641417-89641704
  misc_feature 1..287: note = Hyper
  source 1..287: mol_type = genomic DNA

SEQ ID NO: 112724 - DNA, 88 bp, Homo sapiens
  misc_feature 1..88: note = chr16:89642511-89642599
  misc_feature 1..88: note = Hyper
  source 1..88: mol_type = genomic DNA
ccgggccggggctggcgccgagctggggatgcggagaccagagcgggcgcgctgaggccagtggggcgcaaggcggggccccccggag

SEQ ID NO: 112725 - DNA, 45 bp, Homo sapiens; identical to SEQ ID NO: 79889
  misc_feature 1..45: note = chr16:89650665-89650710
  misc_feature 1..45: note = Hypo
  source 1..45: mol_type = genomic DNA

SEQ ID NO: 112726 - DNA, 51 bp, Homo sapiens; identical to SEQ ID NO: 79890
  misc_feature 1..51: note = chr16:89651630-89651681
  misc_feature 1..51: note = Hypo
  source 1..51: mol_type = genomic DNA

SEQ ID NO: 112727 - DNA, 119 bp, Homo sapiens; identical to SEQ ID NO: 79891
  misc_feature 1..119: note = chr16:89655014-89655133
  misc_feature 1..119: note = Hypo
  source 1..119: mol_type = genomic DNA

SEQ ID NO: 112728 - DNA, 30 bp, Homo sapiens; identical to SEQ ID NO: 79892
  misc_feature 1..30: note = chr16:89657693-89657723
  misc_feature 1..30: note = Hypo
  source 1..30: mol_type = genomic DNA

SEQ ID NO: 112729 - DNA, 71 bp, Homo sapiens; identical to SEQ ID NO: 79893
  misc_feature 1..71: note = chr16:89663895-89663966
  misc_feature 1..71: note = Hypo
  source 1..71: mol_type = genomic DNA

SEQ ID NO: 112730 - DNA, 30 bp, Homo sapiens; identical to SEQ ID NO: 44922
  misc_feature 1..30: note = chr16:89667452-89667482
  misc_feature 1..30: note = Hypo
  source 1..30: mol_type = genomic DNA

SEQ ID NO: 112731 - DNA, 96 bp, Homo sapiens; identical to SEQ ID NO: 79895
  misc_feature 1..96: note = chr16:89668332-89668428
  misc_feature 1..96: note = Hypo
  source 1..96: mol_type = genomic DNA

SEQ ID NO: 112732 - DNA, 56 bp, Homo sapiens; identical to SEQ ID NO: 79896
  misc_feature 1..56: note = chr16:89674507-89674563
  misc_feature 1..56: note = Hypo
  source 1..56: mol_type = genomic DNA

SEQ ID NO: 112733 - DNA, 170 bp, Homo sapiens; identical to SEQ ID NO: 79897
  misc_feature 1..170: note = chr16:89688129-89688299
  misc_feature 1..170: note = Hypo
  source 1..170: mol_type = genomic DNA

SEQ ID NO: 112734 - DNA, 402 bp, Homo sapiens; identical to SEQ ID NO: 79898
  misc_feature 1..402: note = chr16:89702599-89703001
  misc_feature 1..402: note = Hypo
  source 1..402: mol_type = genomic DNA

SEQ ID NO: 112735 - DNA, 212 bp, Homo sapiens; identical to SEQ ID NO: 79899
  misc_feature 1..212: note = chr16:89704484-89704696
  misc_feature 1..212: note = Hypo
  source 1..212: mol_type = genomic DNA

SEQ ID NO: 112736 - DNA, 87 bp, Homo sapiens; identical to SEQ ID NO: 79900
  misc_feature 1..87: note = chr16:89713549-89713636
  misc_feature 1..87: note = Hypo
  source 1..87: mol_type = genomic DNA

SEQ ID NO: 112737 - DNA, 17 bp, Homo sapiens
  misc_feature 1..17: note = chr16:89725803-89725820
  misc_feature 1..17: note = Hypo
  source 1..17: mol_type = genomic DNA
gggcgcagtggctcacg

SEQ ID NO: 112738 - DNA, 37 bp, Homo sapiens; identical to SEQ ID NO: 44928
  misc_feature 1..37: note = chr16:89763835-89763872
  misc_feature 1..37: note = Hypo
  source 1..37: mol_type = genomic DNA

SEQ ID NO: 112739 - DNA, 79 bp, Homo sapiens; identical to SEQ ID NO: 79904
  misc_feature 1..79: note = chr16:89778723-89778802
  misc_feature 1..79: note = Hyper
  source 1..79: mol_type = genomic DNA

SEQ ID NO: 112740 - DNA, 92 bp, Homo sapiens; identical to SEQ ID NO: 79906
  misc_feature 1..92: note = chr16:89846148-89846240
  misc_feature 1..92: note = Hypo
  source 1..92: mol_type = genomic DNA

SEQ ID NO: 112741 - DNA, 42 bp, Homo sapiens; identical to SEQ ID NO: 79907
  misc_feature 1..42: note = chr16:89855370-89855412
  misc_feature 1..42: note = Hypo
  source 1..42: mol_type = genomic DNA

SEQ ID NO: 112742 - DNA, 420 bp, Homo sapiens; identical to SEQ ID NO: 79909
  misc_feature 1..420: note = chr16:89883924-89884344
  misc_feature 1..420: note = Hypo
  source 1..420: mol_type = genomic DNA

SEQ ID NO: 112743 - DNA, 93 bp, Homo sapiens; identical to SEQ ID NO: 44930
  misc_feature 1..93: note = chr16:89884896-89884989
  misc_feature 1..93: note = Hypo
  source 1..93: mol_type = genomic DNA

SEQ ID NO: 112744 - DNA, 33 bp, Homo sapiens; identical to SEQ ID NO: 44931
  misc_feature 1..33: note = chr16:89885109-89885142
  misc_feature 1..33: note = Hypo
  source 1..33: mol_type = genomic DNA

SEQ ID NO: 112745 - DNA, 30 bp, Homo sapiens; identical to SEQ ID NO: 44932
  misc_feature 1..30: note = chr16:89896219-89896249
  misc_feature 1..30: note = Hypo
  source 1..30: mol_type = genomic DNA

SEQ ID NO: 112746 - DNA, 852 bp, Homo sapiens; identical to SEQ ID NO: 79913
  misc_feature 1..852: note = chr16:89899963-89900815
  misc_feature 1..852: note = Hypo
  source 1..852: mol_type = genomic DNA

SEQ ID NO: 112747 - DNA, 38 bp, Homo sapiens; identical to SEQ ID NO: 79914
  misc_feature 1..38: note = chr16:89901552-89901590
  misc_feature 1..38: note = Hypo
  source 1..38: mol_type = genomic DNA

SEQ ID NO: 112748 - DNA, 111 bp, Homo sapiens; identical to SEQ ID NO: 79916
  misc_feature 1..111: note = chr16:89972124-89972235
  misc_feature 1..111: note = Hypo
  source 1..111: mol_type = genomic DNA

SEQ ID NO: 112749 - DNA, 126 bp, Homo sapiens
  misc_feature 1..126: note = chr16:89972675-89972801
  misc_feature 1..126: note = Hypo
  source 1..126: mol_type = genomic DNA
tcgctgccctgcccccggtaagggagaaaggctgaaatgggagctctgtgtaagccggtcacatgcacgtcccttctgctccgggcggtccacatgcaggcgtgcgtggtgcgggctccctcagca

SEQ ID NO: 112750 - DNA, 32 bp, Homo sapiens; identical to SEQ ID NO: 79918
  misc_feature 1..32: note = chr16:89985113-89985145
  misc_feature 1..32: note = Hyper
  source 1..32: mol_type = genomic DNA

SEQ ID NO: 112751 - DNA, 161 bp, Homo sapiens; identical to SEQ ID NO: 79919
  misc_feature 1..161: note = chr16:89992858-89993019
  misc_feature 1..161: note = Hyper
  source 1..161: mol_type = genomic DNA

SEQ ID NO: 112752 - DNA, 49 bp, Homo sapiens; identical to SEQ ID NO: 79920
  misc_feature 1..49: note = chr16:90002280-90002329
  misc_feature 1..49: note = Hypo
  source 1..49: mol_type = genomic DNA

SEQ ID NO: 112753 - DNA, 40 bp, Homo sapiens; identical to SEQ ID NO: 44936
  misc_feature 1..40: note = chr16:90037700-90037740
  misc_feature 1..40: note = Hypo
  source 1..40: mol_type = genomic DNA

SEQ ID NO: 112754 - DNA, 30 bp, Homo sapiens; identical to SEQ ID NO: 79922
  misc_feature 1..30: note = chr16:90048779-90048809
  misc_feature 1..30: note = Hypo
  source 1..30: mol_type = genomic DNA

SEQ ID NO: 112755 - DNA, 363 bp, Homo sapiens; identical to SEQ ID NO: 79924
  misc_feature 1..363: note = chr16:90066618-90066981
  misc_feature 1..363: note = Hypo
  source 1..363: mol_type = genomic DNA

SEQ ID NO: 112756 - DNA, 157 bp, Homo sapiens; identical to SEQ ID NO: 79925
  misc_feature 1..157: note = chr16:90069167-90069324
  misc_feature 1..157: note = Hypo
  source 1..157: mol_type = genomic DNA

SEQ ID NO: 112757 - DNA, 144 bp, Homo sapiens; identical to SEQ ID NO: 80431
  misc_feature 1..144: note = chr17:401156-401300
  misc_feature 1..144: note = Hypo
  source 1..144: mol_type = genomic DNA

SEQ ID NO: 112758 - DNA, 35 bp, Homo sapiens; identical to SEQ ID NO: 80729
  misc_feature 1..35: note = chr17:536397-536432
  misc_feature 1..35: note = Hypo
  source 1..35: mol_type = genomic DNA

SEQ ID NO: 112759 - DNA, 37 bp, Homo sapiens; identical to SEQ ID NO: 44939
  misc_feature 1..37: note = chr17:616989-617026
  misc_feature 1..37: note = Hypo
  source 1..37: mol_type = genomic DNA

SEQ ID NO: 112760 - DNA, 30 bp, Homo sapiens; identical to SEQ ID NO: 80908
  misc_feature 1..30: note = chr17:692622-692652
  misc_feature 1..30: note = Hypo
  source 1..30: mol_type = genomic DNA

SEQ ID NO: 112761 - DNA, 57 bp, Homo sapiens; identical to SEQ ID NO: 44940
  misc_feature 1..57: note = chr17:706526-706583
  misc_feature 1..57: note = Hypo
  source 1..57: mol_type = genomic DNA

SEQ ID NO: 112762 - DNA, 77 bp, Homo sapiens; identical to SEQ ID NO: 80931
  misc_feature 1..77: note = chr17:708414-708491
  misc_feature 1..77: note = Hypo
  source 1..77: mol_type = genomic DNA

SEQ ID NO: 112763 - DNA, 190 bp, Homo sapiens; identical to SEQ ID NO: 81095
  misc_feature 1..190: note = chr17:745634-745824
  misc_feature 1..190: note = Hypo
  source 1..190: mol_type = genomic DNA

SEQ ID NO: 112764 - DNA, 30 bp, Homo sapiens; identical to SEQ ID NO: 81518
  misc_feature 1..30: note = chr17:835911-835941
  misc_feature 1..30: note = Hypo
  source 1..30: mol_type = genomic DNA

SEQ ID NO: 112765 - DNA, 30 bp, Homo sapiens; identical to SEQ ID NO: 81526
  misc_feature 1..30: note = chr17:851863-851893
  misc_feature 1..30: note = Hypo
  source 1..30: mol_type = genomic DNA

SEQ ID NO: 112766 - DNA, 80 bp, Homo sapiens; identical to SEQ ID NO: 81534
  misc_feature 1..80: note = chr17:876820-876900
  misc_feature 1..80: note = Hypo
  source 1..80: mol_type = genomic DNA

SEQ ID NO: 112767 - DNA, 63 bp, Homo sapiens; identical to SEQ ID NO: 81548
  misc_feature 1..63: note = chr17:896321-896384
  misc_feature 1..63: note = Hypo
  source 1..63: mol_type = genomic DNA

SEQ ID NO: 112768 - DNA, 426 bp, Homo sapiens; identical to SEQ ID NO: 81553
  misc_feature 1..426: note = chr17:915591-916017
  misc_feature 1..426: note = Hypo
  source 1..426: mol_type = genomic DNA

SEQ ID NO: 112769 - DNA, 192 bp, Homo sapiens; identical to SEQ ID NO: 81554
  misc_feature 1..192: note = chr17:938024-938216
  misc_feature 1..192: note = Hypo
  source 1..192: mol_type = genomic DNA

SEQ ID NO: 112770 - DNA, 47 bp, Homo sapiens; identical to SEQ ID NO: 79969
  misc_feature 1..47: note = chr17:1082429-1082476
  misc_feature 1..47: note = Hyper
  source 1..47: mol_type = genomic DNA

SEQ ID NO: 112771 - DNA, 30 bp, Homo sapiens; identical to SEQ ID NO: 79970
  misc_feature 1..30: note = chr17:1082997-1083027
  misc_feature 1..30: note = Hyper
  source 1..30: mol_type = genomic DNA

SEQ ID NO: 112772 - DNA, 224 bp, Homo sapiens; identical to SEQ ID NO: 79971
  misc_feature 1..224: note = chr17:1083533-1083757
  misc_feature 1..224: note = Hyper
  source 1..224: mol_type = genomic DNA

SEQ ID NO: 112773 - DNA, 30 bp, Homo sapiens; identical to SEQ ID NO: 79974
  misc_feature 1..30: note = chr17:1129316-1129346
  misc_feature 1..30: note = Hypo
  source 1..30: mol_type = genomic DNA

SEQ ID NO: 112774 - DNA, 18 bp, Homo sapiens
  misc_feature 1..18: note = chr17:1134324-1134342
  misc_feature 1..18: note = Hypo
  source 1..18: mol_type = genomic DNA
attgatctaagaggccgg

SEQ ID NO: 112775 - DNA, 87 bp, Homo sapiens; identical to SEQ ID NO: 79976
  misc_feature 1..87: note = chr17:1136675-1136762
  misc_feature 1..87: note = Hypo
  source 1..87: mol_type = genomic DNA

SEQ ID NO: 112776 - DNA, 30 bp, Homo sapiens; identical to SEQ ID NO: 79981
  misc_feature 1..30: note = chr17:1163513-1163543
  misc_feature 1..30: note = Hyper
  source 1..30: mol_type = genomic DNA

SEQ ID NO: 112777 - DNA, 702 bp, Homo sapiens
  misc_feature 1..702: note = chr17:1173853-1174555
  misc_feature 1..702: note = Hyper
  source 1..702: mol_type = genomic DNA
ggccatgctgcggggcgcgccaggactaggcctcacggcgcggaagggggccgaggactctgcggaggacttggggggcccctgccccgagcccgggggcgattcgggggtgctgggggcgaacggcgcttcctgcagccggggcgaggcggaggagccggcgggcaggaggcgcgcgcggccggtgcggtccaaggcgcggcgcatggccgccaacgtgcgggagcgcaagcgcatcctagactacaacgaggccttcaacgcgctgcgccgggcgctgcggcacgacctgggcggcaagaggctctccaagatcgccacgctgcgcagggccatccaccgcatcgccgcgctctccctggtcctgcgcgccagccccgcgccccgcgggccctgcggacacctggagtgccacggcccggccgcgcgcggggacaccggggacacaggcgccagccccccgccgcctgcagggcccagcctcgcgcgcccagacgccgcccgcccctcggtgccgtccgcgccccgctgcgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatgggccatcc

SEQ ID NO: 112778 - DNA, 30 bp, Homo sapiens; identical to SEQ ID NO: 79986
  misc_feature 1..30: note = chr17:1180688-1180718
  misc_feature 1..30: note = Hypo
  source 1..30: mol_type = genomic DNA

SEQ ID NO: 112779 - DNA, 30 bp, Homo sapiens; identical to SEQ ID NO: 44946
  misc_feature 1..30: note = chr17:1193094-1193124
  misc_feature 1..30: note = Hypo
  source 1..30: mol_type = genomic DNA

SEQ ID NO: 112780 - DNA, 196 bp, Homo sapiens; identical to SEQ ID NO: 80003
  misc_feature 1..196: note = chr17:1387714-1387910
  misc_feature 1..196: note = Hypo
  source 1..196: mol_type = genomic DNA

SEQ ID NO: 112781 - DNA, 73 bp, Homo sapiens; identical to SEQ ID NO: 80004
  misc_feature 1..73: note = chr17:1412390-1412463
  misc_feature 1..73: note = Hypo
  source 1..73: mol_type = genomic DNA

SEQ ID NO: 112782 - DNA, 18 bp, Homo sapiens
  misc_feature 1..18: note = chr17:1471448-1471466
  misc_feature 1..18: note = Hypo
  source 1..18: mol_type = genomic DNA
acccggccactctttcat

SEQ ID NO: 112783 - DNA, 30 bp, Homo sapiens; identical to SEQ ID NO: 80014
  misc_feature 1..30: note = chr17:1472708-1472738
  misc_feature 1..30: note = Hypo
  source 1..30: mol_type = genomic DNA

SEQ ID NO: 112784 - DNA, 18 bp, Homo sapiens
  misc_feature 1..18: note = chr17:1479669-1479687
  misc_feature 1..18: note = Hypo
  source 1..18: mol_type = genomic DNA
gcccggcccaggaactct

SEQ ID NO: 112785 - DNA, 38 bp, Homo sapiens; identical to SEQ ID NO: 80018
  misc_feature 1..38: note = chr17:1501153-1501191
  misc_feature 1..38: note = Hypo
  source 1..38: mol_type = genomic DNA

SEQ ID NO: 112786 - DNA, 25 bp, Homo sapiens
  misc_feature 1..25: note = chr17:1520973-1520998
  misc_feature 1..25: note = Hypo
  source 1..25: mol_type = genomic DNA
cacacccagccgatatgcacctttc

SEQ ID NO: 112787 - DNA, 23 bp, Homo sapiens
  misc_feature 1..23: note = chr17:1536225-1536248
  misc_feature 1..23: note = Hypo
  source 1..23: mol_type = genomic DNA
atatccaggatatgtcgttaagt

SEQ ID NO: 112788 - DNA, 40 bp, Homo sapiens; identical to SEQ ID NO: 80027
  misc_feature 1..40: note = chr17:1543656-1543696
  misc_feature 1..40: note = Hypo
  source 1..40: mol_type = genomic DNA

SEQ ID NO: 112789 - DNA, 49 bp, Homo sapiens; identical to SEQ ID NO: 44952
  misc_feature 1..49: note = chr17:1543917-1543966
  misc_feature 1..49: note = Hypo
  source 1..49: mol_type = genomic DNA

SEQ ID NO: 112790 - DNA, 386 bp, Homo sapiens; identical to SEQ ID NO: 80029
  misc_feature 1..386: note = chr17:1544223-1544609
  misc_feature 1..386: note = Hypo
  source 1..386: mol_type = genomic DNA

SEQ ID NO: 112791 - DNA, 21 bp, Homo sapiens
  misc_feature 1..21: note = chr17:1545300-1545321
  misc_feature 1..21: note = Hypo
  source 1..21: mol_type = genomic DNA
ccaccgcgcccagccagggat

SEQ ID NO: 112792 - DNA, 139 bp, Homo sapiens; identical to SEQ ID NO: 44955
  misc_feature 1..139: note = chr17:1546311-1546450
  misc_feature 1..139: note = Hypo
  source 1..139: mol_type = genomic DNA

SEQ ID NO: 112793 - DNA, 38 bp, Homo sapiens; identical to SEQ ID NO: 80038
  misc_feature 1..38: note = chr17:1589533-1589571
  misc_feature 1..38: note = Hypo
  source 1..38: mol_type = genomic DNA

SEQ ID NO: 112794 - DNA, 24 bp, Homo sapiens
  misc_feature 1..24: note = chr17:1608003-1608027
  misc_feature 1..24: note = Hypo
  source 1..24: mol_type = genomic DNA
tttttttttttgagacggagtctc

SEQ ID NO: 112795 - DNA, 80 bp, Homo sapiens; identical to SEQ ID NO: 80040
  misc_feature 1..80: note = chr17:1623392-1623472
  misc_feature 1..80: note = Hypo
  source 1..80: mol_type = genomic DNA

SEQ ID NO: 112796 - DNA, 32 bp, Homo sapiens; identical to SEQ ID NO: 44956
  misc_feature 1..32: note = chr17:1623703-1623735
  misc_feature 1..32: note = Hypo
  source 1..32: mol_type = genomic DNA

SEQ ID NO: 112797 - DNA, 142 bp, Homo sapiens; identical to SEQ ID NO: 80044
  misc_feature 1..142: note = chr17:1627248-1627390
  misc_feature 1..142: note = Hypo
  source 1..142: mol_type = genomic DNA

SEQ ID NO: 112798 - DNA, 30 bp, Homo sapiens; identical to SEQ ID NO: 80055
  misc_feature 1..30: note = chr17:1675342-1675372
  misc_feature 1..30: note = Hypo
  source 1..30: mol_type = genomic DNA

SEQ ID NO: 112799 - DNA, 16 bp, Homo sapiens
  misc_feature 1..16: note = chr17:1696340-1696356
  misc_feature 1..16: note = Hypo
  source 1..16: mol_type = genomic DNA
agctgagaccacaagc

SEQ ID NO: 112800 - DNA, 48 bp, Homo sapiens; identical to SEQ ID NO: 80081
  misc_feature 1..48: note = chr17:1811643-1811691
  misc_feature 1..48: note = Hyper
  source 1..48: mol_type = genomic DNA

SEQ ID NO: 112801 - DNA, 222 bp, Homo sapiens; identical to SEQ ID NO: 80085
  misc_feature 1..222: note = chr17:1819556-1819778
  misc_feature 1..222: note = Hypo
  source 1..222: mol_type = genomic DNA

SEQ ID NO: 112802 - DNA, 30 bp, Homo sapiens; identical to SEQ ID NO: 80086
  misc_feature 1..30: note = chr17:1824581-1824611
  misc_feature 1..30: note = Hypo
  source 1..30: mol_type = genomic DNA

SEQ ID NO: 112803 - DNA, 86 bp, Homo sapiens; identical to SEQ ID NO: 80089
  misc_feature 1..86: note = chr17:1832993-1833079
  misc_feature 1..86: note = Hypo
  source 1..86: mol_type = genomic DNA

SEQ ID NO: 112804 - DNA, 43 bp, Homo sapiens; identical to SEQ ID NO: 80090
  misc_feature 1..43: note = chr17:1835919-1835962
  misc_feature 1..43: note = Hypo
  source 1..43: mol_type = genomic DNA

SEQ ID NO: 112805 - DNA, 30 bp, Homo sapiens; identical to SEQ ID NO: 80094
  misc_feature 1..30: note = chr17:1887214-1887244
  misc_feature 1..30: note = Hypo
  source 1..30: mol_type = genomic DNA

SEQ ID NO: 112806 - DNA, 477 bp, Homo sapiens
  misc_feature 1..477: note = chr17:1901493-1901970
  misc_feature 1..477: note = Hyper
  source 1..477: mol_type = genomic DNA
cctttgggggaggggcggggagggctgtcgcattgatccggagctgcagggcgagggcggtgcccagacccggcgccccaaggcctcccgcaggccgacccgagccgagcgcgccctttgggcaccggccccgcccgggagggtcttctcgctctagagccgggggcccgcgctgagagatcggggttaccgcgcggggagccgcggccgcgctgggatccgttccctctcgcgggagccgccggccggggatctgcgcaccccacgcgccccgctcgggtcgggcctcccctccccgcggctgcccccgggccggccaccgctgcccagcgcgcaggtccctgccggatccccggcggctttcctgcccccactttacagacgtgaacgctgaggcggagggtgggggacgtggggccggctcgcctcctcctgggctcgccgggatgtggcctccgaggtcgccgcggcgctttc

SEQ ID NO: 112807 - DNA, 300 bp, Homo sapiens; identical to SEQ ID NO: 80100
  misc_feature 1..300: note = chr17:1927406-1927706
  misc_feature 1..300: note = Hyper
  source 1..300: mol_type = genomic DNA

SEQ ID NO: 112808 - DNA, 290 bp, Homo sapiens; identical to SEQ ID NO: 80101
  misc_feature 1..290: note = chr17:1927990-1928280
  misc_feature 1..290: note = Hyper
  source 1..290: mol_type = genomic DNA

SEQ ID NO: 112809 - DNA, 262 bp, Homo sapiens; identical to SEQ ID NO: 80105
  misc_feature 1..262: note = chr17:1956915-1957177
  misc_feature 1..262: note = Hyper
  source 1..262: mol_type = genomic DNA

SEQ ID NO: 112810 - DNA, 115 bp, Homo sapiens; identical to SEQ ID NO: 80106
  misc_feature 1..115: note = chr17:1957480-1957595
  misc_feature 1..115: note = Hyper
  source 1..115: mol_type = genomic DNA

SEQ ID NO: 112811 - DNA, 692 bp, Homo sapiens
  misc_feature 1..692: note = chr17:1958942-1959634
  misc_feature 1..692: note = Hyper
  source 1..692: mol_type = genomic DNA
gggccaggaggggaacggggtcgggcgggcgagcagcgggcaggggagctcagggctcggctccgggctctgccgccggatttgggggccgcgaggaagagctgcgagccgagggcctggggccggcgcactcctcccgccctgtctgcagttggaaaacttttccccaagtttggggcggcggagttccgggggagaaggggccgggggagccgcggagggaggcgccgggcccgcgcgtgtagggcccaggccgaggccgggacgcgggtggggcgcaggcccgggtcagggccgcagccggctgtgcgccgtgcccgcccggggcgctgccccctccctcccctgggagctgcgtggctcccccctcccccccacctgcttcctgcctcagcctcctgccccgatataacgccctccccgcgccgggcccggccttcgcgctctgcccgccacggcagccgctgcctccgctccccgcgcggccgccgcccgggccccgaccgagggttgacagcccccggccagggcggcgccagggcgggcaccgcgctcccctcctccgtatcacttcccccaactggggcaacttctcccgaggcgggaggcgctggttcctcggctccctttctccctacttgggtaaagttctccgccctgaatgacttttcctgaagcggacattttactta

SEQ ID NO: 112812 - DNA, 30 bp, Homo sapiens; identical to SEQ ID NO: 80124
  misc_feature 1..30: note = chr17:2015149-2015179
  misc_feature 1..30: note = Hypo
  source 1..30: mol_type = genomic DNA

SEQ ID NO: 112813 - DNA, 120 bp, Homo sapiens; identical to SEQ ID NO: 80142
  misc_feature 1..120: note = chr17:2207847-2207967
  misc_feature 1..120: note = Hypo
  source 1..120: mol_type = genomic DNA

SEQ ID NO: 112814 - DNA, 36 bp, Homo sapiens; identical to SEQ ID NO: 80143
  misc_feature 1..36: note = chr17:2208027-2208063
  misc_feature 1..36: note = Hypo
  source 1..36: mol_type = genomic DNA

SEQ ID NO: 112815 - DNA, 86 bp, Homo sapiens; identical to SEQ ID NO: 80144
  misc_feature 1..86: note = chr17:2220973-2221059
  misc_feature 1..86: note = Hypo
  source 1..86: mol_type = genomic DNA

SEQ ID NO: 112816 - DNA, 39 bp, Homo sapiens; identical to SEQ ID NO: 80145
  misc_feature 1..39: note = chr17:2237982-2238021
  misc_feature 1..39: note = Hypo
  source 1..39: mol_type = genomic DNA

SEQ ID NO: 112817 - DNA, 30 bp, Homo sapiens; identical to SEQ ID NO: 80146
  misc_feature 1..30: note = chr17:2250051-2250081
  misc_feature 1..30: note = Hypo
  source 1..30: mol_type = genomic DNA

SEQ ID NO: 112818 - DNA, 66 bp, Homo sapiens; identical to SEQ ID NO: 80147
  misc_feature 1..66: note = chr17:2264699-2264765
  misc_feature 1..66: note = Hypo
  source 1..66: mol_type = genomic DNA

SEQ ID NO: 112819 - DNA, 36 bp, Homo sapiens; identical to SEQ ID NO: 80148
  misc_feature 1..36: note = chr17:2270585-2270621
  misc_feature 1..36: note = Hypo
  source 1..36: mol_type = genomic DNA

SEQ ID NO: 112820 - DNA, 148 bp, Homo sapiens; identical to SEQ ID NO: 80149
  misc_feature 1..148: note = chr17:2298883-2299031
  misc_feature 1..148: note = Hypo
  source 1..148: mol_type = genomic DNA

SEQ ID NO: 112821 - DNA, 44 bp, Homo sapiens; identical to SEQ ID NO: 80150
  misc_feature 1..44: note = chr17:2495626-2495670
  misc_feature 1..44: note = Hypo
  source 1..44: mol_type = genomic DNA

SEQ ID NO: 112822 - DNA, 44 bp, Homo sapiens; identical to SEQ ID NO: 80151
  misc_feature 1..44: note = chr17:2529816-2529860
  misc_feature 1..44: note = Hypo
  source 1..44: mol_type = genomic DNA

SEQ ID NO: 112823 - DNA, 148 bp, Homo sapiens; identical to SEQ ID NO: 80153
  misc_feature 1..148: note = chr17:2538042-2538190
  misc_feature 1..148: note = Hypo
  source 1..148: mol_type = genomic DNA

SEQ ID NO: 112824 - DNA, 929 bp, Homo sapiens
  misc_feature 1..929: note = chr17:2627439-2628368
  misc_feature 1..929: note = Hyper
  source 1..929: mol_type = genomic DNA
gacggcgagtcctctcggtagagaaggtgcccccgctcggccccgcggaggaactctcgcgcgaggagagggctcgaagctttggaaacgtcgggaagtacaaaaggctggcggttcggggatttggggggagccggggccgcctcgccccgcttcctggaggaggggcggctgccctccgacccgggacctgcctgcggggaccgagctgcgtccctggccggccctccccgtccgtcccgcgtcaccccggccagcctggcgcctactccgggtccccgggcgcgctgggctggctgggcgcgggctgcgggccggctcggtccgggggctcctggggaggcggctggcgcgggctgcgggcgctgggccgcagcggcctgcgtgcatagaggaagagcgcggggtcgggcatggggtcggcgtcgtcgagggcgccggccccgcggtcccaggcggcccagtcccggccggggcccttggcggcggcctcgtgggcagcaggcgggcggcgggctcgcagtgcgcggcggcgtggcctgggctcggcggtggcgccggggcccgggcgcggggcctgcagtctctggcgcgccgcgtgcagctggcaggagaggtaggcggccgcctcggtgtgcttctgcagctcggtgcccagcacggtggcgcggtggctgcggcggcgcagctcctccaggaagcggcgctcctcggtgcgcaggctgcagcgcagcgcggacaccagcgcctcgcgctgcgccacctcccgccgcagctccgcgttggccgcagcacgcgcctccagctgcgactccagcgcgcggcacttgctctccagctcccgggacgccgcctctggaacggggcagaggccagaggtgacggtctccccctggcttggaacagaacctgcacggctcagagctccg

SEQ ID NO: 112825 - DNA, 40 bp, Homo sapiens; identical to SEQ ID NO: 80176
  misc_feature 1..40: note = chr17:2628710-2628750
  misc_feature 1..40: note = Hypo
  source 1..40: mol_type = genomic DNA

SEQ ID NO: 112826 - DNA, 177 bp, Homo sapiens; identical to SEQ ID NO: 80177
  misc_feature 1..177: note = chr17:2634225-2634402
  misc_feature 1..177: note = Hypo
  source 1..177: mol_type = genomic DNA

SEQ ID NO: 112827 - DNA, 215 bp, Homo sapiens; identical to SEQ ID NO: 80180
  misc_feature 1..215: note = chr17:2652439-2652654
  misc_feature 1..215: note = Hyper
  source 1..215: mol_type = genomic DNA

SEQ ID NO: 112828 - DNA, 38 bp, Homo sapiens; identical to SEQ ID NO: 80184
  misc_feature 1..38: note = chr17:2658821-2658859
  misc_feature 1..38: note = Hyper
  source 1..38: mol_type = genomic DNA

SEQ ID NO: 112829 - DNA, 540 bp, Homo sapiens; identical to SEQ ID NO: 80185
  misc_feature 1..540: note = chr17:2659210-2659750
  misc_feature 1..540: note = Hyper
  source 1..540: mol_type = genomic DNA

SEQ ID NO: 112830 - DNA, 30 bp, Homo sapiens; identical to SEQ ID NO: 80187
  misc_feature 1..30: note = chr17:2666440-2666470
  misc_feature 1..30: note = Hypo
  source 1..30: mol_type = genomic DNA

SEQ ID NO: 112831 - DNA, 315 bp, Homo sapiens; identical to SEQ ID NO: 80188
  misc_feature 1..315: note = chr17:2680183-2680498
  misc_feature 1..315: note = Hyper
  source 1..315: mol_type = genomic DNA

SEQ ID NO: 112832 - DNA, 338 bp, Homo sapiens
  misc_feature 1..338: note = chr17:2756263-2756601
  misc_feature 1..338: note = Hyper
  source 1..338: mol_type = genomic DNA
cgcagcggccaggcccgggtgggcgcggggagggcggagtggggggcgcccggcccgccaggaggaagcggggtcgccgtgaagttggttattgaacccatgtggagtcaaactcccagggccgggagagccagtgttcgcggggagccgaccccagcccactctgcatcccagctcggcgatccttgcgccgactctgcggggaggcgggggcagaattccgcctcgttcctcccatccgcaagctcccacccggggacccgggcccgggagctgcgagccggggcgggcgccgggctcaggtgccccctgtaagcgctgggcggccgggaggggac

SEQ ID NO: 112833 - DNA, 120 bp, Homo sapiens; identical to SEQ ID NO: 80214
  misc_feature 1..120: note = chr17:2757584-2757704
  misc_feature 1..120: note = Hyper
  source 1..120: mol_type = genomic DNA

SEQ ID NO: 112834 - DNA, 99 bp, Homo sapiens; identical to SEQ ID NO: 80224
  misc_feature 1..99: note = chr17:2801121-2801220
  misc_feature 1..99: note = Hypo
  source 1..99: mol_type = genomic DNA

SEQ ID NO: 112835 - DNA, 30 bp, Homo sapiens; identical to SEQ ID NO: 80230
  misc_feature 1..30: note = chr17:2831027-2831057
  misc_feature 1..30: note = Hypo
  source 1..30: mol_type = genomic DNA

SEQ ID NO: 112836 - DNA, 30 bp, Homo sapiens; identical to SEQ ID NO: 80231
  misc_feature 1..30: note = chr17:2844357-2844387
  misc_feature 1..30: note = Hypo
  source 1..30: mol_type = genomic DNA

SEQ ID NO: 112837 - DNA, 272 bp, Homo sapiens; identical to SEQ ID NO: 80234
  misc_feature 1..272: note = chr17:2859276-2859548
  misc_feature 1..272: note = Hypo
  source 1..272: mol_type = genomic DNA

SEQ ID NO: 112838 - DNA, 157 bp, Homo sapiens; identical to SEQ ID NO: 80252
  misc_feature 1..157: note = chr17:2952123-2952280
  misc_feature 1..157: note = Hyper
  source 1..157: mol_type = genomic DNA

SEQ ID NO: 112839 - DNA, 17 bp, Homo sapiens
  misc_feature 1..17: note = chr17:3036557-3036574
  misc_feature 1..17: note = Hypo
  source 1..17: mol_type = genomic DNA
ctcgccagttcccaggc

SEQ ID NO: 112840 - DNA, 28 bp, Homo sapiens
  misc_feature 1..28: note = chr17:3338320-3338348
  misc_feature 1..28: note = Hypo
  source 1..28: mol_type = genomic DNA
gagccaccgtgcccggccacacactgtg

SEQ ID NO: 112841 - DNA, 204 bp, Homo sapiens
  misc_feature 1..204: note = chr17:3438826-3439030
  misc_feature 1..204: note = Hyper
  source 1..204: mol_type = genomic DNA
cctcctcccagactccgcaccgggcgggggcggcacccaccgaagtagaagccttcgtgttggtacttggggttgaagaaggcccccttggcgtgcgcgttgacgtcggcgccggcggcgatgagcagggctgcgatgtccccctgccgccgctcgatggcgatgttcagcgccgtctgccctgcggagcgggcggggacgcgc

SEQ ID NO: 112842 - DNA, 42 bp, Homo sapiens; identical to SEQ ID NO: 80341
  misc_feature 1..42: note = chr17:3541067-3541109
  misc_feature 1..42: note = Hypo
  source 1..42: mol_type = genomic DNA

SEQ ID NO: 112843 - DNA, 81 bp, Homo sapiens; identical to SEQ ID NO: 80342
  misc_feature 1..81: note = chr17:3585002-3585083
  misc_feature 1..81: note = Hypo
  source 1..81: mol_type = genomic DNA

SEQ ID NO: 112844 - DNA, 105 bp, Homo sapiens; identical to SEQ ID NO: 80344
  misc_feature 1..105: note = chr17:3599635-3599740
  misc_feature 1..105: note = Hyper
  source 1..105: mol_type = genomic DNA

SEQ ID NO: 112845 - DNA, 144 bp, Homo sapiens; identical to SEQ ID NO: 80353
  misc_feature 1..144: note = chr17:3658786-3658930
  misc_feature 1..144: note = Hypo
  source 1..144: mol_type = genomic DNA

SEQ ID NO: 112846 - DNA, 143 bp, Homo sapiens; identical to SEQ ID NO: 80354
  misc_feature 1..143: note = chr17:3658990-3659133
  misc_feature 1..143: note = Hypo
  source 1..143: mol_type = genomic DNA

SEQ ID NO: 112847 - DNA, 90 bp, Homo sapiens; identical to SEQ ID NO: 80358
  misc_feature 1..90: note = chr17:3686092-3686182
  misc_feature 1..90: note = Hypo
  source 1..90: mol_type = genomic DNA

SEQ ID NO: 112848 - DNA, 204 bp, Homo sapiens; identical to SEQ ID NO: 80383
  misc_feature 1..204: note = chr17:3741592-3741796
  misc_feature 1..204: note = Hypo
  source 1..204: mol_type = genomic DNA

SEQ ID NO: 112849 - DNA, 30 bp, Homo sapiens; identical to SEQ ID NO: 80384
  misc_feature 1..30: note = chr17:3755004-3755034
  misc_feature 1..30: note = Hypo
  source 1..30: mol_type = genomic DNA

SEQ ID NO: 112850 - DNA, 62 bp, Homo sapiens; identical to SEQ ID NO: 80386
  misc_feature 1..62: note = chr17:3769760-3769822
  misc_feature 1..62: note = Hypo
  source 1..62: mol_type = genomic DNA

SEQ ID NO: 112851 - DNA, 73 bp, Homo sapiens; identical to SEQ ID NO: 80408
  misc_feature 1..73: note = chr17:3792191-3792264
  misc_feature 1..73: note = Hypo
  source 1..73: mol_type = genomic DNA

SEQ ID NO: 112852 - DNA, 227 bp, Homo sapiens; identical to SEQ ID NO: 80421
  misc_feature 1..227: note = chr17:3866983-3867210
  misc_feature 1..227: note = Hyper
  source 1..227: mol_type = genomic DNA

SEQ ID NO: 112853 - DNA, 30 bp, Homo sapiens; identical to SEQ ID NO: 80422
  misc_feature 1..30: note = chr17:3907085-3907115
  misc_feature 1..30: note = Hypo
  source 1..30: mol_type = genomic DNA

SEQ ID NO: 112854 - DNA, 79 bp, Homo sapiens; identical to SEQ ID NO: 80486
  misc_feature 1..79: note = chr17:4236625-4236704
  misc_feature 1..79: note = Hypo
  source 1..79: mol_type = genomic DNA

SEQ ID NO: 112855 - DNA, 32 bp, Homo sapiens; identical to SEQ ID NO: 80527
  misc_feature 1..32: note = chr17:4436418-4436450
  misc_feature 1..32: note = Hypo
  source 1..32: mol_type = genomic DNA

SEQ ID NO: 112856 - DNA, 68 bp, Homo sapiens; identical to SEQ ID NO: 80528
  misc_feature 1..68: note = chr17:4446308-4446376
  misc_feature 1..68: note = Hypo
  source 1..68: mol_type = genomic DNA

SEQ ID NO: 112857 - DNA, 38 bp, Homo sapiens; identical to SEQ ID NO: 80529
  misc_feature 1..38: note = chr17:4487283-4487321
  misc_feature 1..38: note = Hyper
  source 1..38: mol_type = genomic DNA

SEQ ID NO: 112858 - DNA, 786 bp, Homo sapiens; identical to SEQ ID NO: 80545
  misc_feature 1..786: note = chr17:4544270-4545056
  misc_feature 1..786: note = Hyper
  source 1..786: mol_type = genomic DNA

SEQ ID NO: 112859 - DNA, 146 bp, Homo sapiens; identical to SEQ ID NO: 80560
  misc_feature 1..146: note = chr17:4622963-4623109
  misc_feature 1..146: note = Hypo
  source 1..146: mol_type = genomic DNA

SEQ ID NO: 112860 - DNA, 41 bp, Homo sapiens; identical to SEQ ID NO: 44973
  misc_feature 1..41: note = chr17:4699211-4699252
  misc_feature 1..41: note = Hypo
  source 1..41: mol_type = genomic DNA

SEQ ID NO: 112861 - DNA, 30 bp, Homo sapiens; identical to SEQ ID NO: 80678
  misc_feature 1..30: note = chr17:4841792-4841822
  misc_feature 1..30: note = Hypo
  source 1..30: mol_type = genomic DNA

SEQ ID NO: 112862 - DNA, 30 bp, Homo sapiens; identical to SEQ ID NO: 80700
  misc_feature 1..30: note = chr17:4891311-4891341
  misc_feature 1..30: note = Hyper
  source 1..30: mol_type = genomic DNA

SEQ ID NO: 112863 - DNA, 27 bp, Homo sapiens
  misc_feature 1..27: note = chr17:4976841-4976868
  misc_feature 1..27: note = Hypo
  source 1..27: mol_type = genomic DNA
gtgtaataaagcagacggtgggccagg

SEQ ID NO: 112864 - DNA, 615 bp, Homo sapiens
  misc_feature 1..615: note = chr17:4981370-4981985
  misc_feature 1..615: note = Hyper
  source 1..615: mol_type = genomic DNA
gagagttaaaagggtcgcgcaaacggtccccgcgggaatgcgaagcggattctcgagttcttgagcctagagcaatgcttggggagcgacacgagggcgcagagcggcagatcgcggagcggaagttcatccccggagccgttctaggaaacccggaggactcaggtcgtcaatgattccggggctgaagtgggcatcgacgggtgcactttgctgttccagggagccggctcggcaggcggcggcgacgtggaacttgggctagggctagaaccggcgaaaagcaagccggaaaaggcaagggggcgtcggtgcgctgaccacctgttcctccagcggagtgcgacgcgcgccgattggctggagtgccgcccgggtaccggaagtggccgatgcccgtcgccagtgacaccgggacaacagctgcgggctctgtgcgagcggcccagcagcgcggagcctcagcggagtgagcgagcgcggggcagtagcggcctgcggtgagacctcattccgtcgcggctgtgggggtaggcgggggctgggctcccagctccctagagagccgagcggaaaccctacgtttaggcccgttctgaccggggttcgctgtgt

SEQ ID NO: 112865 - DNA, 864 bp, Homo sapiens
  misc_feature 1..864: note = chr17:5000354-5001218
  misc_feature 1..864: note = Hyper
  source 1..864: mol_type = genomic DNA
cccagtgggaaggagcggggacgattctggcgatcacatgaggaagggagcagcctcagcagcgcaggtggacacagtcgtcaaccactcgctggccgcctgcgacgtgaagcacctgcgctgggcgcggcgggtaagcgccgacactagcgggcgcctgaacagtccagcggcgtcagcgctgcggagcaggaaagggtcccaaacgcagggcggccatgcagcgtggcgcccacctgtccctctcctcgaagcgctgagccagcacgatgcacataagggaaggaggaaggtggcttgagggcagtgaccgagcggacagcggaagcccatttcaggagccccggtacccgagctcgggcccctttccaatcccccaggcgtccttcccatgtccttgtctcctagtcctgggaatccacggccactccactctcctgcagtaccgcggacaagaacaccatgtactcttcacaggcaggtgtcttctggtggacccaactctgttggtacttgtcgtctccaaaaagtccccaaatgcgctagaggccagccagcccggtatccgagaggtaagagccccggcggcgcaggcggaagcgtgtctgtcgcgaggcctctctaggactccgggaggacccctcgttagcgcaggacctcggcagccgggggttgggctcgagggctgagggcggcgcgccatgcgcggattagctgccatccggcgggtctttctgccggggaccagtggggtcggacgctgagggccgaggaaccccgcccccccaccgcaccgggcgggctctggggcgtccgcggaggctcccgcgtgcgtgtgcggggtggggtcggggtggcagttgg

SEQ ID NO: 112866 - DNA, 40 bp, Homo sapiens; identical to SEQ ID NO: 80711
  misc_feature 1..40: note = chr17:5014692-5014732
  misc_feature 1..40: note = Hyper
  source 1..40: mol_type = genomic DNA

SEQ ID NO: 112867 - DNA, 30 bp, Homo sapiens; identical to SEQ ID NO: 80717
  misc_feature 1..30: note = chr17:5039277-5039307
  misc_feature 1..30: note = Hypo
  source 1..30: mol_type = genomic DNA

SEQ ID NO: 112868 - DNA, 48 bp, Homo sapiens; identical to SEQ ID NO: 80718
  misc_feature 1..48: note = chr17:5094851-5094899
  misc_feature 1..48: note = Hyper
  source 1..48: mol_type = genomic DNA

SEQ ID NO: 112869 - DNA, 20 bp, Homo sapiens
  misc_feature 1..20: note = chr17:5320631-5320651
  misc_feature 1..20: note = Hypo
  source 1..20: mol_type = genomic DNA
aagtaaatagccaggcgtgg

SEQ ID NO: 112870 - DNA, 120 bp, Homo sapiens; identical to SEQ ID NO: 44976
  misc_feature 1..120: note = chr17:5320771-5320891
  misc_feature 1..120: note = Hypo
  source 1..120: mol_type = genomic DNA

SEQ ID NO: 112871 - DNA, 157 bp, Homo sapiens; identical to SEQ ID NO: 80734
  misc_feature 1..157: note = chr17:5436596-5436753
  misc_feature 1..157: note = Hypo
  source 1..157: mol_type = genomic DNA

SEQ ID NO: 112872 - DNA, 1050 bp, Homo sapiens
  misc_feature 1..1050: note = chr17:5973275-5974325
  misc_feature 1..1050: note = Hyper
  source 1..1050: mol_type = genomic DNA
tgggaagcagtgattcgggatgtgtgtgtcaggcagtgtgcggctgtcgctgtgagtctgcatgggagagtggcggcgtgctctcctctgcgcggcagtgccccgtgtgtttgtgggtctgtgtctgggtgtgagcgtcatggtgcgtgtgttagagcccgtggggccccggtgaaaggctgtggctctgggtgactggtgtgtgtgtgtgtgtgtgtgtgtatcagagtgggtggcggcgtctctgctcggcagtggcgcgtgtggcccgccccgcgcgcgtgttctcgcgggccggggcagggcgtgggccccctccggcggagccgcgacccctcccccgggcggcgggaggtgcgcaccggcgcctctaggacccggcggcggccggccgctgtccccgggccgcgcgagtgagcatgtgcagagcccggcgcccgctcgcccgcccgctgcccgccccggctccgcgcccgcccgcccgccccgccgttcagcccggacgccagcagccccggggagccaggcggcggcgccctgtgcccgggcgcgtgggtccgcttgccgcgggcggccggagacgtgcgggcgccggggcttctgggctccgggcactgcggggggctgcgggctcggcgcccggggaaggcgggccatgggcgcgggtgcgggcgccccagccggccgcgatcgcggggtgagtcctgtctctcggcgctccagccggacccccgcgcgggctgcgagcagggtgttccccttgccgcgggcaaacaagtttgtgcagacgcggttgggagcgcggcggggctgcacctgctccggctgcagggcgggcttgccgggggcaccttcccgggggcccggggcggctcggccggggcaggggagagtgagcgggtgcgtgcaggggttgtgggggggcgggggcggcgctcggcgcggccgggatggggtgggggtgcgcgaggcgccgcacgagccgcgtccccctccggagtcctgagagcccgtccgtcacccgggagggcgctgcggttggtcccgggg

SEQ ID NO: 112873 - DNA, 195 bp, Homo sapiens; identical to SEQ ID NO: 80807
  misc_feature 1..195: note = chr17:6023680-6023875
  misc_feature 1..195: note = Hypo
  source 1..195: mol_type = genomic DNA

SEQ ID NO: 112874 - DNA, 30 bp, Homo sapiens; identical to SEQ ID NO: 80815
  misc_feature 1..30: note = chr17:6070721-6070751
  misc_feature 1..30: note = Hypo
  source 1..30: mol_type = genomic DNA

SEQ ID NO: 112875 - DNA, 85 bp, Homo sapiens; identical to SEQ ID NO: 80829
  misc_feature 1..85: note = chr17:6120251-6120336
  misc_feature 1..85: note = Hypo
  source 1..85: mol_type = genomic DNA

SEQ ID NO: 112876 - DNA, 30 bp, Homo sapiens; identical to SEQ ID NO: 80858
  misc_feature 1..30: note = chr17:6294932-6294962
  misc_feature 1..30: note = Hypo
  source 1..30: mol_type = genomic DNA

SEQ ID NO: 112877 - DNA, 221 bp, Homo sapiens; identical to SEQ ID NO: 80859
  misc_feature 1..221: note = chr17:6297080-6297301
  misc_feature 1..221: note = Hypo
  source 1..221: mol_type = genomic DNA

SEQ ID NO: 112878 - DNA, 30 bp, Homo sapiens; identical to SEQ ID NO: 80862
  misc_feature 1..30: note = chr17:6347790-6347820
  misc_feature 1..30: note = Hyper
  source 1..30: mol_type = genomic DNA

SEQ ID NO: 112879 - DNA, 147 bp, Homo sapiens; identical to SEQ ID NO: 80867
  misc_feature 1..147: note = chr17:6454672-6454819
  misc_feature 1..147: note = Hypo
  source 1..147: mol_type = genomic DNA

SEQ ID NO: 112880 - DNA, 37 bp, Homo sapiens; identical to SEQ ID NO: 80868
  misc_feature 1..37: note = chr17:6456361-6456398
  misc_feature 1..37: note = Hypo
  source 1..37: mol_type = genomic DNA

SEQ ID NO: 112881 - DNA, 820 bp, Homo sapiens
  misc_feature 1..820: note = chr17:6616271-6617091
  misc_feature 1..820: note = Hyper
  source 1..820: mol_type = genomic DNA
gatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagctcagcgccgaggccatcgcgcgggagggagactggcgggcgagacgagtgaggggcagctagaggcgccgcgggcttaagaaggggccacagtccccggggattggggagggggcggtgacaactccgccccgcacgggggcgcctccccgcggccctggggcggggccacccctcggggtctgtgggacgcgcctgcccccaattctgccacccggcggcggtgggaggcgtctttggactccaacgcttcgggccagccctctaggggcagcctgggccctagcatctcgcgctgtccaagcctctcctgcgctgccgaggcagaggtgcgtcccggggctgccaagcggggcgtgttttggtcactggtgctgcccgctttggcgtaaggcgccctcccgcgtccgcatctgctctttcctgggctctgaagggtcccggatgaaactctct

SEQ ID NO: 112882 - DNA, 30 bp, Homo sapiens; identical to SEQ ID NO: 80893
  misc_feature 1..30: note = chr17:6662975-6663005
  misc_feature 1..30: note = Hypo
  source 1..30: mol_type = genomic DNA

SEQ ID NO: 112883 - DNA, 492 bp, Homo sapiens; identical to SEQ ID NO: 80895
  misc_feature 1..492: note = chr17:6679303-6679795
  misc_feature 1..492: note = Hyper
  source 1..492: mol_type = genomic DNA

SEQ ID NO: 112884 - DNA, 423 bp, Homo sapiens; identical to SEQ ID NO: 80899
  misc_feature 1..423: note = chr17:6735130-6735553
  misc_feature 1..423: note = Hyper
  source 1..423: mol_type = genomic DNA

SEQ ID NO: 112885 - DNA, 30 bp, Homo sapiens; identical to SEQ ID NO: 80906
  misc_feature 1..30: note = chr17:6882316-6882346
  misc_feature 1..30: note = Hypo
  source 1..30: mol_type = genomic DNA

SEQ ID NO: 112886 - DNA, 250 bp, Homo sapiens
  misc_feature 1..250: note = chr17:6926178-6926428
  misc_feature 1..250: note = Hyper
  source 1..250: mol_type = genomic DNA
acccaagaccccctacgttacgaccaccccttgtttctgaggtcccgccctcgagacggagaccccgccctggactcgccatctggagagcgagggaggaaggaaggatacagacccaggcgttcaccccacctccacccccgcccccgacatcccggccagataaaggagccgaggccaagaggggagagagaccccgccccccttaagaagagaagccgcggcccctgcaggacgggggtaagaacaa

SEQ ID NO: 112887 - DNA, 279 bp, Homo sapiens
  misc_feature 1..279: note = chr17:6946212-6946491
  misc_feature 1..279: note = Hyper
  source 1..279: mol_type = genomic DNA
tcaccctgaatgacccgggcatcccacttccctcaccagcgaggaggcccaggccgaggtagagatgcagcagatcgctggcgaaagccgagaagacgaagcccagcgaggcgaggacgcccccaaccatcaccacggggcgggccccccagcgcgtgctcagggcgctgcccacggggcctgaaagggggcggagtcaacggaagacacgcccccgggcccccaaactctctccaacacttctcattggctgtttgcctccctcgaactaatggttct

SEQ ID NO: 112888 - DNA, 124 bp, Homo sapiens; identical to SEQ ID NO: 80911
  misc_feature 1..124: note = chr17:6946872-6946996
  misc_feature 1..124: note = Hyper
  source 1..124: mol_type = genomic DNA

SEQ ID NO: 112889 - DNA, 30 bp, Homo sapiens; identical to SEQ ID NO: 80912
  misc_feature 1..30: note = chr17:6947321-6947351
  misc_feature 1..30: note = Hyper
  source 1..30: mol_type = genomic DNA

SEQ ID NO: 112890 - DNA, 30 bp, Homo sapiens; identical to SEQ ID NO: 80913
  misc_feature 1..30: note = chr17:6978470-6978500
  misc_feature 1..30: note = Hypo
  source 1..30: mol_type = genomic DNA

SEQ ID NO: 112891 - DNA, 98 bp, Homo sapiens; identical to SEQ ID NO: 44977
  misc_feature 1..98: note = chr17:7047830-7047928
  misc_feature 1..98: note = Hypo
  source 1..98: mol_type = genomic DNA

SEQ ID NO: 112892 - DNA, 101 bp, Homo sapiens; identical to SEQ ID NO: 80932
  misc_feature 1..101: note = chr17:7107617-7107718
  misc_feature 1..101: note = Hypo
  source 1..101: mol_type = genomic DNA

SEQ ID NO: 112893 - DNA, 31 bp, Homo sapiens; identical to SEQ ID NO: 80945
  misc_feature 1..31: note = chr17:7136114-7136145
  misc_feature 1..31: note = Hypo
  source 1..31: mol_type = genomic DNA

SEQ ID NO: 112894 - DNA, 30 bp, Homo sapiens; identical to SEQ ID NO: 44979
  misc_feature 1..30: note = chr17:7156905-7156935
  misc_feature 1..30: note = Hypo
  source 1..30: mol_type = genomic DNA

SEQ ID NO: 112895 - DNA, 41 bp, Homo sapiens; identical to SEQ ID NO: 80959
  misc_feature 1..41: note = chr17:7164579-7164620
  misc_feature 1..41: note = Hyper
  source 1..41: mol_type = genomic DNA

SEQ ID NO: 112896 - DNA, 104 bp, Homo sapiens; identical to SEQ ID NO: 80964
  misc_feature 1..104: note = chr17:7197588-7197692
  misc_feature 1..104: note = Hyper
  source 1..104: mol_type = genomic DNA

SEQ ID NO: 112897 - DNA, 30 bp, Homo sapiens; identical to SEQ ID NO: 80966
  misc_feature 1..30: note = chr17:7219436-7219466
  misc_feature 1..30: note = Hypo
  source 1..30: mol_type = genomic DNA

SEQ ID NO: 112898 - DNA, 28 bp, Homo sapiens
  misc_feature 1..28: note = chr17:7243860-7243888
  misc_feature 1..28: note = Hypo
  source 1..28: mol_type = genomic DNA
gataagatttgatctcggtcaggccagg

SEQ ID NO: 112899 - DNA, 30 bp, Homo sapiens; identical to SEQ ID NO: 81007
  misc_feature 1..30: note = chr17:7285270-7285300
  misc_feature 1..30: note = Hypo
  source 1..30: mol_type = genomic DNA

SEQ ID NO: 112900 - DNA, 45 bp, Homo sapiens; identical to SEQ ID NO: 81034
  misc_feature 1..45: note = chr17:7343074-7343119
  misc_feature 1..45: note = Hyper
  source 1..45: mol_type = genomic DNA

SEQ ID NO: 112901 - DNA, 226 bp, Homo sapiens; identical to SEQ ID NO: 81036
  misc_feature 1..226: note = chr17:7348747-7348973
  misc_feature 1..226: note = Hyper
  source 1..226: mol_type = genomic DNA

SEQ ID NO: 112902 - DNA, 33 bp, Homo sapiens; identical to SEQ ID NO: 81037
  misc_feature 1..33: note = chr17:7349226-7349259
  misc_feature 1..33: note = Hyper
  source 1..33: mol_type = genomic DNA

SEQ ID NO: 112903 - DNA, 275 bp, Homo sapiens; identical to SEQ ID NO: 81053
  misc_feature 1..275: note = chr17:7368947-7369222
  misc_feature 1..275: note = Hypo
  source 1..275: mol_type = genomic DNA

SEQ ID NO: 112904 - DNA, 30 bp, Homo sapiens; identical to SEQ ID NO: 81084
  misc_feature 1..30: note = chr17:7419628-7419658
  misc_feature 1..30: note = Hypo
  source 1..30: mol_type = genomic DNA

SEQ ID NO: 112905 - DNA, 30 bp, Homo sapiens; identical to SEQ ID NO: 81097
  misc_feature 1..30: note = chr17:7460469-7460499
  misc_feature 1..30: note = Hypo
  source 1..30: mol_type = genomic DNA

SEQ ID NO: 112906 - DNA, 270 bp, Homo sapiens; identical to SEQ ID NO: 81099
  misc_feature 1..270: note = chr17:7466705-7466975
  misc_feature 1..270: note = Hypo
  source 1..270: mol_type = genomic DNA

SEQ ID NO: 112907 - DNA, 30 bp, Homo sapiens; identical to SEQ ID NO: 81107
  misc_feature 1..30: note = chr17:7491930-7491960
  misc_feature 1..30: note = Hypo
  source 1..30: mol_type = genomic DNA

SEQ ID NO: 112908 - DNA, 33 bp, Homo sapiens; identical to SEQ ID NO: 81109
  misc_feature 1..33: note = chr17:7493033-7493066
  misc_feature 1..33: note = Hypo
  source 1..33: mol_type = genomic DNA

SEQ ID NO: 112909 - DNA, 202 bp, Homo sapiens; identical to SEQ ID NO: 81130
  misc_feature 1..202: note = chr17:7554591-7554793
  misc_feature 1..202: note = Hyper
  source 1..202: mol_type = genomic DNA

SEQ ID NO: 112910 - DNA, 66 bp, Homo sapiens; identical to SEQ ID NO: 81132
  misc_feature 1..66: note = chr17:7555185-7555251
  misc_feature 1..66: note = Hyper
  source 1..66: mol_type = genomic DNA

SEQ ID NO: 112911 - DNA, 30 bp, Homo sapiens; identical to SEQ ID NO: 81154
  misc_feature 1..30: note = chr17:7608216-7608246
  misc_feature 1..30: note = Hyper
  source 1..30: mol_type = genomic DNA

SEQ ID NO: 112912 - DNA, 97 bp, Homo sapiens; identical to SEQ ID NO: 81155
  misc_feature 1..97: note = chr17:7608731-7608828
  misc_feature 1..97: note = Hyper
  source 1..97: mol_type = genomic DNA

SEQ ID NO: 112913 - DNA, 58 bp, Homo sapiens; identical to SEQ ID NO: 81170
  misc_feature 1..58: note = chr17:7621433-7621491
  misc_feature 1..58: note = Hyper
  source 1..58: mol_type = genomic DNA

SEQ ID NO: 112914 - DNA, 93 bp, Homo sapiens; identical to SEQ ID NO: 81237
  misc_feature 1..93: note = chr17:7727249-7727342
  misc_feature 1..93: note = Hypo
  source 1..93: mol_type = genomic DNA

SEQ ID NO: 112915 - DNA, 75 bp, Homo sapiens; identical to SEQ ID NO: 81295
  misc_feature 1..75: note = chr17:7856906-7856981
  misc_feature 1..75: note = Hypo
  source 1..75: mol_type = genomic DNA

SEQ ID NO: 112916 - DNA, 160 bp, Homo sapiens; identical to SEQ ID NO: 81324
  misc_feature 1..160: note = chr17:7906254-7906414
  misc_feature 1..160: note = Hyper
  source 1..160: mol_type = genomic DNA

SEQ ID NO: 112917 - DNA, 43 bp, Homo sapiens; identical to SEQ ID NO: 81343
  misc_feature 1..43: note = chr17:7919589-7919632
  misc_feature 1..43: note = Hyper
  source 1..43: mol_type = genomic DNA

SEQ ID NO: 112918 - DNA, 49 bp, Homo sapiens; identical to SEQ ID NO: 36363
  misc_feature 1..49: note = chr17:7976269-7976318
  misc_feature 1..49: note = Hyper
  source 1..49: mol_type = genomic DNA

SEQ ID NO: 112919 - DNA, 125 bp, Homo sapiens; identical to SEQ ID NO: 81381
  misc_feature 1..125: note = chr17:7982585-7982710
  misc_feature 1..125: note = Hyper
  source 1..125: mol_type = genomic DNA

SEQ ID NO: 112920 - DNA, 30 bp, Homo sapiens; identical to SEQ ID NO: 81400
  misc_feature 1..30: note = chr17:7996014-7996044
  misc_feature 1..30: note = Hypo
  source 1..30: mol_type = genomic DNA

SEQ ID NO: 112921 - DNA, 30 bp, Homo sapiens; identical to SEQ ID NO: 81413
  misc_feature 1..30: note = chr17:8021183-8021213
  misc_feature 1..30: note = Hyper
  source 1..30: mol_type = genomic DNA

SEQ ID NO: 112922 - DNA, 50 bp, Homo sapiens; identical to SEQ ID NO: 81425
  misc_feature 1..50: note = chr17:8027872-8027922
  misc_feature 1..50: note = Hyper
  source 1..50: mol_type = genomic DNA

SEQ ID NO: 112923 - DNA, 657 bp, Homo sapiens; identical to SEQ ID NO: 81453
  misc_feature 1..657: note = chr17:8055166-8055823
  misc_feature 1..657: note = Hyper
  source 1..657: mol_type = genomic DNA

SEQ ID NO: 112924 - DNA, 18 bp, Homo sapiens
  misc_feature 1..18: note = chr17:8075326-8075344
  misc_feature 1..18: note = Hypo
  source 1..18: mol_type = genomic DNA
aaacaagagatgggccgg

SEQ ID NO: 112925 - DNA, 29 bp, Homo sapiens
  misc_feature 1..29: note = chr17:8104161-8104190
  misc_feature 1..29: note = Hypo
  source 1..29: mol_type = genomic DNA
gggtgcggtggctcacggctgtaatccca

SEQ ID NO: 112926 - DNA, 209 bp, Homo sapiens; identical to SEQ ID NO: 81494
  misc_feature 1..209: note = chr17:8104430-8104639
  misc_feature 1..209: note = Hypo
  source 1..209: mol_type = genomic DNA

SEQ ID NO: 112927 - DNA, 28 bp, Homo sapiens
  misc_feature 1..28: note = chr17:8104911-8104939
  misc_feature 1..28: note = Hypo
  source 1..28: mol_type = genomic DNA
tataggctgaaaggccgggcgcggtggc

SEQ ID NO: 112928 - DNA, 25 bp, Homo sapiens
  misc_feature 1..25: note = chr17:8123524-8123549
  misc_feature 1..25: note = Hypo
  source 1..25: mol_type = genomic DNA
cccatcccaccggttttgtttttca

SEQ ID NO: 112929 - DNA, 884 bp, Homo sapiens
  misc_feature 1..884: note = chr17:8229958-8230842
  misc_feature 1..884: note = Hyper
  source 1..884: mol_type = genomic DNA
gccctcttccccccacgccccggcccccaagcctgctcactagctctctcctcctccttccacccgcaaggaaccctccagcccacttcctgtgatcctttccggagcccttcagcctggctggctctccagccatctcggaaagcttctctttcctaaaccctccatactcgcaggttcagctacagaggtaactgcaggctcaggttctccagggtggccagcccaccagcccaccgtcccggtgcagcagtgcctctccagcgacagctccaccgcgagcctggcgggctcccgaccttgctccccagcacgtcgtctccaagccacggtctcaccaccctccatcagcctcgggcgacaccaaggggaacagagcgctggagctcctcgaagtcctcccgaccttagcggggctccgttcatcctcccggacgtggccaggccccgctctggccccgcgcccgcccctcccgcggggctgcccctgtctctctgccggagacccggactcagtgagtgagcgcagcgcggccatagggcttcctgcagcggggtctcagcacgtcttctggctggactctggggtctcctggcctggctgtgtctcctggttctcagcgctcgcctcccacgcggggcggagtatgggagtgggctgctcccgcggaagaatcctggggaagttgaggcactggctcccgctgttcagaacactgcccgacgtccccagagctagccactcctccttcccacccacccgcagcactctcgaggtcgcaacggcagtcaccaggtcccggggcctgcgttcagctgcttgatccgactaggtttggcttcggacccgaatgggtcagctccacgcccgatggagtttttca

SEQ ID NO: 112930 - DNA, 37 bp, Homo sapiens; identical to SEQ ID NO: 81514
  misc_feature 1..37: note = chr17:8287722-8287759
  misc_feature 1..37: note = Hypo
  source 1..37: mol_type = genomic DNA

SEQ ID NO: 112931 - DNA, 186 bp, Homo sapiens; identical to SEQ ID NO: 81515
  misc_feature 1..186: note = chr17:8296142-8296328
  misc_feature 1..186: note = Hypo
  source 1..186: mol_type = genomic DNA

SEQ ID NO: 112932 - DNA, 30 bp, Homo sapiens; identical to SEQ ID NO: 81516
  misc_feature 1..30: note = chr17:8328350-8328380
  misc_feature 1..30: note = Hypo
  source 1..30: mol_type = genomic DNA

SEQ ID NO: 112933 - DNA, 45 bp, Homo sapiens; identical to SEQ ID NO: 81517
  misc_feature 1..45: note = chr17:8338095-8338140
  misc_feature 1..45: note = Hypo
  source 1..45: mol_type = genomic DNA

SEQ ID NO: 112934 - DNA, 30 bp, Homo sapiens; identical to SEQ ID NO: 81519
  misc_feature 1..30: note = chr17:8365197-8365227
  misc_feature 1..30: note = Hypo
  source 1..30: mol_type = genomic DNA

SEQ ID NO: 112935 - DNA, 391 bp, Homo sapiens; identical to SEQ ID NO: 81520
  misc_feature 1..391: note = chr17:8384513-8384904
  misc_feature 1..391: note = Hypo
  source 1..391: mol_type = genomic DNA

SEQ ID NO: 112936 - DNA, 36 bp, Homo sapiens; identical to SEQ ID NO: 81521
  misc_feature 1..36: note = chr17:8397135-8397171
  misc_feature 1..36: note = Hypo
  source 1..36: mol_type = genomic DNA

SEQ ID NO: 112937 - DNA, 97 bp, Homo sapiens; identical to SEQ ID NO: 81522
  misc_feature 1..97: note = chr17:8398223-8398320
  misc_feature 1..97: note = Hypo
  source 1..97: mol_type = genomic DNA

SEQ ID NO: 112938 - DNA, 44 bp, Homo sapiens; identical to SEQ ID NO: 81523
  misc_feature 1..44: note = chr17:8409685-8409729
  misc_feature 1..44: note = Hypo
  source 1..44: mol_type = genomic DNA

SEQ ID NO: 112939 - DNA, 30 bp, Homo sapiens; identical to SEQ ID NO: 81524
  misc_feature 1..30: note = chr17:8456005-8456035
  misc_feature 1..30: note = Hypo
  source 1..30: mol_type = genomic DNA

SEQ ID NO: 112940 - DNA, 18 bp, Homo sapiens
  misc_feature 1..18: note = chr17:8464515-8464533
  misc_feature 1..18: note = Hypo
  source 1..18: mol_type = genomic DNA
ggggcctctcctctccgg

SEQ ID NO: 112941 - DNA, 30 bp, Homo sapiens; identical to SEQ ID NO: 81527
  misc_feature 1..30: note = chr17:8532918-8532948
  misc_feature 1..30: note = Hyper
  source 1..30: mol_type = genomic DNA

SEQ ID NO: 112942 - DNA, 38 bp, Homo sapiens; identical to SEQ ID NO: 36367
  misc_feature 1..38: note = chr17:8533161-8533199
  misc_feature 1..38: note = Hyper
  source 1..38: mol_type = genomic DNA

SEQ ID NO: 112943 - DNA, 170 bp, Homo sapiens; identical to SEQ ID NO: 81529
  misc_feature 1..170: note = chr17:8533692-8533862
  misc_feature 1..170: note = Hyper
  source 1..170: mol_type = genomic DNA

SEQ ID NO: 112944 - DNA, 88 bp, Homo sapiens; identical to SEQ ID NO: 81530
  misc_feature 1..88: note = chr17:8572343-8572431
  misc_feature 1..88: note = Hypo
  source 1..88: mol_type = genomic DNA

SEQ ID NO: 112945 - DNA, 76 bp, Homo sapiens; identical to SEQ ID NO: 81531
  misc_feature 1..76: note = chr17:8586787-8586863
  misc_feature 1..76: note = Hypo
  source 1..76: mol_type = genomic DNA

SEQ ID NO: 112946 - DNA, 30 bp, Homo sapiens; identical to SEQ ID NO: 81532
  misc_feature 1..30: note = chr17:8624511-8624541
  misc_feature 1..30: note = Hypo
  source 1..30: mol_type = genomic DNA

SEQ ID NO: 112947 - DNA, 30 bp, Homo sapiens; identical to SEQ ID NO: 44992
  misc_feature 1..30: note = chr17:8732186-8732216
  misc_feature 1..30: note = Hypo
  source 1..30: mol_type = genomic DNA

SEQ ID NO: 112948 - DNA, 30 bp, Homo sapiens; identical to SEQ ID NO: 81535
  misc_feature 1..30: note = chr17:8774759-8774789
  misc_feature 1..30: note = Hypo
  source 1..30: mol_type = genomic DNA

SEQ ID NO: 112949 - DNA, 102 bp, Homo sapiens; identical to SEQ ID NO: 81536
  misc_feature 1..102: note = chr17:8789475-8789577
  misc_feature 1..102: note = Hypo
  source 1..102: mol_type = genomic DNA

SEQ ID NO: 112950 - DNA, 71 bp, Homo sapiens; identical to SEQ ID NO: 81537
  misc_feature 1..71: note = chr17:8789780-8789851
  misc_feature 1..71: note = Hypo
  source 1..71: mol_type = genomic DNA

SEQ ID NO: 112951 - DNA, 30 bp, Homo sapiens; identical to SEQ ID NO: 81538
  misc_feature 1..30: note = chr17:8849594-8849624
  misc_feature 1..30: note = Hypo
  source 1..30: mol_type = genomic DNA

SEQ ID NO: 112952 - DNA, 889 bp, Homo sapiens
  misc_feature 1..889: note = chr17:8868582-8869471
  misc_feature 1..889: note = Hyper
  source 1..889: mol_type = genomic DNA
ccctacgacacagggcgtcctgtgtcagaggcaggaggctgaggacacagctgcgcagagccgcccagcagaggttacccggataacgataagtggtccccgcgacgccccttaagtctctggggttatctggagcgcaggtttgcagacccgctgcccccgcggtgggccaggtccacggggccggaagatagcaggatctgtccagccctcgggctgcggcggctgctcgcggagcccactctccccgacggtccccagcttgctccagctctgcctggagctcccatgcgtgccctccgcatccgccctggccgcccagtcacacacctgcagtccccgccgggcgccgagcccctctccagcggcgactccctgcgattcgggtgaccgtcgggaccaccgcgccccagctggagccgcgcggcgagccgcagcatctgcccagcctgggctcctccggcgggcggggcggagcctgtcagggggcggggcctaatggggcggggctgaccgcggagccggcctctccagccacctggcggcccggcagcgtcagccaggtgcgcgcccggccccacatcctctgggtcacgcccccgaggccgcaaggcgtctgagaagcagccccggctctgacccgccagccctcggaagaagcagaccctggccggtccatggcagtggcccgaggggcaccagcgcggagcaccagcgacccccaaggagtaaggggaggttaggcccccgcgtcggaagcgcggctttggccccgcaggagggctgggcggagcaggggggcaggtctggggtaggggcttaggggaaagacgagaaagaggaagctccgacgagctgcttccttctctcactgcgacccacttcctct

SEQ ID NO: 112953 - DNA, 1650 bp, Homo sapiens
  misc_feature 1..1650: note = chr17:8906188-8907838
  misc_feature 1..1650: note = Hyper
  source 1..1650: mol_type = genomic DNA
gtgtcccaagttacacgcatcctatcttggcccagctccactggagcccgagcggcggggcgcagggtgcgagcgggaggctggtgttctgcccgcgatgggcaggggagccgggtggccgcggggcgaggagccgcgagggccgggccggcgtgacaccacctggcggagtctcggggaagagtcttaaaggcgcgcgctcctccgtgccccgcgcactcgaacgggagccgcggagagctcgcctcccgctgccgccggcgcctcggggaggtaagtgccacccgcggatcccgagtcgcggccgggtgggggcggcccgcggctgccccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgctattttcacacctcccggtgccccggccccggcgcctgattcagtgcttagtaattaatttggcgtttcagaatggtcagcgggctggataatgggtgcattcatcccccgggctaatctgaacagaggtgggaagaaaggctttcacagacagaaaatgccattcgccgagcgctcaaaggggctgtcactcccagaataaatcgccgccgcgcccgccggctcctctggccatttccatacagctccggcccgcgccgcggacccgccggcctcggcctcggctcccgggaatcactcactcgagtgccttcgacgggaaagtcgggcgagagctggacccaggcgggggccgagggaaacggggaaactggagactcgggtgaaggccgcaggggacaaagagattgattagaaaatcaaacgcgcatctagaaggaggcgcaggcgactgctcaaggcgcggacggcggagctggggctcgggagcgtccgtccaaaacccccgaggttcgccaaagaggagggcccgcggcccagaccctccggagcgtgcccgaggcgacacggcaagcttctggggctcccaaattgtgaatggagttcaatgcacaagcatagatagtagaaacagggtcgacctgcacagactttttattccgagttccttgtgctatcagccccgtcgccctcgcggcctggaaggtgacacggtgtcttccccggcctcctgctcgccacccctgttgggaccctcgggtccgcctggggacatctgctgagcgggtgacggaggctttatcctttgatcccttctggatccggtgacgcgctaagtgttgggc

SEQ ID NO: 112954 - DNA, 30 bp, Homo sapiens; identical to SEQ ID NO: 81545
  misc_feature 1..30: note = chr17:8924243-8924273
  misc_feature 1..30: note = Hyper
  source 1..30: mol_type = genomic DNA

SEQ ID NO: 112955 - DNA, 243 bp, Homo sapiens; identical to SEQ ID NO: 81546
  misc_feature 1..243: note = chr17:8925590-8925833
  misc_feature 1..243: note = Hyper
  source 1..243: mol_type = genomic DNA

SEQ ID NO: 112956 - DNA, 42 bp, Homo sapiens; identical to SEQ ID NO: 81547
  misc_feature 1..42: note = chr17:8926060-8926102
  misc_feature 1..42: note = Hyper
  source 1..42: mol_type = genomic DNA

SEQ ID NO: 112957 - DNA, 83 bp, Homo sapiens; identical to SEQ ID NO: 81549
  misc_feature 1..83: note = chr17:9029329-9029412
  misc_feature 1..83: note = Hypo
  source 1..83: mol_type = genomic DNA

SEQ ID NO: 112958 - DNA, 30 bp, Homo sapiens; identical to SEQ ID NO: 81550
  misc_feature 1..30: note = chr17:9065719-9065749
  misc_feature 1..30: note = Hypo
  source 1..30: mol_type = genomic DNA

SEQ ID NO: 112959 - DNA, 44 bp, Homo sapiens; identical to SEQ ID NO: 81551
  misc_feature 1..44: note = chr17:9143066-9143110
  misc_feature 1..44: note = Hyper
  source 1..44: mol_type = genomic DNA

SEQ ID NO: 112960 - DNA, 39 bp, Homo sapiens; identical to SEQ ID NO: 81552
  misc_feature 1..39: note = chr17:9143465-9143504
  misc_feature 1..39: note = Hyper
  source 1..39: mol_type = genomic DNA

SEQ ID NO: 112961 - DNA, 58 bp, Homo sapiens; identical to SEQ ID NO: 81555
  misc_feature 1..58: note = chr17:9547977-9548035
  misc_feature 1..58: note = Hyper
  source 1..58: mol_type = genomic DNA

SEQ ID NO: 112962 - DNA, 36 bp, Homo sapiens; identical to SEQ ID NO: 44995
  misc_feature 1..36: note = chr17:9808139-9808175
  misc_feature 1..36: note = Hypo
  source 1..36: mol_type = genomic DNA

SEQ ID NO: 112963 - DNA, 188 bp, Homo sapiens; identical to SEQ ID NO: 81557
  misc_feature 1..188: note = chr17:9810166-9810354
  misc_feature 1..188: note = Hypo
  source 1..188: mol_type = genomic DNA

SEQ ID NO: 112964 - DNA, 42 bp, Homo sapiens; identical to SEQ ID NO: 81558
  misc_feature 1..42: note = chr17:9851040-9851082
  misc_feature 1..42: note = Hypo
  source 1..42: mol_type = genomic DNA

SEQ ID NO: 112965 - DNA, 26 bp, Homo sapiens
  misc_feature 1..26: note = chr17:9913746-9913772
  misc_feature 1..26: note = Hypo
  source 1..26: mol_type = genomic DNA
gcatgagccaccgcgcccagcctgat

SEQ ID NO: 112966 - DNA, 1609 bp, Homo sapiens
  misc_feature 1..1609: note = chr17:10101056-10102665
  misc_feature 1..1609: note = Hyper
  source 1..1609: mol_type = genomic DNA
ccaaggcagcacgaccgtccacgggtcatcaggctctagactccggggtggagacgcggggctgcgggaccgagtcggtgccactttctcgcacccctgatcctccgtgcctcttcccaagaccgccagacccttcaccggcccctgccactgccgggaacgctcccgcctgctccttaactcacacaggcaacaagttctcgcttcctcagagcagccacggtgtgctccggaggcccggcgcaaggtggaagctccccgcgagtccgcgttgcccacgccccgaggggcgcccgctgccgtcgctgccccccaggagcgtggagctacaggtagcgccggcaagggctgccccccggggcgcccctccgaccgggacgctgcggcatccccggaacgggcaacaggtacgcgagcgcaccgaggaccgcagccccggctcctacagccccggccctcgccccttacctccagcaactgcacgtagctcgccgggaaccagccacggagcccgtcctccttctcgccttcccaccagccgccgtccgggacctgcagcagcgtgatcagctcgcccgcggcgaagcgcagcccctggccgtgccgctccccggagaaggggtacagggtccggcagcgagcgccggacatggccttggcgcccgggttcacagcgcagcctgcattcccgccgagccccacgggctgggcagcggctccgcggggtcccaggcgcccggcgctccgggctcccgcgctctgggcgcgcgccgtctctggggtgcgcgggggtcctcaggcaggcgggggacgcgcgctccgcgccgggaagcagagactcgttggcttcgcagagcgagcggcgacgcccccgggccgggcagctcgcggatcctagctctgggctggggggcggggctcagggggaggagacccaggcgccgcgggctccggagacaacttcccgggaacgcggaacgcgggctgccgccgcgagggctggccggggccggggccgggaccggggccggggccgccctggcgcgcggaaatgcgcagctcccccgggaggtgggacccggagcatcccccgcggcaggactccgcggcgggcggccgtggagaggagctggcggccgggtggccgggcgggggttagctcactggcgagggggcgggccggggcggggccagggcggccacgcccgcggagggctgcgcgctccctcgcagaggggcctgtcactggggagaggggctcccactcgcgcccccaccgccggggaccgcgggaatggaaacgcccctctgttctgtgcctgctttgtaggcctggcggcccgtggcgtgcgggcggcttcttcgaggtgtctgcgagggatcgtttgtggttgtcattgtagtggttgaacctggggttgaacttgtctcaccggaaactgaacaatgggtgaaagacaggtttgaagcctggcgcctgagcccagcagcctggtggcagcgtggcacgctggagggacggaatggagagaagacggggtcggagttgatagaattggaaacagtcgatggggataaatggaggaaaggcgaacggtgagaggaacag

SEQ ID NO: 112967 - DNA, 43 bp, Homo sapiens; identical to SEQ ID NO: 79962
  misc_feature 1..43: note = chr17:10146608-10146651
  misc_feature 1..43: note = Hypo
  source 1..43: mol_type = genomic DNA

SEQ ID NO: 112968 - DNA, 42 bp, Homo sapiens; identical to SEQ ID NO: 79963
  misc_feature 1..42: note = chr17:10212555-10212597
  misc_feature 1..42: note = Hypo
  source 1..42: mol_type = genomic DNA

SEQ ID NO: 112969 - DNA, 201 bp, Homo sapiens; identical to SEQ ID NO: 79964
  misc_feature 1..201: note = chr17:10212807-10213008
  misc_feature 1..201: note = Hypo
  source 1..201: mol_type = genomic DNA

SEQ ID NO: 112970 - DNA, 30 bp, Homo sapiens; identical to SEQ ID NO: 79965
  misc_feature 1..30: note = chr17:10303782-10303812
  misc_feature 1..30: note = Hypo
  source 1..30: mol_type = genomic DNA

SEQ ID NO: 112971 - DNA, 161 bp, Homo sapiens; identical to SEQ ID NO: 79966
  misc_feature 1..161: note = chr17:10404695-10404856
  misc_feature 1..161: note = Hypo
  source 1..161: mol_type = genomic DNA

SEQ ID NO: 112972 - DNA, 30 bp, Homo sapiens; identical to SEQ ID NO: 79967
  misc_feature 1..30: note = chr17:10558730-10558760
  misc_feature 1..30: note = Hypo
  source 1..30: mol_type = genomic DNA

SEQ ID NO: 112973 - DNA, 463 bp, Homo sapiens; identical to SEQ ID NO: 79968
  misc_feature 1..463: note = chr17:10632887-10633350
  misc_feature 1..463: note = Hyper
  source 1..463: mol_type = genomic DNA

SEQ ID NO: 112974 - DNA, 131 bp, Homo sapiens; identical to SEQ ID NO: 79972
  misc_feature 1..131: note = chr17:11143519-11143650
  misc_feature 1..131: note = Hyper
  source 1..131: mol_type = genomic DNA

SEQ ID NO: 112975 - DNA, 218 bp, Homo sapiens
  misc_feature 1..218: note = chr17:11144318-11144536
  misc_feature 1..218: note = Hyper
  source 1..218: mol_type = genomic DNA
gccccaccccgtgaccggctccccgtcttgtcccgcaggacccgcccggacgggaccacgccgccgccgccgccgccgccgcccggagccgcgcttcgggtcctgcctgagccgagccgcgcgcggggccgcagtcaccgccggcgggggatggggctgcccaggaggcgcgccgagcccgcagggggagcgcggagccggcgcgcagcctgagagcc

SEQ ID NO: 112976 - DNA, 370 bp, Homo sapiens
  misc_feature 1..370: note = chr17:11144914-11145284
  misc_feature 1..370: note = Hyper
  source 1..370: mol_type = genomic DNA
acggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctg

SEQ ID NO: 112977 - DNA, 45 bp, Homo sapiens; identical to SEQ ID NO: 79977
  misc_feature 1..45: note = chr17:11461634-11461679
  misc_feature 1..45: note = Hypo
  source 1..45: mol_type = genomic DNA

SEQ ID NO: 112978 - DNA, 97 bp, Homo sapiens; identical to SEQ ID NO: 79978
  misc_feature 1..97: note = chr17:11501937-11502034
  misc_feature 1..97: note = Hyper
  source 1..97: mol_type = genomic DNA

SEQ ID NO: 112979 - DNA, 30 bp, Homo sapiens; identical to SEQ ID NO: 79979
  misc_feature 1..30: note = chr17:11507618-11507648
  misc_feature 1..30: note = Hypo
  source 1..30: mol_type = genomic DNA

SEQ ID NO: 112980 - DNA, 158 bp, Homo sapiens; identical to SEQ ID NO: 79980
  misc_feature 1..158: note = chr17:11572707-11572865
  misc_feature 1..158: note = Hypo
  source 1..158: mol_type = genomic DNA

SEQ ID NO: 112981 - DNA, 165 bp, Homo sapiens; identical to SEQ ID NO: 44999
  misc_feature 1..165: note = chr17:11637555-11637720
  misc_feature 1..165: note = Hypo
  source 1..165: mol_type = genomic DNA

SEQ ID NO: 112982 - DNA, 192 bp, Homo sapiens; identical to SEQ ID NO: 79983
  misc_feature 1..192: note = chr17:11672352-11672544
  misc_feature 1..192: note = Hypo
  source 1..192: mol_type = genomic DNA

SEQ ID NO: 112983 - DNA, 16 bp, Homo sapiens
  misc_feature 1..16: note = chr17:11808260-11808276
  misc_feature 1..16: note = Hypo
  source 1..16: mol_type = genomic DNA
agagaataggctgggc

SEQ ID NO: 112984 - DNA, 32 bp, Homo sapiens; identical to SEQ ID NO: 79988
  misc_feature 1..32: note = chr17:11820735-11820767
  misc_feature 1..32: note = Hypo
  source 1..32: mol_type = genomic DNA

SEQ ID NO: 112985 - DNA, 40 bp, Homo sapiens; identical to SEQ ID NO: 79989
  misc_feature 1..40: note = chr17:11836966-11837006
  misc_feature 1..40: note = Hypo
  source 1..40: mol_type = genomic DNA

SEQ ID NO: 112986 - DNA, 40 bp, Homo sapiens; identical to SEQ ID NO: 79990
  misc_feature 1..40: note = chr17:11838965-11839005
  misc_feature 1..40: note = Hypo
  source 1..40: mol_type = genomic DNA

SEQ ID NO: 112987 - DNA, 30 bp, Homo sapiens; identical to SEQ ID NO: 79991
  misc_feature 1..30: note = chr17:11866757-11866787
  misc_feature 1..30: note = Hypo
  source 1..30: mol_type = genomic DNA

SEQ ID NO: 112988 - DNA, 97 bp, Homo sapiens; identical to SEQ ID NO: 79993
  misc_feature 1..97: note = chr17:12150178-12150275
  misc_feature 1..97: note = Hypo
  source 1..97: mol_type = genomic DNA

SEQ ID NO: 112989 - DNA, 66 bp, Homo sapiens; identical to SEQ ID NO: 79994
  misc_feature 1..66: note = chr17:12568725-12568791
  misc_feature 1..66: note = Hyper
  source 1..66: mol_type = genomic DNA

SEQ ID NO: 112990 - DNA, 230 bp, Homo sapiens; identical to SEQ ID NO: 79995
  misc_feature 1..230: note = chr17:12569172-12569402
  misc_feature 1..230: note = Hyper
  source 1..230: mol_type = genomic DNA

SEQ ID NO: 112991 - DNA, 297 bp, Homo sapiens; identical to SEQ ID NO: 79996
  misc_feature 1..297: note = chr17:12693203-12693500
  misc_feature 1..297: note = Hyper
  source 1..297: mol_type = genomic DNA

SEQ ID NO: 112992 - DNA, 48 bp, Homo sapiens; identical to SEQ ID NO: 79997
  misc_feature 1..48: note = chr17:12877698-12877746
  misc_feature 1..48: note = Hyper
  source 1..48: mol_type = genomic DNA

SEQ ID NO: 112993 - DNA, 30 bp, Homo sapiens; identical to SEQ ID NO: 79998
  misc_feature 1..30: note = chr17:13400298-13400328
  misc_feature 1..30: note = Hypo
  source 1..30: mol_type = genomic DNA

SEQ ID NO: 112994 - DNA, 1814 bp, Homo sapiens
  misc_feature 1..1814: note = chr17:13503842-13505656
  misc_feature 1..1814: note = Hyper
  source 1..1814: mol_type = genomic DNA
ctcaccggtaccaggcgaggcccttgtcgtagctgcggtcgaagaagtggggctcggcgcccacggcgcgcacgtcggggtgcacgcgcaggaactccagcagcgcccgcgtgccgcccttcttcactccgatgatgatggcctgcggcagctgcttgctgccttcgtccaggagcagcgccagggtccccggcggggcctcggccacggtgcttccggccccggagccgcccggaccccctgacaggccaggggactcttcttcccaggccgcctcctcgccgtcgtcgcggggcgcgggcggccggcgcctccgccactgcggcagttgcaggaggcgctttctctgtgccgccgccggccacaccgccagctccctcgggcctccggccaggacgccgccaccaggggcccccgcctcctcgccgccgccggacagccccacgacggggccggacagggtctggcagcgctcggccaggcagtagaagacgtaaagggacgtgagcagggagcagagcatcagcaagaacttccggaagatgctgcgggacagcggctcggccgaggtggagagggcactggccgggcccggaggggccatcctagccggaggcgacgtcgggcaacgcgccggccatgctaggcctggaccccgacaggtgccagagcatccccccggcgggccagcgcgctggacggaggccacatcgccgtgcgcccctgtggccgtgcgaactgtcccgggaggcagcggccggggctccgcggggaaacggaatcccgggggccccgcgcaggatccctgcctccagtcgagggagcgggaaggggaacgcgggtccgtgcttaagaaaccatcgtcttagactcgcccaagtcctgagcttggggcagccttggcccctcggttccccgcaagagtcgccggaatcggggtcttggcagcggtgtcgaaggcgtgcgtctcagccccggccccgagagacttctcggcgcggatctccgctcagcgatcctgcatcactggctcggtccccgtgagggcacgcgcggctgccgggcctctgcgctccgtgcgctccagacagtggcgagcgacagtgacttccagccccggctttctctggtccccttgcccgcctgggcgcgttctctccgcccgagttcaggttctctcagccaaggagcgaggtccccccgagtccctctgcccgagcgggagacaggaggcccgtgcagagccgtccacccctctccgtagcgccgggttgctccaaactgctcttggaccccacctgtgagccgcgtggctgggctgggctgggctgcgcgggacctgtcagcggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaatggcactggagagggcgggggcggcaggggcgacgccccttccccagtgtcccccattcctccccgcggcttcgcccccttccagtggatccggtgtctgcggcggctccggggttgcctgagtgacagctaaggccggccggatctctgggggcctgacttccacccaagacgccactagcttggtgaggggccccagagctctccaccgcagctcagccctccgcagccctgaccct

SEQ ID NO: 112995 - DNA, 30 bp, Homo sapiens; identical to SEQ ID NO: 80002
  misc_feature 1..30: note = chr17:13791939-13791969
  misc_feature 1..30: note = Hypo
  source 1..30: mol_type = genomic DNA

SEQ ID NO: 112996 - DNA, 663 bp, Homo sapiens
  misc_feature 1..663: note = chr17:14200545-14201208
  misc_feature 1..663: note = Hyper
  source 1..663: mol_type = genomic DNA
tctcatccctgcagtcggcttggccagcagcagccgcggggctgcgccagtgcccgcctctggccaggggttcccgcgcctcgagcagcgccctgggcccttctacgggaagaggggatcgcggcgcccgcgacacccaggagctcggacgaccgcagcctcaccactaacccccaacaaaggtacagcgggagtccaggccgagataaagttcccttcccagtccgctggggagacaactggccgcggctgccctctgctccgctcccggctgtcccgcagctgcgaggccggggccagagcgctcccttccgggcgggcatcggagccgctgcggcgccgaccgcccttcgcgcccgggccgctggagaaggcggagcgagctcgcagctgctaacccccgaggggccgcctcgctggcgaggggagcgggaggaaggtccggattccggtggcaggaactggggctctgggccaccggttcaggctgccccaggaaatgcctgctttgcggtgccgcagagggtatagaggagctcggccccagagggtggctgttggggaggcggagctggccgcaggctggagcagctgcggagcctcccatcccgagcctagaatcggagaaatttcaggcggaaaatactgcggggatggtttggc

SEQ ID NO: 112997 - DNA, 326 bp, Homo sapiens; identical to SEQ ID NO: 80007
  misc_feature 1..326: note = chr17:14202945-14203271
  misc_feature 1..326: note = Hyper
  source 1..326: mol_type = genomic DNA

SEQ ID NO: 112998 - DNA, 30 bp, Homo sapiens; identical to SEQ ID NO: 80008
  misc_feature 1..30: note = chr17:14203695-14203725
  misc_feature 1..30: note = Hyper
  source 1..30: mol_type = genomic DNA

SEQ ID NO: 112999 - DNA, 231 bp, Homo sapiens; identical to SEQ ID NO: 36390
  misc_feature 1..231: note = chr17:14204011-14204242
  misc_feature 1..231: note = Hyper
  source 1..231: mol_type = genomic DNA

SEQ ID NO: 113000 - DNA, 332 bp, Homo sapiens; identical to SEQ ID NO: 80010
  misc_feature 1..332: note = chr17:14204502-14204834
  misc_feature 1..332: note = Hyper
  source 1..332: mol_type = genomic DNA

SEQ ID NO: 113001 - DNA, 1203 bp, Homo sapiens; identical to SEQ ID NO: 80011
  misc_feature 1..1203: note = chr17:14205175-14206378
  misc_feature 1..1203: note = Hyper
  source 1..1203: mol_type = genomic DNA

SEQ ID NO: 113002 - DNA, 142 bp, Homo sapiens
  misc_feature 1..142: note = chr17:14212544-14212686
  misc_feature 1..142: note = Hyper
  source 1..142: mol_type = genomic DNA
ggtgtcgcgcgggatcgccgcctctggcccgggggccgctgagccggagacagatggcggagcttcccagtgcgggggcagggctggcagccgagactggggccgcctcccccgcccctaggctggccgggtagtcctccgt

SEQ ID NO: 113003 - DNA, 186 bp, Homo sapiens; identical to SEQ ID NO: 80016
  misc_feature 1..186: note = chr17:14861051-14861237
  misc_feature 1..186: note = Hypo
  source 1..186: mol_type = genomic DNA

SEQ ID NO: 113004 - DNA, 17 bp, Homo sapiens
  misc_feature 1..17: note = chr17:14914268-14914285
  misc_feature 1..17: note = Hypo
  source 1..17: mol_type = genomic DNA
tataaaacccgatgtcg

SEQ ID NO: 113005 - DNA, 20 bp, Homo sapiens
  misc_feature 1..20: note = chr17:15149034-15149054
  misc_feature 1..20: note = Hypo
  source 1..20: mol_type = genomic DNA
gagccacaggccgggcgcag

SEQ ID NO: 113006 - DNA, 63 bp, Homo sapiens; identical to SEQ ID NO: 80020
  misc_feature 1..63: note = chr17:15164652-15164715
  misc_feature 1..63: note = Hyper
  source 1..63: mol_type = genomic DNA

SEQ ID NO: 113007 - DNA, 41 bp, Homo sapiens; identical to SEQ ID NO: 80021
  misc_feature 1..41: note = chr17:15164923-15164964
  misc_feature 1..41: note = Hyper
  source 1..41: mol_type = genomic DNA

SEQ ID NO: 113008 - DNA, 895 bp, Homo sapiens; identical to SEQ ID NO: 80022
  misc_feature 1..895: note = chr17:15165949-15166844
  misc_feature 1..895: note = Hyper
  source 1..895: mol_type = genomic DNA

SEQ ID NO: 113009 - DNA, 295 bp, Homo sapiens; identical to SEQ ID NO: 80024
  misc_feature 1..295: note = chr17:15244291-15244586
  misc_feature 1..295: note = Hyper
  source 1..295: mol_type = genomic DNA

SEQ ID NO: 113010 - DNA, 370 bp, Homo sapiens
  misc_feature 1..370: note = chr17:15244894-15245264
  misc_feature 1..370: note = Hyper
  source 1..370: mol_type = genomic DNA
accacctgcagccctcgactggggcccagaccagtctggccctggccccgcctttcctatctgtgacgatagcagcgcctgagggccactcagcggccgccccggccggctcgccggagctgactggccagttataggagaggcgggagctgtcaggccaggagggaaacccgtcgggcggcggttactatggacgcgctcacgcttagtaaccgaggctccccgccctccgggagacctccttggtttgggaggtgaaaggggtgaagagtagcccaagggagaggcctcggtgatttcccgacctctcctgtgaagcctgattcggaactcttccagctgcgaagaacttggccgattctaaggcaca

SEQ ID NO: 113011 - DNA, 299 bp, Homo sapiens
  misc_feature 1..299: note = chr17:15820731-15821030
  misc_feature 1..299: note = Hyper
  source 1..299: mol_type = genomic DNA
ggcgccaggctgagccggcgcagccaaatctcctcagggctgcggccgcccatcctgggaccgcgcccctgcaccatgtggacggtgcaggctgggctggggtctgacgcccgaggaccccttccccctgcccagccctgcccccgcaggcactggagggctcccctaggcggggctccgggctagggaacagggatgcccagcaatctcgcgctcccggggccggactccagcggcaggggcctccccaggctgcggctccgcgccggtgacgggggctctgccgaagggctcctgcc

SEQ ID NO: 113012 - DNA, 146 bp, Homo sapiens; identical to SEQ ID NO: 80034
  misc_feature 1..146: note = chr17:15847860-15848006
  misc_feature 1..146: note = Hyper
  source 1..146: mol_type = genomic DNA

SEQ ID NO: 113013 - DNA, 312 bp, Homo sapiens; identical to SEQ ID NO: 80035
  misc_feature 1..312: note = chr17:15848567-15848879
  misc_feature 1..312: note = Hyper
  source 1..312: mol_type = genomic DNA

SEQ ID NO: 113014 - DNA, 68 bp, Homo sapiens; identical to SEQ ID NO: 80036
  misc_feature 1..68: note = chr17:15849143-15849211
  misc_feature 1..68: note = Hyper
  source 1..68: mol_type = genomic DNA

SEQ ID NO: 113015 - DNA, 30 bp, Homo sapiens; identical to SEQ ID NO: 80037
  misc_feature 1..30: note = chr17:15855838-15855868
  misc_feature 1..30: note = Hypo
  source 1..30: mol_type = genomic DNA

SEQ ID NO: 113016 - DNA, 34 bp, Homo sapiens; identical to SEQ ID NO: 80042
  misc_feature 1..34: note = chr17:16255661-16255695
  misc_feature 1..34: note = Hyper
  source 1..34: mol_type = genomic DNA

SEQ ID NO: 113017 - DNA, 97 bp, Homo sapiens; identical to SEQ ID NO: 80043
  misc_feature 1..97: note = chr17:16256941-16257038
  misc_feature 1..97: note = Hyper
  source 1..97: mol_type = genomic DNA

SEQ ID NO: 113018 - DNA, 316 bp, Homo sapiens; identical to SEQ ID NO: 80045
  misc_feature 1..316: note = chr17:16282207-16282523
  misc_feature 1..316: note = Hypo
  source 1..316: mol_type = genomic DNA

SEQ ID NO: 113019 - DNA, 23 bp, Homo sapiens
  misc_feature 1..23: note = chr17:16283522-16283545
  misc_feature 1..23: note = Hypo
  source 1..23: mol_type = genomic DNA
tccgcgcccggccaggggcgcgc

SEQ ID NO: 113020 - DNA, 277 bp, Homo sapiens; identical to SEQ ID NO: 80047
  misc_feature 1..277: note = chr17:16310319-16310596
  misc_feature 1..277: note = Hyper
  source 1..277: mol_type = genomic DNA

SEQ ID NO: 113021 - DNA, 159 bp, Homo sapiens; identical to SEQ ID NO: 80048
  misc_feature 1..159: note = chr17:16432126-16432285
  misc_feature 1..159: note = Hypo
  source 1..159: mol_type = genomic DNA

SEQ ID NO: 113022 - DNA, 30 bp, Homo sapiens; identical to SEQ ID NO: 80049
  misc_feature 1..30: note = chr17:16440314-16440344
  misc_feature 1..30: note = Hyper
  source 1..30: mol_type = genomic DNA

SEQ ID NO: 113023 - DNA, 812 bp, Homo sapiens; identical to SEQ ID NO: 80050
  misc_feature 1..812: note = chr17:16471976-16472788
  misc_feature 1..812: note = Hyper
  source 1..812: mol_type = genomic DNA

SEQ ID NO: 113024 - DNA, 109 bp, Homo sapiens; identical to SEQ ID NO: 80051
  misc_feature 1..109: note = chr17:16492360-16492469
  misc_feature 1..109: note = Hyper
  source 1..109: mol_type = genomic DNA

SEQ ID NO: 113025 - DNA, 400 bp, Homo sapiens
  misc_feature 1..400: note = chr17:16570153-16570553
  misc_feature 1..400: note = Hyper
  source 1..400: mol_type = genomic DNA
gctgccctttggtggcgttgggcacagatcaccgcctggcagaagcccgcgacagcgtggagggagcgatgcccccgcccgggactcctggtgggtgatggcgccgggaggccttggctgggacagatcggggcctcccggtcggtcagcgactcgcgcccggctgcgactttcagaggcttttggacaccgcctgccatcccgccgcgcctctcggggtccgctcccccggactggccctgcccacggagcgcgggtagcagccggcggccaggagccagtggcgggagccaccggtgggaaaaccggcaggaggctgcgctggaccccgctgggcagcgccaatccctaaggcagccgggcgggtgagctaacggcggcgggggcggctgagaggctg

SEQ ID NO: 113026 - DNA, 280 bp, Homo sapiens; identical to SEQ ID NO: 80054
  misc_feature 1..280: note = chr17:16570673-16570953
  misc_feature 1..280: note = Hyper
  source 1..280: mol_type = genomic DNA

SEQ ID NO: 113027 - DNA, 39 bp, Homo sapiens; identical to SEQ ID NO: 80056
  misc_feature 1..39: note = chr17:16830521-16830560
  misc_feature 1..39: note = Hypo
  source 1..39: mol_type = genomic DNA

SEQ ID NO: 113028 - DNA, 30 bp, Homo sapiens; identical to SEQ ID NO: 80058
  misc_feature 1..30: note = chr17:16993611-16993641
  misc_feature 1..30: note = Hypo
  source 1..30: mol_type = genomic DNA

SEQ ID NO: 113029 - DNA, 59 bp, Homo sapiens; identical to SEQ ID NO: 80059
  misc_feature 1..59: note = chr17:17062602-17062661
  misc_feature 1..59: note = Hypo
  source 1..59: mol_type = genomic DNA

SEQ ID NO: 113030 - DNA, 30 bp, Homo sapiens; identical to SEQ ID NO: 80060
  misc_feature 1..30: note = chr17:17067369-17067399
  misc_feature 1..30: note = Hypo
  source 1..30: mol_type = genomic DNA

SEQ ID NO: 113031 - DNA, 30 bp, Homo sapiens; identical to SEQ ID NO: 80061
  misc_feature 1..30: note = chr17:17090124-17090154
  misc_feature 1..30: note = Hypo
  source 1..30: mol_type = genomic DNA

SEQ ID NO: 113032 - DNA, 30 bp, Homo sapiens; identical to SEQ ID NO: 80062
  misc_feature 1..30: note = chr17:17100986-17101016
  misc_feature 1..30: note = Hypo
  source 1..30: mol_type = genomic DNA

SEQ ID NO: 113033 - DNA, 105 bp, Homo sapiens; identical to SEQ ID NO: 80063
  misc_feature 1..105: note = chr17:17123888-17123993
  misc_feature 1..105: note = Hypo
  source 1..105: mol_type = genomic DNA

SEQ ID NO: 113034 - DNA, 84 bp, Homo sapiens; identical to SEQ ID NO: 80064
  misc_feature 1..84: note = chr17:17146203-17146287
  misc_feature 1..84: note = Hypo
  source 1..84: mol_type = genomic DNA

SEQ ID NO: 113035 - DNA, 67 bp, Homo sapiens; identical to SEQ ID NO: 80065
  misc_feature 1..67: note = chr17:17204144-17204211
  misc_feature 1..67: note = Hyper
  source 1..67: mol_type = genomic DNA

SEQ ID NO: 113036 - DNA, 30 bp, Homo sapiens; identical to SEQ ID NO: 80066
  misc_feature 1..30: note = chr17:17250180-17250210
  misc_feature 1..30: note = Hypo
  source 1..30: mol_type = genomic DNA

SEQ ID NO: 113037 - DNA, 100 bp, Homo sapiens; identical to SEQ ID NO: 80067
  misc_feature 1..100: note = chr17:17395947-17396047
  misc_feature 1..100: note = Hypo
  source 1..100: mol_type = genomic DNA

SEQ ID NO: 113038 - DNA, 966 bp, Homo sapiens
  misc_feature 1..966: note = chr17:17398606-17399572
  misc_feature 1..966: note = Hyper
  source 1..966: mol_type = genomic DNA
cttcttgttccgcagcgccttcttgtgcagcacgtcgcagtactgcaccgagaccttgcggtgcaggtctgggctcatctcgctgggcagcttggccatggcgaagagcgcgcggaacatctggtccaggctgctgttcttcttggccgagatctcgaagtaggcgcagcgctgggggtcgtcgcccaccagctgctcgatctcgcgctggtccacctcgcggtagaagtcgcggtcacccttgttgccgcagatgaccaggggcacgtccacgttctccttggttttgttcttgaggcaagacttggtgtcgaggatctgctgcctgagccgctgcacctcctcgaaggagtcgcggttgtccagactgaacaccaggatgaaaacgtctcctagagggggcacagagagcagaaaaggagaaggtgagggtggccgcccaggggacaagtcgggctgactttgaggccgcgcggggcgcgctagcctctctaagcgcgaagcgcactactcggcgcgcggcagccggaccggcgctcgcggggcgccctggccgagggttccccgcccttccctcccgcacctgcccggcccccggctcacctgtgaggatggagaggcgccgcatggcggggaacgggtggttgccggacgtgtcgaggatgtcgagctggtagacctcgccgcggatggagtagaacttgcggtggaagtcctcgatggtaggcgtgtaggcgtcctcgaagcggccggtgaggaagcgcgacacgatggccgtcttgcccaccttggacgagccgaggatgaccatgcgatagcagttcttggccgggatactcagctccgagtcgctcgggcacatcttcttgatcatcgcggccagtttcattgggcagaggggccgcgagggcgggcgcggggccgagagaagggcagagagcggctgagggtcgctggggtggcacg

SEQ ID NO: 113039 - DNA, 30 bp, Homo sapiens; identical to SEQ ID NO: 80070
  misc_feature 1..30: note = chr17:17466959-17466989
  misc_feature 1..30: note = Hypo
  source 1..30: mol_type = genomic DNA

SEQ ID NO: 113040 - DNA, 198 bp, Homo sapiens; identical to SEQ ID NO: 80071
  misc_feature 1..198: note = chr17:17579330-17579528
  misc_feature 1..198: note = Hypo
  source 1..198: mol_type = genomic DNA

SEQ ID NO: 113041 - DNA, 39 bp, Homo sapiens; identical to SEQ ID NO: 45009
  misc_feature 1..39: note = chr17:17592178-17592217
  misc_feature 1..39: note = Hypo
  source 1..39: mol_type = genomic DNA

SEQ ID NO: 113042 - DNA, 30 bp, Homo sapiens; identical to SEQ ID NO: 80073
  misc_feature 1..30: note = chr17:17612465-17612495
  misc_feature 1..30: note = Hypo
  source 1..30: mol_type = genomic DNA

SEQ ID NO: 113043 - DNA, 46 bp, Homo sapiens; identical to SEQ ID NO: 80074
  misc_feature 1..46: note = chr17:17687009-17687055
  misc_feature 1..46: note = Hyper
  source 1..46: mol_type = genomic DNA

SEQ ID NO: 113044 - DNA, 36 bp, Homo sapiens; identical to SEQ ID NO: 80075
  misc_feature 1..36: note = chr17:17700921-17700957
  misc_feature 1..36: note = Hypo
  source 1..36: mol_type = genomic DNA

SEQ ID NO: 113045 - DNA, 183 bp, Homo sapiens; identical to SEQ ID NO: 80076
  misc_feature 1..183: note = chr17:17717969-17718152
  misc_feature 1..183: note = Hypo
  source 1..183: mol_type = genomic DNA

SEQ ID NO: 113046 - DNA, 30 bp, Homo sapiens; identical to SEQ ID NO: 80077
  misc_feature 1..30: note = chr17:17750275-17750305
  misc_feature 1..30: note = Hypo
  source 1..30: mol_type = genomic DNA

SEQ ID NO: 113047 - DNA, 114 bp, Homo sapiens; identical to SEQ ID NO: 80078
  misc_feature 1..114: note = chr17:17891258-17891372
  misc_feature 1..114: note = Hypo
  source 1..114: mol_type = genomic DNA

SEQ ID NO: 113048 - DNA, 40 bp, Homo sapiens; identical to SEQ ID NO: 45011
  misc_feature 1..40: note = chr17:17910311-17910351
  misc_feature 1..40: note = Hypo
  source 1..40: mol_type = genomic DNA

SEQ ID NO: 113049 - DNA, 38 bp, Homo sapiens; identical to SEQ ID NO: 45012
  misc_feature 1..38: note = chr17:18070928-18070966
  misc_feature 1..38: note = Hypo
  source 1..38: mol_type = genomic DNA

SEQ ID NO: 113050 - DNA, 142 bp, Homo sapiens; identical to SEQ ID NO: 80082
  misc_feature 1..142: note = chr17:18127894-18128036
  misc_feature 1..142: note = Hypo
  source 1..142: mol_type = genomic DNA

SEQ ID NO: 113051 - DNA, 38 bp, Homo sapiens; identical to SEQ ID NO: 80083
  misc_feature 1..38: note = chr17:18157976-18158014
  misc_feature 1..38: note = Hypo
  source 1..38: mol_type = genomic DNA

SEQ ID NO: 113052 - DNA, 261 bp, Homo sapiens; identical to SEQ ID NO: 80084
  misc_feature 1..261: note = chr17:18163093-18163354
  misc_feature 1..261: note = Hypo
  source 1..261: mol_type = genomic DNA

SEQ ID NO: 113053 - DNA, 30 bp, Homo sapiens; identical to SEQ ID NO: 80087
  misc_feature 1..30: note = chr17:18267413-18267443
  misc_feature 1..30: note = Hypo
  source 1..30: mol_type = genomic DNA

SEQ ID NO: 113054 - DNA, 196 bp, Homo sapiens; identical to SEQ ID NO: 80088
  misc_feature 1..196: note = chr17:18314944-18315140
  misc_feature 1..196: note = Hyper
  source 1..196: mol_type = genomic DNA

SEQ ID NO: 113055 - DNA, 34 bp, Homo sapiens; identical to SEQ ID NO: 80091
  misc_feature 1..34: note = chr17:18538112-18538146
  misc_feature 1..34: note = Hyper
  source 1..34: mol_type = genomic DNA

SEQ ID NO: 113056 - DNA, 93 bp, Homo sapiens; identical to SEQ ID NO: 80092
  misc_feature 1..93: note = chr17:18538206-18538299
  misc_feature 1..93: note = Hyper
  source 1..93: mol_type = genomic DNA

SEQ ID NO: 113057 - DNA, 120 bp, Homo sapiens; identical to SEQ ID NO: 80093
  misc_feature 1..120: note = chr17:18760619-18760739
  misc_feature 1..120: note = Hypo
  source 1..120: mol_type = genomic DNA

SEQ ID NO: 113058 - DNA, 30 bp, Homo sapiens; identical to SEQ ID NO: 80097
  misc_feature 1..30: note = chr17:19211734-19211764
  misc_feature 1..30: note = Hypo
  source 1..30: mol_type = genomic DNA

SEQ ID NO: 113059 - DNA, 34 bp, Homo sapiens; identical to SEQ ID NO: 45015
  misc_feature 1..34: note = chr17:19230161-19230195
  misc_feature 1..34: note = Hypo
  source 1..34: mol_type = genomic DNA

SEQ ID NO: 113060 - DNA, 41 bp, Homo sapiens; identical to SEQ ID NO: 80099
  misc_feature 1..41: note = chr17:19230676-19230717
  misc_feature 1..41: note = Hypo
  source 1..41: mol_type = genomic DNA

SEQ ID NO: 113061 - DNA, 844 bp, Homo sapiens; identical to SEQ ID NO: 80102
  misc_feature 1..844: note = chr17:19436820-19437664
  misc_feature 1..844: note = Hyper
  source 1..844: mol_type = genomic DNA

SEQ ID NO: 113062 - DNA, 30 bp, Homo sapiens; identical to SEQ ID NO: 80103
  misc_feature 1..30: note = chr17:19482865-19482895
  misc_feature 1..30: note = Hyper
  source 1..30: mol_type = genomic DNA

SEQ ID NO: 113063 - DNA, 312 bp, Homo sapiens; identical to SEQ ID NO: 80104
  misc_feature 1..312: note = chr17:19483115-19483427
  misc_feature 1..312: note = Hyper
  source 1..312: mol_type = genomic DNA

SEQ ID NO: 113064 - DNA, 30 bp, Homo sapiens; identical to SEQ ID NO: 80109
  misc_feature 1..30: note = chr17:19611097-19611127
  misc_feature 1..30: note = Hypo
  source 1..30: mol_type = genomic DNA

SEQ ID NO: 113065 - DNA, 49 bp, Homo sapiens; identical to SEQ ID NO: 80110
  misc_feature 1..49: note = chr17:19618412-19618461
  misc_feature 1..49: note = Hypo
  source 1..49: mol_type = genomic DNA

SEQ ID NO: 113066 - DNA, 228 bp, Homo sapiens; identical to SEQ ID NO: 80111
  misc_feature 1..228: note = chr17:19622428-19622656
  misc_feature 1..228: note = Hypo
  source 1..228: mol_type = genomic DNA

SEQ ID NO: 113067 - DNA, 177 bp, Homo sapiens; identical to SEQ ID NO: 80112
  misc_feature 1..177: note = chr17:19648102-19648279
  misc_feature 1..177: note = Hyper
  source 1..177: mol_type = genomic DNA

SEQ ID NO: 113068 - DNA, 95 bp, Homo sapiens; identical to SEQ ID NO: 80113
  misc_feature 1..95: note = chr17:19769817-19769912
  misc_feature 1..95: note = Hypo
  source 1..95: mol_type = genomic DNA

SEQ ID NO: 113069 - DNA, 470 bp, Homo sapiens; identical to SEQ ID NO: 80114
  misc_feature 1..470: note = chr17:19770389-19770859
  misc_feature 1..470: note = Hyper
  source 1..470: mol_type = genomic DNA

SEQ ID NO: 113070 - DNA, 135 bp, Homo sapiens; identical to SEQ ID NO: 80115
  misc_feature 1..135: note = chr17:19771274-19771409
  misc_feature 1..135: note = Hyper
  source 1..135: mol_type = genomic DNA

SEQ ID NO: 113071 - DNA, 118 bp, Homo sapiens; identical to SEQ ID NO: 45018
  misc_feature 1..118: note = chr17:19771594-19771712
  misc_feature 1..118: note = Hypo
  source 1..118: mol_type = genomic DNA

SEQ ID NO: 113072 - DNA, 150 bp, Homo sapiens; identical to SEQ ID NO: 80117
  misc_feature 1..150: note = chr17:19890251-19890401
  misc_feature 1..150: note = Hypo
  source 1..150: mol_type = genomic DNA

SEQ ID NO: 113073 - DNA, 41 bp, Homo sapiens; identical to SEQ ID NO: 80118
  misc_feature 1..41: note = chr17:19925117-19925158
  misc_feature 1..41: note = Hypo
  source 1..41: mol_type = genomic DNA

SEQ ID NO: 113074 - DNA, 30 bp, Homo sapiens; identical to SEQ ID NO: 80119
  misc_feature 1..30: note = chr17:19985359-19985389
  misc_feature 1..30: note = Hypo
  source 1..30: mol_type = genomic DNA

SEQ ID NO: 113075 - DNA, 189 bp, Homo sapiens; identical to SEQ ID NO: 80120
  misc_feature 1..189: note = chr17:19995800-19995989
  misc_feature 1..189: note = Hypo
  source 1..189: mol_type = genomic DNA

SEQ ID NO: 113076 - DNA, 34 bp, Homo sapiens; identical to SEQ ID NO: 80121
  misc_feature 1..34: note = chr17:20008373-20008407
  misc_feature 1..34: note = Hypo
  source 1..34: mol_type = genomic DNA

SEQ ID NO: 113077 - DNA, 30 bp, Homo sapiens; identical to SEQ ID NO: 80122
  misc_feature 1..30: note = chr17:20014279-20014309
  misc_feature 1..30: note = Hypo
  source 1..30: mol_type = genomic DNA

SEQ ID NO: 113078 - DNA, 30 bp, Homo sapiens; identical to SEQ ID NO: 80123
  misc_feature 1..30: note = chr17:20108333-20108363
  misc_feature 1..30: note = Hypo
  source 1..30: mol_type = genomic DNA

SEQ ID NO: 113079 - DNA, 30 bp, Homo sapiens; identical to SEQ ID NO: 80125
  misc_feature 1..30: note = chr17:20218717-20218747
  misc_feature 1..30: note = Hypo
  source 1..30: mol_type = genomic DNA

SEQ ID NO: 113080 - DNA, 30 bp, Homo sapiens; identical to SEQ ID NO: 80126
  misc_feature 1..30: note = chr17:20516049-20516079
  misc_feature 1..30: note = Hypo
  source 1..30: mol_type = genomic DNA

SEQ ID NO: 113081 - DNA, 241 bp, Homo sapiens; identical to SEQ ID NO: 80127
  misc_feature 1..241: note = chr17:20747219-20747460
  misc_feature 1..241: note = Hyper
  source 1..241: mol_type = genomic DNA

SEQ ID NO: 113082 - DNA, 380 bp, Homo sapiens
  misc_feature 1..380: note = chr17:20755766-20756146
  misc_feature 1..380: note = Hyper
  source 1..380: mol_type = genomic DNA
tcaccgagcgcacctcgcaatctctgatcttcgaacccactgaaaaagcacaaggcatggggagtcctgttggttcacgccccgggtgcgaataccaaaagcaactcccgctggaaagcctgcaggaaactcgagacaaagacagaggcaaacgcaacgctgggaagagccaggggtgctgccgtctgcaaaagcagagacgcgtctcccttcgggcaaagtgactgctacaaagtctgttccctcctgcgcagggacagagacatttaaaggcctgaacggacgtcagcaccagtagagctcgctgggtgagcgccaggcctccccgccccaaggatagcgcgcacagggcgatctgctgctcgcgaggtagaaagtgg

SEQ ID NO: 113083 - DNA, 198 bp, Homo sapiens; identical to SEQ ID NO: 80130
  misc_feature 1..198: note = chr17:20771771-20771969
  misc_feature 1..198: note = Hypo
  source 1..198: mol_type = genomic DNA

SEQ ID NO: 113084 - DNA, 78 bp, Homo sapiens; identical to SEQ ID NO: 80131
  misc_feature 1..78: note = chr17:20813557-20813635
  misc_feature 1..78: note = Hypo
  source 1..78: mol_type = genomic DNA

SEQ ID NO: 113085 - DNA, 39 bp, Homo sapiens; identical to SEQ ID NO: 80132
  misc_feature 1..39: note = chr17:20817539-20817578
  misc_feature 1..39: note = Hypo
  source 1..39: mol_type = genomic DNA

SEQ ID NO: 113086 - DNA, 39 bp, Homo sapiens; identical to SEQ ID NO: 80133
  misc_feature 1..39: note = chr17:20817878-20817917
  misc_feature 1..39: note = Hypo
  source 1..39: mol_type = genomic DNA

SEQ ID NO: 113087 - DNA, 114 bp, Homo sapiens; identical to SEQ ID NO: 80134
  misc_feature 1..114: note = chr17:21104001-21104115
  misc_feature 1..114: note = Hypo
  source 1..114: mol_type = genomic DNA

SEQ ID NO: 113088 - DNA, 145 bp, Homo sapiens; identical to SEQ ID NO: 80135
  misc_feature 1..145: note = chr17:21147453-21147598
  misc_feature 1..145: note = Hypo
  source 1..145: mol_type = genomic DNA

SEQ ID NO: 113089 - DNA, 64 bp, Homo sapiens; identical to SEQ ID NO: 80136
  misc_feature 1..64: note = chr17:21150794-21150858
  misc_feature 1..64: note = Hypo
  source 1..64: mol_type = genomic DNA

SEQ ID NO: 113090 - DNA, 27 bp, Homo sapiens
  misc_feature 1..27: note = chr17:21168792-21168819
  misc_feature 1..27: note = Hypo
  source 1..27: mol_type = genomic DNA
acctgaggctcttaacgattctctgga

SEQ ID NO: 113091 - DNA, 30 bp, Homo sapiens; identical to SEQ ID NO: 80138
  misc_feature 1..30: note = chr17:21178051-21178081
  misc_feature 1..30: note = Hypo
  source 1..30: mol_type = genomic DNA

SEQ ID NO: 113092 - DNA, 196 bp, Homo sapiens; identical to SEQ ID NO: 80139
  misc_feature 1..196: note = chr17:21859901-21860097
  misc_feature 1..196: note = Hypo
  source 1..196: mol_type = genomic DNA

SEQ ID NO: 113093 - DNA, 37 bp, Homo sapiens; identical to SEQ ID NO: 80140
  misc_feature 1..37: note = chr17:21911061-21911098
  misc_feature 1..37: note = Hypo
  source 1..37: mol_type = genomic DNA

SEQ ID NO: 113094 - DNA, 30 bp, Homo sapiens; identical to SEQ ID NO: 80141
  misc_feature 1..30: note = chr17:21953249-21953279
  misc_feature 1..30: note = Hypo
  source 1..30: mol_type = genomic DNA

SEQ ID NO: 113095 - DNA, 30 bp, Homo sapiens; identical to SEQ ID NO: 80152
  misc_feature 1..30: note = chr17:25309119-25309149
  misc_feature 1..30: note = Hypo
  source 1..30: mol_type = genomic DNA

SEQ ID NO: 113096 - DNA, 40 bp, Homo sapiens; identical to SEQ ID NO: 80154
  misc_feature 1..40: note = chr17:25432176-25432216
  misc_feature 1..40: note = Hypo
  source 1..40: mol_type = genomic DNA

SEQ ID NO: 113097 - DNA, 142 bp, Homo sapiens; identical to SEQ ID NO: 1616
  misc_feature 1..142: note = chr17:25620573-25620715
  misc_feature 1..142: note = Hypo
  source 1..142: mol_type = genomic DNA

SEQ ID NO: 113098 - DNA, 163 bp, Homo sapiens; identical to SEQ ID NO: 80156
  misc_feature 1..163: note = chr17:25676870-25677033
  misc_feature 1..163: note = Hypo
  source 1..163: mol_type = genomic DNA

SEQ ID NO: 113099 - DNA, 18 bp, Homo sapiens
  misc_feature 1..18: note = chr17:25680258-25680276
  misc_feature 1..18: note = Hypo
  source 1..18: mol_type = genomic DNA
cctgtaatcccagcacgt

SEQ ID NO: 113100 - DNA, 30 bp, Homo sapiens; identical to SEQ ID NO: 80158
  misc_feature 1..30: note = chr17:25825913-25825943
  misc_feature 1..30: note = Hypo
  source 1..30: mol_type = genomic DNA

SEQ ID NO: 113101 - DNA, 30 bp, Homo sapiens; identical to SEQ ID NO: 80159
  misc_feature 1..30: note = chr17:25879017-25879047
  misc_feature 1..30: note = Hypo
  source 1..30: mol_type = genomic DNA

SEQ ID NO: 113102 - DNA, 160 bp, Homo sapiens; identical to SEQ ID NO: 80160
  misc_feature 1..160: note = chr17:25907710-25907870
  misc_feature 1..160: note = Hypo
  source 1..160: mol_type = genomic DNA

SEQ ID NO: 113103 - DNA, 60 bp, Homo sapiens; identical to SEQ ID NO: 80161
  misc_feature 1..60: note = chr17:25928294-25928354
  misc_feature 1..60: note = Hypo
  source 1..60: mol_type = genomic DNA

SEQ ID NO: 113104 - DNA, 201 bp, Homo sapiens; identical to SEQ ID NO: 80162
  misc_feature 1..201: note = chr17:25931558-25931759
  misc_feature 1..201: note = Hypo
  source 1..201: mol_type = genomic DNA

SEQ ID NO: 113105 - DNA, 30 bp, Homo sapiens; identical to SEQ ID NO: 80163
  misc_feature 1..30: note = chr17:25936581-25936611
  misc_feature 1..30: note = Hypo
  source 1..30: mol_type = genomic DNA

SEQ ID NO: 113106 - DNA, 30 bp, Homo sapiens; identical to SEQ ID NO: 45035
  misc_feature 1..30: note = chr17:25957285-25957315
  misc_feature 1..30: note = Hypo
  source 1..30: mol_type = genomic DNA

SEQ ID NO: 113107 - DNA, 39 bp, Homo sapiens; identical to SEQ ID NO: 80165
  misc_feature 1..39: note = chr17:25977721-25977760
  misc_feature 1..39: note = Hypo
  source 1..39: mol_type = genomic DNA

SEQ ID NO: 113108 - DNA, 30 bp, Homo sapiens; identical to SEQ ID NO: 80166
  misc_feature 1..30: note = chr17:25982331-25982361
  misc_feature 1..30: note = Hypo
  source 1..30: mol_type = genomic DNA

SEQ ID NO: 113109 - DNA, 30 bp, Homo sapiens; identical to SEQ ID NO: 80167
  misc_feature 1..30: note = chr17:26078326-26078356
  misc_feature 1..30: note = Hypo
  source 1..30: mol_type = genomic DNA

SEQ ID NO: 113110 - DNA, 102 bp, Homo sapiens; identical to SEQ ID NO: 80168
  misc_feature 1..102: note = chr17:26085974-26086076
  misc_feature 1..102: note = Hypo
  source 1..102: mol_type = genomic DNA

SEQ ID NO: 113111 - DNA, 454 bp, Homo sapiens
  misc_feature 1..454: note = chr17:26120462-26120916
  misc_feature 1..454: note = Hyper
  source 1..454: mol_type = genomic DNA
tctaaaagaggaaaacgcttttagtaaaccctcaggaatcccacagagcgcacatccccgccctccgatttctcccagagagagatggggccccgcccgggctcggagcccaccgcttccctcccagggcggacttcggcccgcggggtacctggctctgcgcgggcagcagtcaggcttcggccggaggatcctgcagagcagcctgcacagccggggcccggcggcctcgcacgccgcgcccagcccctcgcgcatggcccggctccttaggcgcagctccgctggctccacgcgcctcccagcgcccgcgctttatcgctcggagcctgcagcccccgccccgggggcggggcgagccgagcagcggcgggggctcttcacccacgcgatgtcccgggccgagctgcccctccttccctgccttccccggcgatcccgggacccaagcacc

SEQ ID NO: 113112 - DNA, 36 bp, Homo sapiens; identical to SEQ ID NO: 80171
  misc_feature 1..36: note = chr17:26125647-26125683
  misc_feature 1..36: note = Hypo
  source 1..36: mol_type = genomic DNA

SEQ ID NO: 113113 - DNA, 31 bp, Homo sapiens; identical to SEQ ID NO: 80172
  misc_feature 1..31: note = chr17:26263183-26263214
  misc_feature 1..31: note = Hypo
  source 1..31: mol_type = genomic DNA

SEQ ID NO: 113114 - DNA, 170 bp, Homo sapiens; identical to SEQ ID NO: 80178
  misc_feature 1..170: note = chr17:26346789-26346959
  misc_feature 1..170: note = Hypo
  source 1..170: mol_type = genomic DNA

SEQ ID NO: 113115 - DNA, 23 bp, Homo sapiens
  misc_feature 1..23: note = chr17:26420105-26420128
  misc_feature 1..23: note = Hypo
  source 1..23: mol_type = genomic DNA
accgcacccggcctagtggcttg

SEQ ID NO: 113116 - DNA, 639 bp, Homo sapiens
  misc_feature 1..639: note = chr17:26554500-26555139
  misc_feature 1..639: note = Hyper
  source 1..639: mol_type = genomic DNA
tcctggtcactcagccgtcgtgagcgcaggcgcggggcgggcggagcgggacccctggggctctccccctgcggccccgctccaccgggggcgtggctagatctgaccgcgcccttccaggccccgccctcaggtatgggaaactaggccgcccggtcgcgcgcctctccaaaacgttcttcccagactgcgaggaccgcctcggcaggtggcggtaaaagcgcccccatcaagtcacataacatcctgcctccgagagcgcggtctggccccaccctggtccatcacttacgacgtctcccaggcttgcctccccggatcggattcctttcccttcgatcccgcaggccggaggcgcagacctgtggtgaggacacccgaggcctcctgggagacctgcagaccacgcccacctcatttacatgttcactcccgaccctggaaacccggatttcgcctccggacagcggcgtctgggcagggttcgggtactgcagtcccgcgtctggatgcccccgccccctgagctgcagggctgtgtgtggtccttccctggtcccaaaataaagagcgaattgcacagaaacggaatgtgtgcctttgtattttctttcctttctccttcgtggaggtggcgtc

SEQ ID NO: 113117 - DNA, 357 bp, Homo sapiens; identical to SEQ ID NO: 80183
  misc_feature 1..357: note = chr17:26578290-26578647
  misc_feature 1..357: note = Hyper
  source 1..357: mol_type = genomic DNA

SEQ ID NO: 113118 - DNA, 38 bp, Homo sapiens; identical to SEQ ID NO: 80186
  misc_feature 1..38: note = chr17:26634205-26634243
  misc_feature 1..38: note = Hyper
  source 1..38: mol_type = genomic DNA

SEQ ID NO: 113119 - DNA, 30 bp, Homo sapiens; identical to SEQ ID NO: 80189
  misc_feature 1..30: note = chr17:26897238-26897268
  misc_feature 1..30: note = Hypo
  source 1..30: mol_type = genomic DNA

SEQ ID NO: 113120 - DNA, 48 bp, Homo sapiens; identical to SEQ ID NO: 80190
  misc_feature 1..48: note = chr17:26926767-26926815
  misc_feature 1..48: note = Hyper
  source 1..48: mol_type = genomic DNA

SEQ ID NO: 113121 - DNA, 22 bp, Homo sapiens
  misc_feature 1..22: note = chr17:26927142-26927164
  misc_feature 1..22: note = Hypo
  source 1..22: mol_type = genomic DNA
actggatttcaaacacgtcgta

SEQ ID NO: 113122 - DNA, 133 bp, Homo sapiens; identical to SEQ ID NO: 80192
  misc_feature 1..133: note = chr17:26961803-26961936
  misc_feature 1..133: note = Hypo
  source 1..133: mol_type = genomic DNA

SEQ ID NO: 113123 - DNA, 528 bp, Homo sapiens
  misc_feature 1..528: note = chr17:27038663-27039191
  misc_feature 1..528: note = Hyper
  source 1..528: mol_type = genomic DNA
cgtcctgacccacatcgctctccgcccaggtcttcgtctctacaggactcttgcgtgaagtccaaccctgagcctcagcccggccgagccctcggcccagccgtgaactccagtctcggcttcgcccccgcctagcccctaaccccgcctcatgctggcgcagcccccgccggcctccccagcccggctccaggctgcgtagtcttcccagctgggtctcagcgtcagccgcgttcttcatccggggcctccggcgcctcccaggcccctctttatctcagaccttaaccttacaggcccagctctcaccacccatctctggttccagcttgcagtccaaaccccagattttcaccctgcctccagatcgtagccccaattcttagtgttacaacgagccttgcccccagccccattcttagccccgccccggccattctctaaaccgcacactcccgtcccgctccccgccccaccgacccttgggaacccagccgcagccccgcctctgcccgctggcgagagagc

SEQ ID NO: 113124 - DNA, 33 bp, Homo sapiens; identical to SEQ ID NO: 80195
  misc_feature 1..33: note = chr17:27039851-27039884
  misc_feature 1..33: note = Hypo
  source 1..33: mol_type = genomic DNA

SEQ ID NO: 113125 - DNA, 410 bp, Homo sapiens
  misc_feature 1..410: note = chr17:27044472-27044882
  misc_feature 1..410: note = Hyper
  source 1..410: mol_type = genomic DNA
acaatcacccggggccgcggcgagcccaaaatcacccgggccctgggcgtcccgaagatgactctggggcgaggagactcttcggccgccaattgggggcggggagtcccgtctggtgggggccgggcccgcgcagaccctacgattacgcggggccggatagttcctacgattacgcggggccggatggttcctacaataacccggggccgcggagacccgacgtcatctcggggctgaggctgccctaccattacagagcggcccgggggcgcggagcggccccgccacacggggtcagtgtgggcaggggcggcgctgccaaggcccgcaggccgctggaggagggggcgaggggcccagtccggctacagggcctcgagtcccactccgctcgggctccgccaacg

SEQ ID NO: 113126 - DNA, 24 bp, Homo sapiens
  misc_feature 1..24: note = chr17:27056401-27056425
  misc_feature 1..24: note = Hypo
  source 1..24: mol_type = genomic DNA
ctccctctgtcaccccggctggag

SEQ ID NO: 113127 - DNA, 24 bp, Homo sapiens
  misc_feature 1..24: note = chr17:27056845-27056869
  misc_feature 1..24: note = Hypo
  source 1..24: mol_type = genomic DNA
gagccaccgcgacaggccagaagt

SEQ ID NO: 113128 - DNA, 30 bp, Homo sapiens; identical to SEQ ID NO: 16185
  misc_feature 1..30: note = chr17:27074858-27074888
  misc_feature 1..30: note = Hypo
  source 1..30: mol_type = genomic DNA

SEQ ID NO: 113129 - DNA, 30 bp, Homo sapiens; identical to SEQ ID NO: 80201
  misc_feature 1..30: note = chr17:27085505-27085535
  misc_feature 1..30: note = Hypo
  source 1..30: mol_type = genomic DNA

SEQ ID NO: 113130 - DNA, 20 bp, Homo sapiens
  misc_feature 1..20: note = chr17:27170162-27170182
  misc_feature 1..20: note = Hypo
  source 1..20: mol_type = genomic DNA
tttttttttctgagtcgaag

SEQ ID NO: 113131 - DNA, 76 bp, Homo sapiens; identical to SEQ ID NO: 80203
  misc_feature 1..76: note = chr17:27181283-27181359
  misc_feature 1..76: note = Hypo
  source 1..76: mol_type = genomic DNA

SEQ ID NO: 113132 - DNA, 30 bp, Homo sapiens; identical to SEQ ID NO: 80204
  misc_feature 1..30: note = chr17:27271675-27271705
  misc_feature 1..30: note = Hypo
  source 1..30: mol_type = genomic DNA

SEQ ID NO: 113133 - DNA, 30 bp, Homo sapiens; identical to SEQ ID NO: 80205
  misc_feature 1..30: note = chr17:27299598-27299628
  misc_feature 1..30: note = Hypo
  source 1..30: mol_type = genomic DNA

SEQ ID NO: 113134 - DNA, 367 bp, Homo sapiens; identical to SEQ ID NO: 80206
  misc_feature 1..367: note = chr17:27332366-27332733
  misc_feature 1..367: note = Hyper
  source 1..367: mol_type = genomic DNA

SEQ ID NO: 113135 - DNA, 100 bp, Homo sapiens; identical to SEQ ID NO: 80207
  misc_feature 1..100: note = chr17:27333101-27333201
  misc_feature 1..100: note = Hyper
  source 1..100: mol_type = genomic DNA

SEQ ID NO: 113136 - DNA, 30 bp, Homo sapiens; identical to SEQ ID NO: 16187
  misc_feature 1..30: note = chr17:27411663-27411693
  misc_feature 1..30: note = Hypo
  source 1..30: mol_type = genomic DNA

SEQ ID NO: 113137 - DNA, 321 bp, Homo sapiens; identical to SEQ ID NO: 80209
  misc_feature 1..321: note = chr17:27419250-27419571
  misc_feature 1..321: note = Hypo
  source 1..321: mol_type = genomic DNA

SEQ ID NO: 113138 - DNA, 30 bp, Homo sapiens; identical to SEQ ID NO: 80210
  misc_feature 1..30: note = chr17:27426754-27426784
  misc_feature 1..30: note = Hypo
  source 1..30: mol_type = genomic DNA

SEQ ID NO: 113139 - DNA, 30 bp, Homo sapiens; identical to SEQ ID NO: 36425
  misc_feature 1..30: note = chr17:27466437-27466467
  misc_feature 1..30: note = Hyper
  source 1..30: mol_type = genomic DNA

SEQ ID NO: 113140 - DNA, 30 bp, Homo sapiens; identical to SEQ ID NO: 80212
  misc_feature 1..30: note = chr17:27467405-27467435
  misc_feature 1..30: note = Hyper
  source 1..30: mol_type = genomic DNA

SEQ ID NO: 113141 - DNA, 88 bp, Homo sapiens; identical to SEQ ID NO: 80215
  misc_feature 1..88: note = chr17:27716046-27716134
  misc_feature 1..88: note = Hypo
  source 1..88: mol_type = genomic DNA

SEQ ID NO: 113142 - DNA, 120 bp, Homo sapiens; identical to SEQ ID NO: 80216
  misc_feature 1..120: note = chr17:27716194-27716314
  misc_feature 1..120: note = Hypo
  source 1..120: mol_type = genomic DNA

SEQ ID NO: 113143 - DNA, 28 bp, Homo sapiens
  misc_feature 1..28: note = chr17:27716614-27716642
  misc_feature 1..28: note = Hypo
  source 1..28: mol_type = genomic DNA
gagccaccgcgcccggccttacactttt

SEQ ID NO: 113144 - DNA, 30 bp, Homo sapiens; identical to SEQ ID NO: 80218
  misc_feature 1..30: note = chr17:27909175-27909205
  misc_feature 1..30: note = Hypo
  source 1..30: mol_type = genomic DNA

SEQ ID NO: 113145 - DNA, 769 bp, Homo sapiens
  misc_feature 1..769: note = chr17:27940142-27940911
  misc_feature 1..769: note = Hyper
  source 1..769: mol_type = genomic DNA
ggatccaggcttcaccgcggagttcagactctccccaggcattgacggggagaacttggtagggtctgggctccgccacgaccaggtgggggccaggacgccgcgggactgaccgcctccactagagggtggtggccgcgggccgccctggagcctccacgccgtgtcccggccccggccggtgggtgggtgcgcccgggagcccgcgacattccttccccacccccaggagcgccccgcccacgccgcagcgccagcctgcgcccccggcgtcagtgcccagccctcggcccagctcagggccaggttccggcggccacgtgttccggagctacgacgagcagctgcggctggcgatggaactgtcggcgcaggagcaggaggagaggcggcggcgcgcgcgccaggaggaggaggagctggagcgcatcctgaggctctcactgaccgagcagtagcgccccctgccgggaccctcgccagcgccacgcgcgccacgcccagggccaggagccagacaaaccccggcctgcgcgcctgcagagcggcggctggagactggagccaccgcctcgcgggtgcagcagcacagcaggcacggttcggggagggattcggcatggccgcggggtaccttcccaggccagggccctggaggcaactggcacggcctggtccccctgctttgctgtattctgattccccaacccgctcccctgggctcagatctgtcctgtcctagggcggagccaggcggtcctgaggggga

SEQ ID NO: 113146 - DNA, 850 bp, Homo sapiens
  misc_feature 1..850: note = chr17:27949432-27950282
  misc_feature 1..850: note = Hyper
  source 1..850: mol_type = genomic DNA
gtgcccttcaaggcgcgtctgcggccccgagcctgaggcccggcctccctgcacccttcttcagcctgctgccctgacactgcgttcttgcgagacgaggtgtctgcgccctccgggagcgctggctgctgtccggccaaatatagacaccacgtcctccccgcccgaaaccgaatttggcggcgcggggggaggaggcgcagacctctgcccctcagggaccccgcccgctccgctggctgcggtgacggccgggtgtggggggctgggtacctggtcctgagcgggctgcggggcgctcacgctgcgaatcctctgcggaaggggcccgagtgcgtagggggccgaggaaggcttcagggcgaaggagccacctctccgggtgtctgtagtatctgggacccgggtgtccagctccgcactctggccgatcctgcggctctctagagcccggcgccgctgcagccccagctgccgctgccatcaacctaagagggcggggctagcataggggcggggccagagcccaagttgccccgccccctccagcggcgggaaagtcgagcgaccccgactcccctcccagcttccgccggcctcggagaaccatcgaaaataaatgtgcagctgtgtgctaggtgcgcacgctgcttccctccctccatgactcccgggtaggctggggaggctcgggttcgcagacctagagcaggacgcttggagagggaacgggcgagggggcgtgcgcccctagagcgggcagccgagggagaccaggtgcctccacccgcattccagcctcaatcgcgctcccaatttagctgtcccgatcggccgggactgcgggact

SEQ ID NO: 113147 - DNA, 30 bp, Homo sapiens; identical to SEQ ID NO: 80223
  misc_feature 1..30: note = chr17:27956058-27956088
  misc_feature 1..30: note = Hypo
  source 1..30: mol_type = genomic DNA

SEQ ID NO: 113148 - DNA, 544 bp, Homo sapiens
  misc_feature 1..544: note = chr17:28088129-28088673
  misc_feature 1..544: note = Hyper
  source 1..544: mol_type = genomic DNA
gagcgttcgcggaggcggagggcgcgcggcggactcacagctggttgatggcgttctgcgagatgaccgcgttggcggagaagtaaggaatcatgtcggggccaccgaggctgcaggtgcaagcgaggggcgccttcctcttgcgggccaacgtgctcagggtcatggggccggctcaaagtgcacaactccgcatcctggcctctgctctgctccggcacgaggcgcaggctgcgcgtgcacccggcggcggaggcgggcccgccgggtcgcgcggaggcagccgccgaagccccagggctcggcggtagagtccggactgacgggcgtcgccagcagttcgcccccacccgcgtccggggcgggacgggcgggtcctgagagcggagagggtaggcccggccggcgccccgccccagatctcgggacgcccgcgcggatcccgcagcgcgcgtcacagcctttagggcatccggcggccccaagacactgctgcctcggtaagggagtgaagctactcaagggtggacgagaaaggcttgca

SEQ ID NO: 113149 - DNA, 105 bp, Homo sapiens; identical to SEQ ID NO: 80227
  misc_feature 1..105: note = chr17:28089170-28089275
  misc_feature 1..105: note = Hypo
  source 1..105: mol_type = genomic DNA

SEQ ID NO: 113150 - DNA, 35 bp, Homo sapiens; identical to SEQ ID NO: 80228
  misc_feature 1..35: note = chr17:28112487-28112522
  misc_feature 1..35: note = Hypo
  source 1..35: mol_type = genomic DNA

SEQ ID NO: 113151 - DNA, 18 bp, Homo sapiens
  misc_feature 1..18: note = chr17:28299358-28299376
  misc_feature 1..18: note = Hypo
  source 1..18: mol_type = genomic DNA
gcccggcccaggcatttt

SEQ ID NO: 113152 - DNA, 465 bp, Homo sapiens; identical to SEQ ID NO: 80232
  misc_feature 1..465: note = chr17:28562551-28563016
  misc_feature 1..465: note = Hyper
  source 1..465: mol_type = genomic DNA

SEQ ID NO: 113153 - DNA, 61 bp, Homo sapiens; identical to SEQ ID NO: 36431
  misc_feature 1..61: note = chr17:28563999-28564060
  misc_feature 1..61: note = Hyper
  source 1..61: mol_type = genomic DNA

SEQ ID NO: 113154 - DNA, 175 bp, Homo sapiens; identical to SEQ ID NO: 36432
  misc_feature 1..175: note = chr17:28705281-28705456
  misc_feature 1..175: note = Hyper
  source 1..175: mol_type = genomic DNA

SEQ ID NO: 113155 - DNA, 102 bp, Homo sapiens; identical to SEQ ID NO: 80236
  misc_feature 1..102: note = chr17:28715707-28715809
  misc_feature 1..102: note = Hypo
  source 1..102: mol_type = genomic DNA

SEQ ID NO: 113156 - DNA, 30 bp, Homo sapiens; identical to SEQ ID NO: 80237
  misc_feature 1..30: note = chr17:28836503-28836533
  misc_feature 1..30: note = Hypo
  source 1..30: mol_type = genomic DNA

SEQ ID NO: 113157 - DNA, 30 bp, Homo sapiens; identical to SEQ ID NO: 80238
  misc_feature 1..30: note = chr17:28894952-28894982
  misc_feature 1..30: note = Hypo
  source 1..30: mol_type = genomic DNA

SEQ ID NO: 113158 - DNA, 33 bp, Homo sapiens; identical to SEQ ID NO: 80239
  misc_feature 1..33: note = chr17:28902754-28902787
  misc_feature 1..33: note = Hypo
  source 1..33: mol_type = genomic DNA

SEQ ID NO: 113159 - DNA, 206 bp, Homo sapiens; identical to SEQ ID NO: 80240
  misc_feature 1..206: note = chr17:28973624-28973830
  misc_feature 1..206: note = Hyper
  source 1..206: mol_type = genomic DNA

SEQ ID NO: 113160 - DNA, 25 bp, Homo sapiens
  misc_feature 1..25: note = chr17:28988903-28988928
  misc_feature 1..25: note = Hypo
  source 1..25: mol_type = genomic DNA
aaagagagaggcggccgggtgcggt

SEQ ID NO: 113161 - DNA, 205 bp, Homo sapiens; identical to SEQ ID NO: 80242
  misc_feature 1..205: note = chr17:29020865-29021070
  misc_feature 1..205: note = Hyper
  source 1..205: mol_type = genomic DNA

SEQ ID NO: 113162 - DNA, 30 bp, Homo sapiens; identical to SEQ ID NO: 80243
  misc_feature 1..30: note = chr17:29032502-29032532
  misc_feature 1..30: note = Hypo
  source 1..30: mol_type = genomic DNA

SEQ ID NO: 113163 - DNA, 185 bp, Homo sapiens; identical to SEQ ID NO: 80244
  misc_feature 1..185: note = chr17:29033276-29033461
  misc_feature 1..185: note = Hyper
  source 1..185: mol_type = genomic DNA

SEQ ID NO: 113164 - DNA, 23 bp, Homo sapiens
  misc_feature 1..23: note = chr17:29232244-29232267
  misc_feature 1..23: note = Hypo
  source 1..23: mol_type = genomic DNA
aggtttgtcttaggccgggcgcg

SEQ ID NO: 113165 - DNA, 27 bp, Homo sapiens
  misc_feature 1..27: note = chr17:29234370-29234397
  misc_feature 1..27: note = Hypo
  source 1..27: mol_type = genomic DNA
cgcctggccaaccgtaaggaattgaac

SEQ ID NO: 113166 - DNA, 525 bp, Homo sapiens
  misc_feature 1..525: note = chr17:29249414-29249939
  misc_feature 1..525: note = Hyper
  source 1..525: mol_type = genomic DNA
gagcccttccagtcccgctctcttccctggccaggcacccgaccgcccgagtccgggctctcgatgtctgcgcacccaggcgcgccccacgccctcggactcagacatcccagccagggctaaacgtcgggcccaggccgccgacagtcctgtgccccctgcccgctcccagacgccccccgaaggcctccccagcgccccacctcggggacgccgagggccccctaactcagcctccccacctgcagctccgcgccgagccccgcggtgcgccccccgcgccctcctctcggttccttctgagtcccttcacttccacgtcgcgcagcctcagactctctccccgggccctgaactgcctccaggatcttcaccccggtcgccgcgcagcggccggtgggctaaccagaaggtgccaggctggccgcttagttcgccttaggtgggagaaggggcgccccacctgccccagtgccccgagcccagccctggtttcttcaccgcgctttccgctcagctcctctc

SEQ ID NO: 113167 - DNA, 286 bp, Homo sapiens
  misc_feature 1..286: note = chr17:29298080-29298366
  misc_feature 1..286: note = Hyper
  source 1..286: mol_type = genomic DNA
gcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagat

SEQ ID NO: 113168 - DNA, 508 bp, Homo sapiens
  misc_feature 1..508: note = chr17:29335342-29335850
  misc_feature 1..508: note = Hyper
  source 1..508: mol_type = genomic DNA
ggaaaagcaaaatcccgggtccctcagacaaaagggcgggtggaggaggagaagccgagagtcctgctccggcgccgccggagcaccgcctgcctcagccgaccagcgccgtcgactactgggcctagcccagacgagaggagggaaaggccgcagaggccgcgaggatgctgcggaggcgcgggcggccggctgccgcctagttgtgcagcccagaccaaggaaagagaagtgggaggagcggggagctcggcgtcccgcgtcctccgcggctcaggacgactacgctcggcacgtccgggaccctccggccgtggcggttgcagcgccaaaagctcgggcctcagcccctgacgctgtggtgactccgccgcgcctcgccgtcgcccctgtccccgtcctgcccgccgcctccgccgctggggacatgtccaaccccggaagccggaggaacgggcccgtcaagctgcacctgacaggtgagggggagcgccgggccgggctgggc

SEQ ID NO: 113169 - DNA, 41 bp, Homo sapiens; identical to SEQ ID NO: 80251
  misc_feature 1..41: note = chr17:29396500-29396541
  misc_feature 1..41: note = Hypo
  source 1..41: mol_type = genomic DNA

SEQ ID NO: 113170 - DNA, 427 bp, Homo sapiens; identical to SEQ ID NO: 80253
  misc_feature 1..427: note = chr17:29718113-29718540
  misc_feature 1..427: note = Hyper
  source 1..427: mol_type = genomic DNA

SEQ ID NO: 113171 - DNA, 509 bp, Homo sapiens
  misc_feature 1..509: note = chr17:29718778-29719287
  misc_feature 1..509: note = Hyper
  source 1..509: mol_type = genomic DNA
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccgggtatccctggcccagccgggccctcgctttccgccccccggcgcccgtgccccgagcgtcacgcgtcacgcctagggtggcttctgcgcccaccttccttc

SEQ ID NO: 113172 - DNA, 32 bp, Homo sapiens; identical to SEQ ID NO: 80255
  misc_feature 1..32: note = chr17:29805337-29805369
  misc_feature 1..32: note = Hypo
  source 1..32: mol_type = genomic DNA

SEQ ID NO: 113173 - DNA, 276 bp, Homo sapiens; identical to SEQ ID NO: 80256
  misc_feature 1..276: note = chr17:29886452-29886728
  misc_feature 1..276: note = Hyper
  source 1..276: mol_type = genomic DNA

SEQ ID NO: 113174 - DNA, 235 bp, Homo sapiens; identical to SEQ ID NO: 80257
  misc_feature 1..235: note = chr17:30243754-30243989
  misc_feature 1..235: note = Hypo
  source 1..235: mol_type = genomic DNA

SEQ ID NO: 113175 - DNA, 43 bp, Homo sapiens; identical to SEQ ID NO: 80258
  misc_feature 1..43: note = chr17:30244921-30244964
  misc_feature 1..43: note = Hypo
  source 1..43: mol_type = genomic DNA

SEQ ID NO: 113176 - DNA, 36 bp, Homo sapiens; identical to SEQ ID NO: 80259
  misc_feature 1..36: note = chr17:30250325-30250361
  misc_feature 1..36: note = Hypo
  source 1..36: mol_type = genomic DNA

SEQ ID NO: 113177 - DNA, 30 bp, Homo sapiens; identical to SEQ ID NO: 45052
  misc_feature 1..30: note = chr17:30333112-30333142
  misc_feature 1..30: note = Hypo
  source 1..30: mol_type = genomic DNA

SEQ ID NO: 113178 - DNA, 32 bp, Homo sapiens; identical to SEQ ID NO: 80261
  misc_feature 1..32: note = chr17:30334317-30334349
  misc_feature 1..32: note = Hypo
  source 1..32: mol_type = genomic DNA

SEQ ID NO: 113179 - DNA, 180 bp, Homo sapiens; identical to SEQ ID NO: 80263
  misc_feature 1..180: note = chr17:30389685-30389865
  misc_feature 1..180: note = Hyper
  source 1..180: mol_type = genomic DNA

SEQ ID NO: 113180 - DNA, 144 bp, Homo sapiens; identical to SEQ ID NO: 80264
  misc_feature 1..144: note = chr17:30622364-30622508
  misc_feature 1..144: note = Hypo
  source 1..144: mol_type = genomic DNA

SEQ ID NO: 113181 - DNA, 28 bp, Homo sapiens
  misc_feature 1..28: note = chr17:30710928-30710956
  misc_feature 1..28: note = Hypo
  source 1..28: mol_type = genomic DNA
aacaaaaaaacatcgactagagcagtgg

SEQ ID NO: 113182 - DNA, 78 bp, Homo sapiens; identical to SEQ ID NO: 80266
  misc_feature 1..78: note = chr17:30822187-30822265
  misc_feature 1..78: note = Hypo
  source 1..78: mol_type = genomic DNA

SEQ ID NO: 113183 - DNA, 176 bp, Homo sapiens; identical to SEQ ID NO: 80267
  misc_feature 1..176: note = chr17:30846483-30846659
  misc_feature 1..176: note = Hyper
  source 1..176: mol_type = genomic DNA

SEQ ID NO: 113184 - DNA, 66 bp, Homo sapiens; identical to SEQ ID NO: 80268
  misc_feature 1..66: note = chr17:30954269-30954335
  misc_feature 1..66: note = Hypo
  source 1..66: mol_type = genomic DNA

SEQ ID NO: 113185 - DNA, 36 bp, Homo sapiens; identical to SEQ ID NO: 80269
  misc_feature 1..36: note = chr17:30986312-30986348
  misc_feature 1..36: note = Hypo
  source 1..36: mol_type = genomic DNA

SEQ ID NO: 113186 - DNA, 45 bp, Homo sapiens; identical to SEQ ID NO: 80270
  misc_feature 1..45: note = chr17:31144850-31144895
  misc_feature 1..45: note = Hypo
  source 1..45: mol_type = genomic DNA

SEQ ID NO: 113187 - DNA, 30 bp, Homo sapiens; identical to SEQ ID NO: 45056
  misc_feature 1..30: note = chr17:31162054-31162084
  misc_feature 1..30: note = Hypo
  source 1..30: mol_type = genomic DNA

SEQ ID NO: 113188 - DNA, 155 bp, Homo sapiens; identical to SEQ ID NO: 45057
  misc_feature 1..155: note = chr17:31214020-31214175
  misc_feature 1..155: note = Hypo
  source 1..155: mol_type = genomic DNA

SEQ ID NO: 113189 - DNA, 27 bp, Homo sapiens
  misc_feature 1..27: note = chr17:31370236-31370263
  misc_feature 1..27: note = Hypo
  source 1..27: mol_type = genomic DNA
tcggcacatccccgttttactgatgag

SEQ ID NO: 113190 - DNA, 30 bp, Homo sapiens; identical to SEQ ID NO: 80274
  misc_feature 1..30: note = chr17:31372520-31372550
  misc_feature 1..30: note = Hypo
  source 1..30: mol_type = genomic DNA

SEQ ID NO: 113191 - DNA, 2156 bp, Homo sapiens
  misc_feature 1..2156: note = chr17:31618291-31620447
  misc_feature 1..2156: note = Hyper
  source 1..2156: mol_type = genomic DNA
gttctgccttggcatcgtggagtggtaacactgcaagaggcctggggacagccccgagggggcggaacaccaggcctcctgactgccggggagtggggcgcagagggagcgggttcgcgcggagggcaactcacggaggagaagttgtgcggcccgcagagctcgccgcggtacttgcaggagagcagcatgtcctccagctggtggcccaggcggtccatgaaggcggcgctgattccctcgaagtggcgcggaggcaggaagaggcggaagtccgccagcttgcggaaccactggcggcgcggctcgtcgccccgcagcagctcgctgacaagcgggcgcgcggtgcggttgggcagcagcagcccgagccagtggccggcatagtagaggtcccccttggagaggcgcgggaagcgcagcgggttgttgttgcacacagtgacggcggggaagggtaactggcggctccactcgcggtgcacccgcgtgtgtgacgggaagctgagccagtagagcaagcggttcgaggaccaggacagcagcaagccgaaggatgtacagaaggccagcacccacagcgcccgccgctggaaggagcccccagccgccgtgcgcccggcacacatgtgccgcagcccgtgcagtttagcgcggctcagcgatggccgccccctgcgggcgacccctggcccctgcagcgcccgctcgccgcctctgccgcccccgggctgcccggcagccgccaacgccgcgggcgccggctcctcgcgggccatgcggaagcgtcccgggccggtgagcgcggctgcgggcagcccggctccgccaatccggctcattcattcagcccgcggctggcggcagcggcggcggccccggccgggcggagccgccatgggagtccgcagcagcagtggaagcagcagcagcggcagccgcgcgcagcccgcgccagggaagcgtgcgcccgaaaggagctccggtggcgcggcatgcccgcccggcgccgccgctgccgcctccgcgggcgcccgcccggggctgagcgccgcctcagcccgcagcccctggcagtggcctctcccgagcgcctcccaggctttcccggcccctggtcttcctggaggatgcccggcgcccggcactacttctggaggggtcccactgggagccgcctctccagtccctgggtgctgcgcccgccttccctcgtcctggacctcgggggaccctgagccgagtcccccctgccccgcctaaccccagcttttacgctggtcctgggagaagggccactcggccaccatgcctgatctggacatccccagggaccccaccagcccggcccgtagcccagcggtgctgggacacgggagagaaggcgccaaggaacgagcgcccccagaggcgcaccgcggctcctggctgggcgggcggggtgggtgtgtacgggggtgagtggtcgccttgccggctgccgccttctttcccttcccctccaggacccttccttgttactgctccctgggctgcgctcggcagagacctgcttaggcttccccaagtcctgcgcctaagtcctgccaggcgcccgctctcgcctggggctgagagcttctcagggcgtcctgcgggaggctgttcgccgccggggtccttcaaggatgctagccgcagggaagtgtcgcttctcgcctcggctctcccaggtgcctcgcgtctccagaaaagcccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 113192 - DNA, 184 bp, Homo sapiens; identical to SEQ ID NO: 45058
  misc_feature 1..184: note = chr17:32237066-32237250
  misc_feature 1..184: note = Hypo
  source 1..184: mol_type = genomic DNA

SEQ ID NO: 113193 - DNA, 82 bp, Homo sapiens; identical to SEQ ID NO: 80278
  misc_feature 1..82: note = chr17:32239182-32239264
  misc_feature 1..82: note = Hypo
  source 1..82: mol_type = genomic DNA

SEQ ID NO: 113194 - DNA, 23 bp, Homo sapiens
  misc_feature 1..23: note = chr17:32239704-32239727
  misc_feature 1..23: note = Hypo
  source 1..23: mol_type = genomic DNA
attatagactagggccgggtgag

SEQ ID NO: 113195 - DNA, 30 bp, Homo sapiens; identical to SEQ ID NO: 80280
  misc_feature 1..30: note = chr17:32257150-32257180
  misc_feature 1..30: note = Hypo
  source 1..30: mol_type = genomic DNA

SEQ ID NO: 113196 - DNA, 109 bp, Homo sapiens; identical to SEQ ID NO: 80281
  misc_feature 1..109: note = chr17:32275435-32275544
  misc_feature 1..109: note = Hypo
  source 1..109: mol_type = genomic DNA

SEQ ID NO: 113197 - DNA, 32 bp, Homo sapiens; identical to SEQ ID NO: 80282
  misc_feature 1..32: note = chr17:32478151-32478183
  misc_feature 1..32: note = Hypo
  source 1..32: mol_type = genomic DNA

SEQ ID NO: 113198 - DNA, 221 bp, Homo sapiens; identical to SEQ ID NO: 80283
  misc_feature 1..221: note = chr17:32483992-32484213
  misc_feature 1..221: note = Hyper
  source 1..221: mol_type = genomic DNA

SEQ ID NO: 113199 - DNA, 112 bp, Homo sapiens; identical to SEQ ID NO: 80284
  misc_feature 1..112: note = chr17:32905966-32906078
  misc_feature 1..112: note = Hyper
  source 1..112: mol_type = genomic DNA

SEQ ID NO: 113200 - DNA, 715 bp, Homo sapiens
  misc_feature 1..715: note = chr17:32906304-32907019
  misc_feature 1..715: note = Hyper
  source 1..715: mol_type = genomic DNA
aggggcgagcggaatcgcgaggtcggcccttggcccgagtctcattaaggagccgcgcgcgccgccaggctaggaatgcggaatggacacgtggacagaggagggggagctaggagtcggggagtctccgtggcgcgcgagctgtgggccgcgcgctcgggggccacgtgaccacggggaatctgggaggggtgggagtgagcgcgccaagctcggcgcccgcttctgcccgggtgggcgctgaatcccggacggaggaggagggcgggcgagcgcgagtgtgtgtgtctctctcgagtcatttacggcggagcagccggcgcgagcgccgaggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgcaagctgcgcaggtgccggctgccctggcccctggcgccgcgcccgcgtctcaccgcccgcagcccggactggcgcggcgatccgctcgcccaaactgactcggagggagcgggagccgatgcccggcagcatcgagacagcgggcgaacgggcgtccggggacagggtgggggcggcggggaggaggcgtcggagactctgaacc

SEQ ID NO: 113201 - DNA, 1922 bp, Homo sapiens
  misc_feature 1..1922: note = chr17:32907224-32909146
  misc_feature 1..1922: note = Hyper
  source 1..1922: mol_type = genomic DNA
attagccggctttctcgctccctcgcttctccaagccccatctacatggggcagcccgttctggccgcgccacccttgccccagccgccgagcggctgcctgggcaggaggcgctgagccggcctgtgtggagcctgggccctgatccagactggagaaagcgcgctggagcggaggagcgagccttgcgaggggacaaacatctggccgcccgcctcgggcatccggtctgggcgtcgcctagggtggtggcgaccggcgtcgccagtttcagcaccgcacggaaacttttccttctccagatggattaaagttgtctggattttctctttctttgagaaagacagcattcatttgcacctgacctgggatttttatgctgggctgctgcaggggcttggaggaagaaagcggcgctatccatgtgcggttactaccgaaaccgaggaaactggggattgcgttggaagtcggcaccctcgagtgagttcggattcgagctgggccgtgaggccgggagattcagcactgggctctaggtagcccccgggacgcccgcggccaccgggctccggactgcacgtgcagctccccccgcgcctcgcagatcctgcagggggcaccagctgggggaggtggaggctcctcccgcccggagctgcgcccccaccggctccgagggtgtagccgccagcgcctgggacgccccctccccgcaaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcagcgctactcgcccacggtaagtgtcgcggcgcggactgggggtgaggatgcggcaggcgccactggagggggtacggggaagactggggagaggagcacccacaccccctggactcgcagccgccactccgggtttggcgtctctggctgcagctcgagttaccgccagcccccgagccctccggcgagctcagctgaggggaccgagcccggcgccagaaaagggtggggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagggaagtggactgactccgggccggggagccgccgcggctcgcacgcccgcggtcctgtgagctgcatctaaatggccggcttaggcgagcccggagggcgggggtctgggcacccgcacaggccggggcggtgggccgcgggccgcgcgcggagggagcgggctccgcgctctcgcattctgcaatctgttgcgtctgctccccaggctcgccccgggctccgcggtaaagggggtgggagaaggagggattgaggttggcgcgctttggcggtgggacagcgggcatacgggtggggggcagcgggtttttgaacagcccccaagaatgggaaatcagaccagagggaaggaggctgcagcgggccttccgcaagctggagacgctccaggaggcgaggggagcagaccgaggtgggagggagagagctccgaaaggagagtggagaagcggggccctctgctccctcctaacgtgaaaccagccgacctgggatacat

SEQ ID NO: 113202 - DNA, 205 bp, Homo sapiens; identical to SEQ ID NO: 80291
  misc_feature 1..205: note = chr17:32953266-32953471
  misc_feature 1..205: note = Hyper
  source 1..205: mol_type = genomic DNA

SEQ ID NO: 113203 - DNA, 30 bp, Homo sapiens; identical to SEQ ID NO: 80292
  misc_feature 1..30: note = chr17:32953682-32953712
  misc_feature 1..30: note = Hyper
  source 1..30: mol_type = genomic DNA

SEQ ID NO: 113204 - DNA, 64 bp, Homo sapiens; identical to SEQ ID NO: 80293
  misc_feature 1..64: note = chr17:32965239-32965303
  misc_feature 1..64: note = Hyper
  source 1..64: mol_type = genomic DNA

SEQ ID NO: 113205 - DNA, 211 bp, Homo sapiens; identical to SEQ ID NO: 80294
  misc_feature 1..211: note = chr17:33102688-33102899
  misc_feature 1..211: note = Hypo
  source 1..211: mol_type = genomic DNA

SEQ ID NO: 113206 - DNA, 30 bp, Homo sapiens; identical to SEQ ID NO: 80295
  misc_feature 1..30: note = chr17:33124973-33125003
  misc_feature 1..30: note = Hyper
  source 1..30: mol_type = genomic DNA

SEQ ID NO: 113207 - DNA, 30 bp, Homo sapiens; identical to SEQ ID NO: 80296
  misc_feature 1..30: note = chr17:33179323-33179353
  misc_feature 1..30: note = Hypo
  source 1..30: mol_type = genomic DNA

SEQ ID NO: 113208 - DNA, 100 bp, Homo sapiens; identical to SEQ ID NO: 80298
  misc_feature 1..100: note = chr17:33447192-33447292
  misc_feature 1..100: note = Hypo
  source 1..100: mol_type = genomic DNA

SEQ ID NO: 113209 - DNA, 27 bp, Homo sapiens
  misc_feature 1..27: note = chr17:33601404-33601431
  misc_feature 1..27: note = Hypo
  source 1..27: mol_type = genomic DNA
atggctgaataggaacggctccagtct

SEQ ID NO: 113210 - DNA, 220 bp, Homo sapiens; identical to SEQ ID NO: 80300
  misc_feature 1..220: note = chr17:33672862-33673082
  misc_feature 1..220: note = Hyper
  source 1..220: mol_type = genomic DNA

SEQ ID NO: 113211 - DNA, 320 bp, Homo sapiens; identical to SEQ ID NO: 80301
  misc_feature 1..320: note = chr17:33673302-33673622
  misc_feature 1..320: note = Hyper
  source 1..320: mol_type = genomic DNA

SEQ ID NO: 113212 - DNA, 34 bp, Homo sapiens; identical to SEQ ID NO: 80302
  misc_feature 1..34: note = chr17:33688778-33688812
  misc_feature 1..34: note = Hypo
  source 1..34: mol_type = genomic DNA

SEQ ID NO: 113213 - DNA, 904 bp, Homo sapiens; identical to SEQ ID NO: 80303
  misc_feature 1..904: note = chr17:33700472-33701376
  misc_feature 1..904: note = Hyper
  source 1..904: mol_type = genomic DNA

SEQ ID NO: 113214 - DNA, 30 bp, Homo sapiens; identical to SEQ ID NO: 80304
  misc_feature 1..30: note = chr17:33701582-33701612
  misc_feature 1..30: note = Hyper
  source 1..30: mol_type = genomic DNA

SEQ ID NO: 113215 - DNA, 120 bp, Homo sapiens; identical to SEQ ID NO: 80305
  misc_feature 1..120: note = chr17:33718792-33718912
  misc_feature 1..120: note = Hypo
  source 1..120: mol_type = genomic DNA

SEQ ID NO: 113216 - DNA, 30 bp, Homo sapiens; identical to SEQ ID NO: 80306
  misc_feature 1..30: note = chr17:33772552-33772582
  misc_feature 1..30: note = Hypo
  source 1..30: mol_type = genomic DNA

SEQ ID NO: 113217 - DNA, 444 bp, Homo sapiens; identical to SEQ ID NO: 80307
  misc_feature 1..444: note = chr17:33775327-33775771
  misc_feature 1..444: note = Hyper
  source 1..444: mol_type = genomic DNA

SEQ ID NO: 113218 - DNA, 17 bp, Homo sapiens
  misc_feature 1..17: note = chr17:33877286-33877303
  misc_feature 1..17: note = Hypo
  source 1..17: mol_type = genomic DNA
aggtgcagtggctcacg

SEQ ID NO: 113219 - DNA, 38 bp, Homo sapiens; identical to SEQ ID NO: 45062
  misc_feature 1..38: note = chr17:33917230-33917268
  misc_feature 1..38: note = Hypo
  source 1..38: mol_type = genomic DNA

SEQ ID NO: 113220 - DNA, 30 bp, Homo sapiens; identical to SEQ ID NO: 80310
  misc_feature 1..30: note = chr17:33933196-33933226
  misc_feature 1..30: note = Hypo
  source 1..30: mol_type = genomic DNA

SEQ ID NO: 113221 - DNA, 30 bp, Homo sapiens; identical to SEQ ID NO: 80311
  misc_feature 1..30: note = chr17:33991634-33991664
  misc_feature 1..30: note = Hypo
  source 1..30: mol_type = genomic DNA

SEQ ID NO: 113222 - DNA, 30 bp, Homo sapiens; identical to SEQ ID NO: 80314
  misc_feature 1..30: note = chr17:34400013-34400043
  misc_feature 1..30: note = Hyper
  source 1..30: mol_type = genomic DNA

SEQ ID NO: 113223 - DNA, 399 bp, Homo sapiens; identical to SEQ ID NO: 36457
  misc_feature 1..399: note = chr17:35014243-35014642
  misc_feature 1..399: note = Hyper
  source 1..399: mol_type = genomic DNA

SEQ ID NO: 113224 - DNA, 30 bp, Homo sapiens; identical to SEQ ID NO: 80316
  misc_feature 1..30: note = chr17:35042671-35042701
  misc_feature 1..30: note = Hypo
  source 1..30: mol_type = genomic DNA

SEQ ID NO: 113225 - DNA, 41 bp, Homo sapiens; identical to SEQ ID NO: 80317
  misc_feature 1..41: note = chr17:35054437-35054478
  misc_feature 1..41: note = Hyper
  source 1..41: mol_type = genomic DNA

SEQ ID NO: 113226 - DNA, 445 bp, Homo sapiens; identical to SEQ ID NO: 80318
  misc_feature 1..445: note = chr17:35060232-35060677
  misc_feature 1..445: note = Hyper
  source 1..445: mol_type = genomic DNA

SEQ ID NO: 113227 - DNA, 189 bp, Homo sapiens; identical to SEQ ID NO: 45063
  misc_feature 1..189: note = chr17:35061647-35061836
  misc_feature 1..189: note = Hypo
  source 1..189: mol_type = genomic DNA

SEQ ID NO: 113228 - DNA, 424 bp, Homo sapiens; identical to SEQ ID NO: 80320
  misc_feature 1..424: note = chr17:35078532-35078956
  misc_feature 1..424: note = Hyper
  source 1..424: mol_type = genomic DNA

SEQ ID NO: 113229 - DNA, 834 bp, Homo sapiens
  misc_feature 1..834: note = chr17:35165308-35166142
  misc_feature 1..834: note = Hyper
  source 1..834: mol_type = genomic DNA
gtgtccttgccttgccgtctcccgcattcgggccgctccccgcatttccaccccgctcccactgctgggtaaatgttcatctggacggggacaggatcgggaaccgccgggcagggggtctgcgcggcggcgtcctcccctccccgcccggctctcccgctccatccccgcggcctggccaagggcagcgccaagggcgcccgcggagggcgcagctgccccggacggagcccccgccacccccacagccgcgcgggtgctccagagcatccaacttcatttccacttcaattttatcagcggccggggagccgggcgggagataggaggccggccctgacacgaattagcccggagattgtccgatacgccttggccagggcgccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggcgcggggctccaggacccgtctgctcctggtgcccccagctcctcagggtccggccgggtcacctgggccgatccaggcgggcaggggcctcgctgctcctcccccgcagcccctctcgccctcccggggaccgtgtgcggggagcagctgggagctgcgtctggaggggctgtccgactggggaacttgtcctgtgccttgtccatgccattacattcatcctcccaagaaccctgagaaatgaggagatcgtcagagaaggggaaactgaggctcagagaggcgacagtactcgccc

SEQ ID NO: 113230 - DNA, 181 bp, Homo sapiens; identical to SEQ ID NO: 80323
  misc_feature 1..181: note = chr17:35242096-35242277
  misc_feature 1..181: note = Hyper
  source 1..181: mol_type = genomic DNA

SEQ ID NO: 113231 - DNA, 30 bp, Homo sapiens; identical to SEQ ID NO: 80324
  misc_feature 1..30: note = chr17:35248683-35248713
  misc_feature 1..30: note = Hypo
  source 1..30: mol_type = genomic DNA

SEQ ID NO: 113232 - DNA, 358 bp, Homo sapiens; identical to SEQ ID NO: 12667
  misc_feature 1..358: note = chr17:35285437-35285795
  misc_feature 1..358: note = Hyper
  source 1..358: mol_type = genomic DNA

SEQ ID NO: 113233 - DNA, 432 bp, Homo sapiens; identical to SEQ ID NO: 80326
  misc_feature 1..432: note = chr17:35289269-35289701
  misc_feature 1..432: note = Hyper
  source 1..432: mol_type = genomic DNA

SEQ ID NO: 113234 - DNA, 48 bp, Homo sapiens; identical to SEQ ID NO: 80327
  misc_feature 1..48: note = chr17:35290025-35290073
  misc_feature 1..48: note = Hyper
  source 1..48: mol_type = genomic DNA

SEQ ID NO: 113235 - DNA, 775 bp, Homo sapiens; identical to SEQ ID NO: 80328
  misc_feature 1..775: note = chr17:35290334-35291109
  misc_feature 1..775: note = Hyper
  source 1..775: mol_type = genomic DNA

SEQ ID NO: 113236 - DNA, 1341 bp, Homo sapiens
  misc_feature 1..1341: note = chr17:35291320-35292661
  misc_feature 1..1341: note = Hyper
  source 1..1341: mol_type = genomic DNA
ctctccatgtccctgcgaccgattatgttttaaaacaaaagctcaatggaaacgaaaacaaaacaaaacccaccatttgtctaatgtgctgtccccgtggaggagttaaatctggactccaaacctagaatctggagccaagaggcgcactttgagttgcgctcctggccccccttgcagagacgccagggttggctcctgcggacctgtttactgagccatctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaaggagcccagctgggacgggggcggaggcaagccacccgggactggggccactatagattccagaaaggggcggttgggtcgagggcgctggcggcgagaaccgggacagctgcggggaggggaggagtgtgaggacagcagggctggactggccccctccccgcaggcctcacgcagcgcagcaggctgggaggcgcctgggggtccgggtggaagaagtggggaccccatgccacacggcttttggcgcttgcgggggtgccagaagcctaccgagtaccggtcgtcttccgccgggaagtgccgggtccgcaggaggagcgcgaagccgagtccgagcccgcggagcccgccccctagatcgcagaaccgccttctccatcctctgccctgccccgcgtcggggtctgggagcgaccggcggaggccggcggcgcgccggagctgactagtcccctacgctcctccggcccgcagcggggagcccacatgtgtatgtgcaagaaggtgtggagaaggcgttagggtcccggcacccacgggtcagggcagaacgccaacgagtcgcactgcgggtctccgcggcttcggtttccatgacatggtgacgccggcggcaaggcggggggctgcctgtgggccttgaggttgctgggcggtgcgggcggagtcagcaaaggggcgttggcaaagccctaaaaccccacggttccacggagcgcaagccagattctctgaagcagcttccccgttcgtccgaagagggtattccatctgcacagcgggattccctgccagcccaggttcactgcgactccgcttccccgagcat

SEQ ID NO: 113237 - DNA, 35 bp, Homo sapiens; identical to SEQ ID NO: 36469
  misc_feature 1..35: note = chr17:35292896-35292931
  misc_feature 1..35: note = Hyper
  source 1..35: mol_type = genomic DNA
